United States Patent 12,397,048 (BUNYAVIRALES VACCINE) - sequence listing, part 5

SEQ ID NO: 6015 - RNA, 1449 nt, synthetic construct
  misc_feature 1..1449: note = derived and/or modified CDS sequence (opt3) from CCHFV(China)__AF354296.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgagagattcgtgtttcagatggcctcagctactgacgatgcacaaaaagacagtatttatgccagcgcgcttgtagaggctacgaagttctgtgcccctatatacgaatgcgcatgggtgtcctctaccggaatcgtcaagaaaggtctggagtggtttgaaaagaatgccggcacaattaaatcgtgggatgagtcatatactgagttgaaggtggaagttccaaaaatcgagcagttagctaactaccagcaggcagccctgaagtggaggaaggacattgggttccgggtgaatgctaacaccgccgcgctaagccacaaagtcctcgcagaatataaggtgccgggagagatcgtaatgagtgttaaagaaatgctgtccgatatgatacgccgacgtaatcttatcctgaactctggcggtgacgagaatcccagagggcctgtgagcagggagcatgtcgaatggtgtcgggagtttgtgaagggaaaatacattatggccttcaacccaccctggggcgatatcaataagtccggccgctcagggattgctttggtggccacaggactcgcaaaactggctgaaaccggtggcaagggggtctttgacgaggccaagaaaactgttgaagcgctgaacggatatctcgataagcacaaagacgaggtggataaggccagtgcagacaacatgatcacaaatttactgaaacatatagctaaggcccaagagctttacaagaacagctctgctttgagagcccagggcgcacagattgacaccgccttctcctcatactattggctgtacaaagctggtgcgacgcctgaaacttttccaaccgtaagccagttcctattcgagctcgggaagcaacccaggggaactaaaaagatgaaaaaggcactgcttagtacacctatgaagtggggcaaaaagctgtatgaattgtttgccgatgactctttccagcagaatcggatctacatgcacccagctgtgctcaccgccggccgcatttccgagatgggggtctgctttggaacaatcccggtggcaaaccccgatgacgccgctcagggtagcggccataccaaatcgatcctgaatttacgaacgaacactgaaacaaataacccttgtgccaagaccattgttagactgttcgagatacagaaaactgggtttaatatccaagatatggacattgtggcatctgagcacctccttcaccagtccctggtcggaaagcaatcaccattccagaacgcgtataatgtgaagggcaacgctacaagtgccaatatcatatga

SEQ ID NO: 6016 - RNA, 1449 nt, synthetic construct
  misc_feature 1..1449: note = derived and/or modified CDS sequence (opt3) from CCHFV(China)__AF358784.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaggggtctggaatggtttgagaaaaatgccggcacaattaagtcgtgggacgaatcatatactgagttgaaagtggaggttccaaagatcgaacagttcgctgattaccagcaggcagccttaaaatggcggaaggacattgggtttcgcgtgaacgctaataccacagccctgagccacaaggtcctagcggagtataaagtgccgggagaaatcgtaatgagtgttaaggagatgctctccgatatgatacgacgtagaaacctgatccttaataggggcggtgacgaatctccccgggggcctgtgagccgcgagcatgtcgagtggtgtagagagttcgtgaaaggaaagtacattatggcatttaacccaccctggggcgatatcaataaatccggcaggtcagggattgccctggtggctaccggattggccaagctcgcagaaactgaaggtaaaggcgtcttcgacgaggctaagaagacagttgaagccctgaacgggtatctgaataaacacaaggatgaggtggacaaagcgagtgccgacagcatgatcaccaacctcttaaagcatatagcaaaagctcaagagctgtacaagaactcttccgcccttcgggctcagggagcccagattgatacggcattttcaagctactattggttgtacaaggccggcgtaactcctgaaaccttcccaacagtgagtcagttcctgtttgagctaggtaaacaaccccgcgggactaagaaaatgaagaaagctctcctgtctacccctcttaagtggggaaagaaactgtatgaattgttcgcggacgattcctttcagcagaatcgaatctacatgcacccagcagtcctcacagccggcagaattagcgagatgggcgtgtgcttcgggaccatcccggttgctaaccccgacgatgccgcacagggatcgggtcatacgaagtctatcctgaatttaaggactaacacagaaaccaataacccttgtgccaaaactattgtgaagctgtttgagatacagaaaacaggcttcaatatccaagacatggatattgtcgcttccgagcacctccttcaccagtcactggtggggaagcaaagtccatttcagaacgcctataatgtaaagggaaacgcaaccagcgcgaatatcatatga

SEQ ID NO: 6017 - RNA, 1449 nt, synthetic construct
  misc_feature 1..1449: note = derived and/or modified CDS sequence (opt3) from CCHFV(China)__AF362080.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgagagattcgtgtttcagatggcctcagctactgacgatgcacaaaaagacagtatttatgccagcgcgcttgtagaggctacgaagttctgtgcccctatatacgaatgcgcatgggtgtcctctaccggaatcgtcaagaaaggtctggagtggtttgaaaagaatgccggcacaattaaatcgtgggatgagtcatatactgagttgaaggtggaagttccaaaaatcgagcagttaaccaactaccagcaggctgcactgaagtggaggaaggacattgggttccgggtgaatgccaacacagctgccctaagccacaaagtcctcgcggaatataaggtgccgggagagatcgtaatgagtgttaaagaaatgctgtccgatatgatacgccgacgtaatcttatcctgaacagaggcggtgacgagaatcccagggggcctgtgtctcgggagcatgtcgaatggtgtcgcgagtttgtgaagggaacctacattatggcattcaacccaccctggggcgatatcaataaaagcggcagatccgggattgccttggtggctactggactcgccaagctggcagaaacagagggtaaaggcgtctttgacgaagctaagaagaccgttgaggccctgaacgggtatctcgataaacacaaggacgaggtggataaagcgtcagccgacaacatgatcacgaatttactgaagcatatagcaaaagctcaagaactttacaagaacagtagcgccttgagggctcagggagcccagattgacactgcattctcttcctactattggctgtacaaggccggcgtaacccctgagacatttccaactgtgtcacagttcctattcgaactcggtaaacaaccccgggggaccaagaaaatgaagaaagctctgcttagcacacctatgaagtggggaaagaaactgtatgagttgtttgcggatgacagtttccagcagaatcgcatctacatgcacccagcagtcctcaccgccggccgaatttctgaaatgggcgtgtgctttgggacgatcccggttgctaaccccgatgacgccgcacagggatccggtcatactaagagcatcctgaatttaagaacaaacaccgagactaataacccttgtgccaaaacaattgtgaagctgttcgagatacagaaaaccggctttaatatccaagatatggacattgtcgcttcggaacacctccttcaccagtctctggtggggaagcaatccccattccagaacgcctataatgtaaagggaaacgcaacgtcagcgaatatcatatga

SEQ ID NO: 6018 - RNA, 1449 nt, synthetic construct
  misc_feature 1..1449: note = derived and/or modified CDS sequence (opt3) from CCHFV(China)__AY029157.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgagagattcgtgtttcagatggcctcagctactgacgatgcacaaaaagacagtatttatgccagcgcgcttgtagaggctacgaagttctgtgcccctatatacgaatgcgcatgggtgtcctctaccggaatcgtcaagaaaggtctggagtggtttgaaaagaatgccggcacaattaaatcgtgggatgagtcatatactgagttgaaggtggaagttccaaaaatcgagcagttagctaactaccagcaggcagccctgaagtggaggaaggacattgggttccgggtgaatgctaacaccgccgcgctaagccacaaagtcctcgcagaatataaggtgccgggagagatcgtaatgagtgttaaagaaatgctgtccgatatgatacgccgacgtaatcttatcctgaacagaggcggtgacgagaatcccagggggcctgtgtctcgggagcatgtcgaatggtgtcgcgagtttgtgaagggaaaatacattatggccttcaacccaccctggggcgatatcaataagagcggcagatccgggattgctttggtggccacaggactcgcaaaactggctgaaaccgagggtaagggcgtctttgacgaagccaagaaaactgttgaggcgctgaacgggtatctcgataagcacaaagacgaggtggataaggcctcagcagacaacatgatcacaaatttactgaaacatatagctaaggcccaagaactttacaagaacagtagcgctttgagggcccagggagcacagattgacaccgccttctcttcctactattggctgtacaaagctggcgtaacgcctgagacttttccaaccgtgtcacagttcctattcgaactcggtaagcaaccccgggggactaaaaagatgaaaaaggcgctgcttagcacacctatgaagtggggcaaaaagctgtatgagttgtttgcagatgacagtttccagcagaatcgcatctacatgcacccagccgtcctcaccgctggacgaatttctgaaatgggcgtgtgctttgggacaatcccggttgccaaccccgatgacgcagcccagggatccggtcataccaaaagcatcctgaatttaagaacgaacactgagacaaataacccttgtgctaagaccattgtgaaactgttcgagatacaaaagactggctttaatatccaggatatggacattgtcgcctcggaacacctccttcaccagtctctggtggggaagcaatccccattccagaacgcatataatgtaaaaggaaacgcgacatcagctaatatcatatga

SEQ ID NO: 6019 - RNA, 1449 nt, synthetic construct
  misc_feature 1..1449: note = derived and/or modified CDS sequence (opt3) from CCHFV(DAK 8194)__U88411.1__N
  source 1..1449: mol_type = other RNA
atggagaacaagatcgaagtgaataacaaagacgagctgaataagtggttcgaagagtttaaaaagggcaacgggctcgtcgataccttcacaaatagctactccttttgcgaaaacatgcccaatcttgacagattcgtttttcagatggccggagctactgatgacgcacaaaaagattctatttatgcctcagcgctggtggaggctacgaagtactgtgcccctatatatgagtgcgcatgggtaagtagcaccggtatcgtgaagaggggcttggaatggttcgagaaaaacacagggactattaagtcctgggacgaatcttacaccgagttaaaagtcgatgtgccaaagatcgagcagctggccaattatcagcaggctgcactaaaatggcggaaggacattggatttcgcgttaacgccaatacagctgccctctcgaacaaggtgctgtcagaatacaaagtcccgggcgagatcgtgatgagcgtaaaggaaatgcttagtgatatgatacgacgtagaaatctgatcttgaacaggggtggggacgagaatccccggggacctgtttccaaagaacacattgagtggtgtcgcgagttcgtgaagggcaaatatatcatggcgtttaacccaccctggggcgatgtcaacaagtctgggagaagcggaattgcactcgtggccaccggtctggctaaactggccgaaactgagggcaagggggtgttcgaagaggcaaagaaaacagtcgaagctctcaaggagtacttagacaaacataaggatgaggttgacaaagcctccgcggactcaatggtgaccaatctgcttaagcacatcacgaaggcccaagaattgtacaaaaacagtagcgcactgagggctcagggagcccagatagatactcctttttcttccttctattggctatacaaggctggcgtaaccccagagacatttcccactgtgtcacagttcctcttcgaactgggtaaacaacctcgggggaccaagaaaatgaagaaggcccttctgagcacaccaatgaaatggggaaagaaattgtatgagctctttgcagacgatagtttccagcagaatcgcatttacatgcatccggccgtcctgaccgctggccgaatctctgaaatgggcgtgtgctttgggacgattcccgttgcggaccctgatgacgcagcccagggatccggtcacactaagagcatcttaaacctgagaacatcgtctgagaccaataacccatgtgctaaaactatcgtgaaactcttcgaggtccaaaagacaggctttaatattcaggatatggacatagtggcctccgaacatcttctgcaccagtcattggtagggaagcaaagtcccttccagaacgcatataatgttaagggaaacgccaccagcgctaatatcatttga

SEQ ID NO: 6020 - RNA, 1449 nt, synthetic construct
  misc_feature 1..1449: note = derived and/or modified CDS sequence (opt3) from CCHFV(Drosdov)__U88412.1__N
  source 1..1449: mol_type = other RNA
atggagaacaagatcgaagtgaatagcaaagacgagatgaacaagtggttcgaagagtttaaaaaggaaaatggcctgatggataccttcacaaactcctactctttttgcgagaatgtccccaacctcgacaaattcgtttttcagatggcctcagctactgatgacgcacaaaaggatagtatttatgccagcgcgcttgtggaggctacgaagttctgtgcccctatatacgaatgcgcatgggtatcctctaccgggatcgtgaaaaagggactggagtggtttgagaaaaattcgggtacaattaagtcatgggacgaaaactatactgagttgaaagtcgatgtgccaaagatcgaacagttagccaattaccagcaggctgcactgaagtggagaaaagacattggcttcagggttaacgccaataccgctgccctaagcaacaaggtgctcgcggagtataaagtcccgggggaaatcgtgatgagtgtaaaggagatgctgtccgatatgatacggcgccgaaatcttatcctgaaccgtggaggcgacgaaaatcccagaggtcctgtttctagggagcacgtggagtggtgtcgggaatttgtcaaagggaagtacattatggcattcaacccaccctggggagatatcaacaaaagcggccgctccggcattgccttggtggctacagggctcgccaagctggcagagaccgaaggaaagggtgtgtttgacgaggctaaaaagactgtcgaagccctgaatggctatctcgataaacatagagacgaggttgacaaggcgtcagccgatagtatgatcacaaacttactgaaacacatagcaaaggctcaagagctttacaagaatagctctgccttgagggctcagggggcccagattgacacccctttctcctcattttactggctgtataaagcaggagtgacgccagaaactttccccaccatcagccagttcctatttgagctcggcaagcaacctcggggtactaaaaagatgaaaaaggccctgcttagtacaccaatgaagtgggggaaaaagctgtacgaattgttcgctgatgactcttttcagcagaaccgcatttatatgcatccggcggtactcaccgcaggacgaatctccgagatgggcgtgtgcttcggcacaatccccgtcgccaatcctgatgacgctgcccaggggagcggacacaccaaatcgattctgaacttaagaacgtctactgaaacaaataacccatgtgcaaagaccatagtgaaactgtttgagatccaaaagactggtttcaatattcaggatatggacatcgttgcctccgagcatctccttcaccagtcactggtgggcaagcaaagtccctttcagaacgcttacaatgtcaaagggaacgccacaagcgcaaatataatttga

SEQ ID NO: 6021 - RNA, 1449 nt, synthetic construct
  misc_feature 1..1449: note = derived and/or modified CDS sequence (opt3) from CCHFV(Eskisehir23-2012)__KR092376.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaaaatacaggcactattaagtcgtgggacgaaaactatgccgagttgaaagtcgatgtgccaaagatcgagcagttagctaattaccagcaggcagccctgaagtggagaaaagacattgggttcagggttaacgctaataccgccgcgctatcaaacaaggtgctcgcagaatataaagtcccgggagagatcgtgatgagcgtaaaggaaatgctgagtgatatgatacggcgccgaaatcttatcctgaaccgtggcggtggggagaatcccagaggacctgtttccagggaacacgtggagtggtgtcgggagtttgtcaaaggcaagtacattatggccttcaacccaccctggggcgacatcaacaaatctgggcgcagcggaattgctttggtggccacaggtctcgcaaagctggctgaaaccgagggcaagggggtgtttgatgaagccaaaagaactgtcgaggcgctgaatggatatctcgacaagcatagggatgaagttgacaaagcctccgcagactcaatgatcacaaacttactgaagcacatagctaaagcccaagagctttacaagaatagtagcgctttgcgggcccagggcgcacagattgatacccctttctcttccttttactggctgtataaggccggtgtgacgccagagactttccccaccatctcacagttcctatttgaactcgggaaacaacctcgcggaacaaagaaaatgaagaaagctctgcttagcactccaatgaagtggggcaagaaactgtacgagttgttcgcggacgatagttttcagcagaaccgaatttatatgcatccggcagtactcaccgccggcagaatctctgaaatgggggtgtgcttcggaacaatccccgtcgctaatcctgacgatgccgcacagggttccggccacaccaagagcattctgaacttaaggacgtcgactgagacaaataacccatgtgccaaaaccatagtgaagctgtttgaaatccagaaaactgggttcaatattcaagacatggatatcgttgcttctgagcatctccttcaccagtccctggtgggaaagcaatcaccctttcagaacgcctacaatgtcaagggcaacgcaacaagtgcgaatataatttga

SEQ ID NO: 6022 - RNA, 1449 nt, synthetic construct
  misc_feature 1..1449: note = derived and/or modified CDS sequence (opt3) from CCHFV(Hodzha)__AY223475.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaaaggtctggaatggtttgagaagaatgccggcacaattaaatcgtgggacgaatcatatactgagttgaaggtggaggttccaaaaatcgaacagttagctaactaccagcaggcagccctgaagtggaggaaggatattgggttccgggtgaatgctaacaccgccgcgctaagccacaaagtcctcagtgagtataaggtgccgggagaaatcgtaatgtccgttaaagagatgctgtctgacatgatacgccgacgtaatcttatcctgaacagaggcggtgatgaaaatcccagggggcctgtgagccgggagcatgtcgagtggtgtcgcgaatttgtgaagggaaaatacattatggcattcaacccaccctggggcgacatcaataagtccggcagatcagggattgccttggtggctacaggactcgccaaactggcagagaccgaaggtaagggcgtctttgatgaggctaagaaaactgttgaagccctgaacgggtatctcgacaagcacaaagatgaggtggacaaggcgagtgccgacaacatgacaaccaatttactgaaacatatcgcaaaggctcaagagctttacaagaacagctctgccttgagggctcagggagcccagatagatacggcattctcctcatactattggctgtacaaagccggcgtaactcctgaaacctttccaacagtgagccagttcctattcgagctcggtaagcaaccccgggggactaaaaagatgaaaaaggctctgcttagtacccctatgaagtggggcaaaaagctgtatgaattgtttgcggacgattctttccagcagaatcgcatttacatgcacccagcagtcctcacagccggacgaatctccgagatgggcgtgtgctttgggaccgttccggtggctgaccccgatgacgccgcacagggaagcggtcatacgaaatcgattctgaacttaagaactaatacagaaaccaacaatccttgtgccaagactatcgtcaaactgttcgagatccaaaagacaggctttaacattcaggatatggacatagtggcttctgagcacctccttcaccagtccctggtagggaagcaatcaccattccagaatgcctataacgttaaaggaaatgcaaccagtgcgaacatcatttga

SEQ ID NO: 6023 - RNA, 1449 nt, synthetic construct
  misc_feature 1..1449: note = derived and/or modified CDS sequence (opt3) from CCHFV(Iran-52)__DQ446212.1__N
  source 1..1449: mol_type = other RNA
atggagaacaagatcgaagtgaatagcaaagacgagatgaacaagtggttcgaagagtttaaaaagggcaatgggctggtcgataccttcacaaactcctactctttttgcgaatcagttcccaatctcgacagattcgtgtttcagatggccagtgctactgatgacgcacaaaaagatagcatttatgcctccgcgcttgtagaggctacgaagttctgtgcccctatatacgagtgcgcatgggcctcttcgaccggaatcgtgaagaaaggtctggaatggtttgagaagaacgctggcacaattaaatcatgggacgaaagctatactgagttgaaggtcgaggtgccaaaaatcgaacagttaagtaattaccagcaggcagccctgaagtggaggaaggatattgggttccgggttaacgctaataccgccgcgctatccaacaaagtgctcgcagagtataaggtcccgggagaaatcgtgatgtctgtaaaagagatgctgagcgacatgatacgccgacgtaatcttatcctgaacagaggcggtgatgaaaatcccagggggcctgtttcccgggagcacgtggagtggtgtcgcgaatttgtcaagggaaaatacattatggccttcaacccaccctggggcgacatcaataagtcaggcagaagtgggattgctttggtggccacaggactcgcaaaactggctgagaccgaaggtaagggcgtgtttgatgaggccaagaaaactgtcgaagcgctgaacgggtatctcgacaagcataaagatgaggttgacaaggccagcgcagactctatgatcacaaacttactgaaacacatagctaaggcccaagagctttacaaaaattcctcagctttgagggcccagggagcacagattgataccgtgttcagcagttactattggctgtacaaagccggcgtaacgcctgacacttttccaaccgtgtctcagttcctattcgaactcggtaagcaaccccgggggacaaagaagatgaaaaaggctctgctttccactcctatgaagtggggaaagaagctgtatgagttgtttgcggatgacagcttccagcagaaccgcatctacatgcatccagcagtcctcaccgccggccgaatttcggaaatgggcgtgtgctttgggacaatcccggttgctaatcccgatgacgccgcactgggatctggtcacaccaaatccatcttaaacctgagaacgaatactgagacaaacaatccttgtgccaggaccattgtgaaactcttcgaaatacagaaaactggctttaacatccaagatatggacattgtcgcttcagagcatcttctgcaccagagtttggtggggaagcagagcccattccaaaatgcctataacgtaaagggaaatgcaacatccgcgaacatcatatga

SEQ ID NO: 6024 - RNA, 1449 nt, synthetic construct
  misc_feature 1..1449: note = derived and/or modified CDS sequence (opt3) from CCHFV(Iran-53)__DQ446213.1__N
  source 1..1449: mol_type = other RNA
atggagaacaagatcgaagtgaatagcaaagacgagatgaacaagtggttcgaagagtttaaaaagggcaatgggctggtcgataccttcacaaactcctactctttttgcgaatcagttcccaatctcgacagattcgtgtttcagatggccagtgctactgatgacgcacaaaaagatagcatttatgcctccgcgcttgtagaggctacgaagttctgtgcccctatatacgagtgcgcatgggcctcttcgaccggaatcgtgaagaaaggtctggaatggtttgagaagaacgctggcacaattaaatcatgggacgaaagctatactgagttgaaggtcgaggtgccaaaaatcgaacagttaagtaattaccagcaggcagccctgaagtggaggaaggatattgggttccgggttaacgctaataccgccgcgctatccaacaaagtgctcgcagagtataaggtcccgggagaaatcgtgatgtctgtaaaagagatgctgagcgacatgatacgccgacgtaatcttatcctgaacaagggcggtgatgaaaatcccagagggcctgtttccagggagcacgtggagtggtgtcgggaatttgtcaaaggaaagtacattatggccttcaacccaccctggggcgacatcaataaatcaggccgcagtgggattgctttggtggccacaggactcgcaaagctggctgagaccgaaggtaagggcgtgtttgatgaggccaaaaagactgtcgaagcgctgaacgggtatctcgacaaacataaggatgaggttgacaaagccagcgcagactctatgatcacaaacttactgaagcacatagctaaggcccaagagctttacaaaaattcctcagctttgagagcccagggagcacagattgataccgtgttcagcagttactattggctgtacaaggccggcgtaacgcctgacacttttccaaccgtgtctcagttcctattcgaactcggtaaacaacccagggggacaaagaaaatgaagaaggctctgctttccactcctatgaaatggggaaagaaactgtatgagttgtttgcggatgacagcttccagcagaaccggatctacatgcatccagcagtcctcaccgccggccgcatttcggaaatgggcgtgtgctttgggacaatcccggttgctaatcccgatgacgccgcactgggatctggtcacaccaagtccatcttaaacctgcgaacgaatactgagacaaacaatccttgtgccagaaccattgtgaaactcttcgaaatacagaagactggctttaacatccaagatatggacattgtcgcttcagagcatcttctgcaccagagtttggtggggaagcagagcccattccaaaatgcctataacgtaaaaggaaatgcaacatccgcgaacatcatatga

SEQ ID NO: 6025 - RNA, 1449 nt, synthetic construct
  misc_feature 1..1449: note = derived and/or modified CDS sequence (opt3) from CCHFV(JD 206)__U88414.1__N
  source 1..1449: mol_type = other RNA
atggagaacaagatcgaagtgaatagcaaagacgagatgaacaagtggttcgaagagtttaaaaagggcaatgggctggtcgataccttcacaaactcctactctttttgcgaaaatgttcccaacctcgacagattcgtgtttcagatggcctcagctactgatgacgcacaaaaagatagtatttatgccagcgcgcttgtagaggctacgaagttctgtgcccctatatacgagtgcgcatgggcctcctctaccggaatcgtgaagaaaggtctggaatggtttgagaagaatgctggcacaattaaatcgtgggacgaatcatatactgagttgaaggtcgaggtgccaaaaatcgaacagttaagcaactaccagcaggcagccctgaagtggaggaaggatattgggttccgggttaatgctaacaccgccgcgctaagtaataaagtgctcgcagagtataaggtcccgggagaaatcgtgatgtccgtaaaagagatgctgtctgacatgatacgccgacgtaaccttatcctgaatagaggcggtgatgaaaaccccagggggcctgttagccgggagcacgtggagtggtgtcgcgaatttgtcaagggaatgtacattatggccttcaatccaccctggggcgacatcaacaaatccggcagatcagggattgctttggtggccacaggactcgcaaagctggctgagaccgaaggtaaaggcgtgtttgatgaggccaagaagactgtcgaagcgctgaacgggtatctcgacaaacataaggatgaggttgacaaagccagtgcagacagcatgatcacaaatttactgaagcacatagctaaagcccaagagctttacaagaactcttccgctttgagggcccagggagcacagattgataccgtgttctcaagctactattggctgtacaaggccggcgtaacgcctgacacttttccaaccgtgagtcagttcctattcgaactcggtaaacaaccccgggggacaaagaaaatgaagaaagctctgctttctactcctatgaagtggggaaagaaactgtatgagttgtttgcggatgactccttccagcagaatcgcatctacatgcatccagcagtcctcaccgccggccgaattagcgaaatgggcgtgtgctttgggacaatcccggttgctaaccccgatgacgccgcactgggatcgggtcacaccaagtctatcttaaatctgagaacgaacactgagacaaataacccttgtgccaaaaccattgtgaaactcttcgaaatacagaagactggctttaatatccaagatatggacattgtcgcttccgagcatcttctgcaccagtcattggtggggaagcagagtccattccaaaacgcctataatgtaaagggaaacgcaacaagcgcgaatatcatatga

SEQ ID NO: 6026 - RNA, 1449 nt, synthetic construct
  misc_feature 1..1449: note = derived and/or modified CDS sequence (opt3) from CCHFV(Kashmanov)__DQ211644.1__N
  source 1..1449: mol_type = other RNA
atggagaacaagatcgaagtgaatagcaaagacgagatgaacaagtggttcgaagagtttaaaaaggaaaatggcctgatggataccttcacaaactcctactctttttgcgagaatgtccccaacctcgacaaattcgtttttcagatggcctcagctactgatgacgcacaaaaggatagtatttatgccagcgcgcttgtggaggctacgaagttctgtgcccctatatacgaatgcgcatgggtatcctctaccgggatcgtgaaaaagggactggagtggtttgagaaaaattcgggtacaattaagtcatgggacgaaaactatgccgagttgaaagtcgatgtgccaaagatcgaacagttagctaattaccagcaggcagccctgaagtggagaaaagacattggcttcagggttaacgctaatactgccgcgctaagcaacaaggtgctcgcagagtataaagtcccgggggaaatcgtgatgagtgtaaaggagatgctgtccgatatgatacggcgccgaaatcttatcctgaaccgtggaggcgacgaaaatcccagaggtcctgtttctagggagcacgtggagtggtgtcgggaatttgtcaaagggaagtacattatggccttcaacccaccctggggagatatcaacaaaagcggccgctccggcattgctttggtggccaccgggctcgcaaagctggctgagacagaaggaaagggtgtgtttgacgaggccaaaaagaccgtcgaagcgctgaatggctatctcgataaacatagagacgaggttgacaaggcctcagcagatagtatgatcactaacttactgaaacacatagctaaggcccaagagctttacaagaatagctctgctttgagggcccagggggcacagattgacacacctttctcctcattttactggctgtataaagccggagtgaccccagaaacgttccccactatcagccagttcctatttgagctcggcaagcaacctcggggtaccaaaaagatgaaaaaggctctgcttagtacaccaatgaagtgggggaaaaagctgtacgaattgttcgcggatgactcttttcagcagaaccgcatttatatgcatccggcagtactcactgccggacgaatctccgagatgggcgtgtgcttcggcaccatccccgtcgctaatcctgatgacgccgcacaggggagcggacacacaaaatcgattctgaacttaagaacctctacggaaactaataacccatgtgccaagacaatagtgaaactgtttgagatccaaaagaccggtttcaatattcaggatatggacatcgttgcttccgagcatctccttcaccagtcactggtgggcaagcaaagtccctttcagaacgcctacaatgtcaaagggaacgcaactagcgcgaatataatttga

SEQ ID NO: 6027 - RNA, 1449 nt, synthetic construct
  misc_feature 1..1449: note = derived and/or modified CDS sequence (opt3) from CCHFV(NIV 10405051)__JF922681.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggtgtcctctaccggaatcgtcaagaaaggtctggaatggtttgagaagaatgccggcacaattaaatcgtgggacgaatcatatactgagttgaaggtggaggttccaaaaatcgaacagttagctaactaccagcaggcagccctgaagtggaggaaggatattgggttccgggtgaatgctaacaccgccgcgctaagccacaaagtcctcgcagagtataaggtgccgggagaaatcgtaatgagtgttaaagagatgctgtccgacatgatacgccgacgtaatcttatcctgaacagaggcggtgatgaaaatcccagggggcctgtgtctcgggagcatgtcgagtggtgtcgcgaatttgtgaagggaaaatacattatggccttcaacccaccctggggcgacatcaataagagcggcagatccgggattgctttggtggccacaggactcgcaaaactggctgagaccgaaggtaagggcgtctttgatgaggccaagaaaactgttgaagcgctgaacgggtatctcgacaagcacaaagatgaggtggacaaggcctcagcagacaacatgatcacaaatttactgaaacatatagctaaggcccaagagctttacaagaacagtagcgctttgagggcccagggagcacagattgataccgccttctcttcctactattggctgtacaaagctggcgtaacgcctgaaacttttccaaccgtgtcacagttcctattcgagctcggtaagcaaccccgggggactaaaaagatgaaaaaggcgctgcttagcacacctatgcgctggggaaagaaactgtatgaattgtttgcagacgatagtttccagcagaatcgaatctacatgcacccagccgtcctcaccgctggcagaatttctgagatgggcgtgtgctttgggacaatcccggttgccaaccccgacgatgcagcccagggatccggtcataccaagagcatcctgaatttaaggacgaacactgaaacaaataacccttgtgctaaaaccattgtgaagctgttcgagatacagaaaactggctttaatatccaagacattgatatcgtcgcctcggagcacctccttcaccagtctctggtggggaagcaatccccattccagaacgcatataatgtaaagggaaacgcgacatcagctaatataatttga

SEQ ID NO: 6028 - RNA, 1449 nt, synthetic construct
  misc_feature 1..1449: note = derived and/or modified CDS sequence (opt3) from CCHFV(Oman)__DQ211645.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggcctcctctaccggaatcgtgaagaaaggtctggaatggtttgagaagaatgctggcacaattaaatcgtgggacgaatcatatactgagttgaaggtcgaggtgccaaaaatcgaacagttaagcaactaccagcaggcagccctgaagtggaggaaggatattgggttccgggttaatgctaacaccgccgcgctaagtaataaagtgctcgcagagtataaggtcccgggagaaatcgtgatgtccgtaaaagagatgctgtctgacatgatacgccgacgtaaccttatcctgaatagaggcggtgatgaaaaccccagggggcctgttagccgggagcacgtggagtggtgtcgcgaatttattaagggaaaatacatcatggccttcaatccaccctggggcgacattaacaagtccggcagatcagggatcgctttggtcgccacaggactcgcaaaactggctgagaccgaaggtaagggcgtgtttgatgaggccaagaaaactgtggaagcgctgaacgggtatctcgacaagcataaagatgaggtcgacaaggccagtgcagacagcatgataacaaatttactgaaacacattgctaaggcccaagagctttacaagaactcttccgctttgagggcccagggagcacagatcgataccgttttctcaagctactattggctgtacaaagccggcgtgacgcctgacacttttccaaccgtaagtcagttcctattcgaactcggtaagcaaccccgggggactaaaaagatgaaaaaggctctgctttctacacctatgaagtggggcaaaaagctgtatgagttgtttgcggatgactccttccagcagaatcgcatttacatgcatccagcagtgctcaccgccggacgaatcagcgaaatgggcgtctgctttgggacaatcccggtggctaaccccgatgacgccgcactgggatcgggtcacaccaaatctattttaaatctgagaacgaacactgagacaaataacccttgtgccaagaccatagttaaactcttcgaaatccagaagactggctttaatattcaagatatggacatcgtggcttccgagcatcttctgcaccagtcattggtcgggaagcagagtccattccaaaacgcctataatgtgaaaggaaacgcaacaagcgcgaatataatttga

SEQ ID NO: 6029 - RNA, 1449 nt, synthetic construct
  misc_feature 1..1449: note = derived and/or modified CDS sequence (opt3) from CCHFV(SCT ex Afghanistan)__JX908640.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgacgcacaaaaagatagtatttatgccagcgcgcttgtagaggctacgaagttctgtgcccctatatacgagtgcgcatgggcctcctctaccggaatcgtgaagaaaggtctggaatggtttgagaagaatgctggcacaattaaatcgtgggacgaatcatatactgagttgaaggtcgaggtgccaaaaatcgaacagttaagcaactaccagcaggcagccctgaagtggaggaaggatattgggttccgggttaatgctaacaccgccgcgctaagtaataaagtgctcgcagagtataaggtcccgggagaaatcgtgatgtccgtaaaagagatgctgtctgacatgatacgccgacgtaaccttatcctgaatagaggcggtgatgaaaaccccagggggcctgttagccgggagcacgtggagtggtgtcgcgaatttattaagggaaaatacatcatggccttcaatccaccctggggcgacattaacaagtccggcagatcagggatcgctttggtcgccacaggactcgcaaaactggctgagaccgaaggtaagggcgtgtttgatgaggccaagaaaactgtggaagcgctgaacgggtatctcgacaagcataaagatgaggtcgacaaggccagtgcagacagcatgataacaaatttactgaaacacattgctaaggcccaagagctttacaagaactcttccgctttgagggcccagggagcacagatcgataccgttttctcaagctactattggctgtacaaagccggcgtgacgcctgaaacttttccaaccgtaagtcagttcctattcgagctcggtaagcaaccccgggggactaaaaagatgaaaaaggctctgctttctacacctatgaagtggggcaaaaagctgtatgaattgtttgcggacgattccttccagcagaatcgcatttacatgcatccagcagtgctcaccgccggacgaatcagcgagatgggcgtctgctttgggacaatcccggtggctaaccccgacgatgccgcactgggatcgggtcacaccaaatctattttaaatctgagaacgaacactgaaacaaataacccttgtgccaagaccatagttaaactcttcgagatccagaagactggctttaatattcaagacatggatatcgtggcttccgagcatcttctgcaccagtcattggtcgggaagcagagtccattccaaaacgcctataatgtgaaaggaaacgcaacaagcgcgaatataatttga

SEQ ID NO: 6030 - RNA, 1449 nt, synthetic construct
  misc_feature 1..1449: note = derived and/or modified CDS sequence (opt3) from CCHFV(Semunya)__DQ076413.1__N
  source 1..1449: mol_type = other RNA
atggagaacaagatcgaagtgaccagcaaagacgagatgaatagatggttcgaagagtttaagaaatccaacggcctggtcgatacattcactaattcttactcattttgcgaaagtgttcccaacctcgacaggttcgtgtttcagatggccagcgctacggatgacgcacaaaaggattccatttatgcctctgcgcttgtagaggctaccaaattctgtgcccctatatacgagtgcgcatgggtgtcgtcaacagggatcgtcaagaagggactggaatggtttgagaaaaatgccggtactattaagagctgggacgaaagttataccgagttgaaagtgggcgttccaaagatcgagcagttagctaactaccagcaggcagccctgaaatggcggaaggatattgggttccgcgtgaatgctaacacagccgcgctatccaataaggtcctcgcagaatataaagtgccgggagagatcgtaatgtctgttaaggaaatgctgagcgacatgatacgacgtagaaaccttatcctgaataggggcggtgatgagaacccccgggggcctgtgtcccgcgaacacgtcgagtggtgtagagagtttgtgaaaggaaagtacattatggccttcaatccaccctggggcgacatcaacaaatcaggcaggagtgggattgctttggtggccaccggactcgcaaagctggctgaaactgagggtaaaggcgtctttgatgaagccaagaagacagttgaggcgctgaatgggtatctcgacaaacataaggatgaagtggacaaagccagcgcagacggaatggtaaccaacttactgaagcacatcgctaaagcccaagagctttacaagaactcttccgctttgcgggcccagggcgcacagatagatacgcctttcagctcattttactggctgtataaggccggtgtgagtccagagactttccccaccgtctctcagttcctatttgaactcgggaaacaacctcgcggaacaaagaaaatgaagaaagctctgctttccactccaatgaagtggggcaagaaactgtacgagttgttcgcggacgatagctttcaggaaaatcgaatttatatgcatccggcagtgctcaccgccggcagaatctcggagatgggggtttgcttcggaacaattcccgtggctaaccctgacgatgccgcacagggttctggccacaccaagtccatcctgaatttaaggacgaacactgaaacaaataacccatgtgccaaaaccatcgtcaagctgtttgagattcagaaaactgggttcaatatacaagacatggatatcgtggcttcagagcatctccttcaccagagtctggtaggaaagcagagcccctttcaaaacgcctacaatgttaagggcaacgcaacatccgcgaatattatctga

SEQ ID NO: 6031 - RNA, 1449 nt, synthetic construct
  misc_feature 1..1449: note = derived and/or modified CDS sequence (opt3) from CCHFV(SK 2015/human)__KX129738.1__N
  source 1..1449: mol_type = other RNA
atggagaacaagatcgaagtgaataacaaagacgagatgaataagtggttcgaagagtttaaaaagggcaacgggctggtcgatacttacacaaatagctattccttctgcgaatctgttcccaacctcgacagatttgtgttccagatggcctcagctactgatgacgcacaaaaagatagtatttacgccagcgcgcttgtagaggctacgaagttttgtgcccctatatatgagtgcgcatgggcctcctctaccggaatcgtgaagaaaggtctggaatggttcgagaagaatgctggcacaattaaattgtgggacgaatcgtacgcagagttaaaggtcgaggtgccaaaaatcgaacagctgtcaaactatcagcaggccgctctaaagtggaggaaggatattgggtttcgggttaatgccaacactgcggcactcagcaataaagtgctggccgagtacaaggtcccgggagaaatcgtgatgagtgtaaaagagatgctttccgacatgatacgccgacgtaacctgatcttgaatagaggcggtgatgaaaaccccagggggcctgtttctcgggagcacgtggagtggtgtcgcgagttcgtcaagggaaaatatattatggcttttaatccaccctggggcgacatcaacaagagcggcagatccgggattgccctcgtggcaaccggactggctaaactggccgagacagaaggtaagggcgtgttcgatgaggcgaagaaaaccgtcgaagccctcaacgggtacttagacaagcataaagatgaggttgacaaggcatcagctgacagtatgatcactaatctgcttaaacacatagccaaggctcaagagttgtacaagaacagctctgccctgagggcacagggagcccagattgatacagtgttttcctcatattactggctatataaagctggcgtaacccctgacacgttcccaactgtgagccagtttctcttcgaactgggtaagcaaccccgggggaccaaaaagatgaaaaaggcgcttctgagtacacctatgaagtggggcaaaaagttgtacgaactcttcgcagatgactcttttcagcagaatcgcatctatatgcatccagccgtcctgactgctggacgaatttccgaaatgggcgtgtgcttcgggaccgttccggtggccaaccccgatgacgcagccttaggaagcggtcacacaaaatcgatcctgaatctcagaaccaacacggagactaataacccttgtgctaagacaatcgtcaaactttttgaaattcagaagaccggcttcaatatacaagatatggacatcgtggcctctgagcatctgttgcaccagtccctagtagggaagcagtcaccatttcaaaacgcatacaatgttaaaggaaacgcgaccagtgctaatattatctga

SEQ ID NO: 6032 - RNA, 1449 nt, synthetic construct
  misc_feature 1..1449: note = derived and/or modified CDS sequence (opt3) from CCHFV(SPU128/81/7)__DQ076415.1__N
  source 1..1449: mol_type = other RNA
atggagaacaagatcgaagtgaataacaaacacgagatgaataagtggttcgaagagtttaaaaagggcaacgggctggtcgacaccttcacaaatagctactccttttgcgaatctgttcccaacctcgataaattcgtgtttcagatggcctcagctactgacgatgcacaaaaggacagtatttatgccagcgcgcttgtagaggctacgaagttctgtgcccctatatacgagtgcgcatgggtgtcctctaccggaatcgtcaaaagaggtctggaatggtttgagaagaatgccggcacaattaaatcgtgggatgaatcatatactgagttgaaggtggacgttccaaaaatcgagcagttagctaactaccagcaggcagccctgaagtggaggaaggatattgggttccgggtgaatgctaacaccgccgcgctaagcaataaagtcctcgcagaatataaggtgccgggagagatcgtaatgagtgttaaagaaatgctgtccgacatgatacgccgacgtaaccaaatccttaatagaggcggtgatgagaaccccagggggcctgtgtctcgggaacacgtcgactggtgtcgcgagtttgtgaagggaaaatacattatggccttcaatccaccctggggcgatatcaacaagagcggcagatccgggattgctctggtggccacaggattggcaaaactcgctgagaccgaaggtaagggcgtctttgacgaggccaagaaaactgttgaagtgctgaacgggtatctggataagcacaaagacgaggtagacagggcgtcagccgatagtatgatcacaaatctcttaaagcatatagcaaaagctcaggaactgtacaagaacagctctgcccttcgggctcagggagcccagattgacaccgcattctcctcatactattggttgtacaaggccggcgtgacgcctgagacttttccaaccgtcagccaattcctgttcgagctaggtaaacagccccgcgggacaaagaaaatgaagaaagctctcctgagtactcctatgaagtggggaaagaaactttatgaactgtttgcggatgactctttccagcagaatcgaatctacatgcacccagcagtgttgaccgccggcagaatttccgagatgggcgtttgctttgggacaatcccggtggctaaccccgatgacgccgcacaaggaagcggtcataccaagtcgatcctcaatctgaggacgaacactgaaacaaataacccttgtgcccggaccattgtcaaattattcgagatacagaagactggctttaatatccaggatatggacattgtggcttctgaacatctgctccaccaatcccttgtagggaaacagtcaccattccagaacgcctataatgttaagggaaacgcaacaagtgcgaatatcatatga

SEQ ID NO: 6033 - RNA, 1449 nt, synthetic construct
  misc_feature 1..1449: note = derived and/or modified CDS sequence (opt3) from CCHFV(Sudan Al-Fulah 4-2008)__GQ862372.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggcctcagctactgatgacgcacaaaaggatagtatttatgccagcgcgcttgtagaggctacgaagttctgtgcccctatatacgagtgcgcatgggtgtcctctaccggaatcgtcaaaagaggtctggaatggtttgagaagaatgccggcacaattaaatcgtgggacgaatcatatactgagttgaaggtggatgttccaaaaatcgagcagttagctaactaccagcaggcagccctgaagtggaggaaggacattgggttccgggtgaatgctaacaccgccgcgctaagcaataaagtcctcgcagaatataaggtgccgggagagatcgtaatgagtgttaaagaaatgctgtccgatatgatacgccgacgtaaccaaatccttaatagaggcggtgacgagaaccccagggggcctgtgtctcgggaacacgtcgattggtgtcgcgagtttgtgaagggaaaatacattatggccttcaatccaccctggggcgacatcaacaagagcggcagatccgggattgctctggtggccacaggattggcaaaactcgctgagaccgaaggtaagggcgtctttgatgaggccaagaaaactgttgaagcgctgaacgggtatctggacaagcataaagacgaggtggatagggcctcagcagacagtatgatcacaaatctcttaaagcacatagctaaagcccaggaactgtacaagaacagctctgcccttcgggctcagggagcacagattgataccgccttctcctcatactattggttgtacaaggctggcgtaacgcctgagacttttccaaccgtgagccaattcctgttcgagctaggtaaacagccccgcgggacaaagaaaatgaagaaagcgctcctgagtactcctatgaagtggggaaagaaactttatgaactgtttgcagacgattctttccagcagaatcgaatctacatgcatccagccgtcttgaccgctggcagaatttccgagatgggcgtgtgctttgggacaatcccggttgccaaccccgacgatgcagcccaaggaagcggtcacaccaagtcgatcctcaatctgaggacgaacactgaaacaaataacccttgtgctcggaccattgtgaaattattcgagatacagaagactggcttttctatccaggacatggatattgtcgcctccgaacatctgctccaccaatcacttgtggggaaacagagtccattccagaatgcatataacgtaaagggaaatgcgacaagcgctaacatcatatga

SEQ ID NO: 6034 - RNA, 1449 nt, synthetic construct
  misc_feature 1..1449: note = derived and/or modified CDS sequence (opt3) from CCHFV(TAJUK)__JN086996.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggcctcagctactgatgaggcacaaaaagacagtatttatgccagcgcgcttgtagaggctacgaagttctgtgcccctatatacgaatgcgcatgggtgtcctctaccggaatcgtcaagaaaggtctggagtggtttgaaaagaatgccggcacaattaaatcgtgggatgagtcatatactgagttgaaggtggaagttccaaaaatcgagcagttagctaactaccagcaggcagccctgaagtggaggaaggacattgggttccgggtgaatgctaacaccgccgcgctaagccacaaagtcctcgcagaatataaggtgccgggagagatcgtaatgagtgttaaagaaatgctgtccgatatgatacgccgacgtaatcttatcctgaacagaggcggtgacgagaatcccagggggcctgtgtctcgggagcatgtcgaatggtgtcgcgagtttgtgaagggaaaatacattatggccttcaacccaccctggggcgatatcaataagagcggcagatccgggattgctttggtggccacaggactcgcaaaactggctgaaaccgagggtaagggcgtctttgacgaagccaagaaaactgttgaggcgctgaacgggtatctcgataagcacaaagacgaggtggataaggcctcagcagacaacatgatcacaaatttactgaaacatatagctaaggcccaagaactttacaagaacagtagcgctttgagggcccagggagcacagattgacaccgccttctcttcctactattggctgtacaaagctggcgtaacgcctgagacttttccaaccgtgtcacagttcctattcgaactcggtaagcaaccccgggggactaaaaagatgaaaaaggcgctgcttagcacacctatgaagtggggcaaaaagctgtatgagttgtttgcagatgacagtttccagcagaatcgcatctacatgcacccagccgtcctcaccgctggacgaatttctgaaatgggcgtgtgctttgggacaatcccggttgccaaccccgatgacgcagcccagggatccggtcataccaaaagcatcctgaatttaagaacgaacactgagacaaataacccttgtgctaagaccattgtgaaactgttcgagatacaaaagactggctttaatatccaggatatggacattgtcgcctcggaacacctccttcaccagtctctggtggggaagcaatccccattccagaacgcatataatgtaaaaggaaacgcgacatcagctaatatcatatga

SEQ ID NO: 6035 - RNA, 1449 nt, synthetic construct
  misc_feature 1..1449: note = derived and/or modified CDS sequence (opt3) from CCHFV(UG3010)__DQ211650.1__N
  source 1..1449: mol_type = other RNA
atggagaacaagatcgaagtgaccagcaaagacgagatgaatagatggttcgaagagtttaagaaatccaacggcctggtcgatacattcactaattcttactcattttgcgaaagtgttcccaacctcgacaggttcgtgtttcagatggccagcgctacggatgacgcacaaaaggattccatttatgcctctgcgcttgtagaggctaccaaattctgtgcccctatatacgagtgcgcatgggtgtcgtcaacagggatcgtcaagaagggactggaatggtttgagaaaaatgccggtactattaagagctgggacgaaagttataccgagttgaaagtgggcgttccaaagatcgagcagttagctaactaccagcaggcagccctgaaatggcggaaggatattgggttccgcgtgaatgctaacacagccgcgctatccaataaggtcctcgcagaatataaagtgccgggagagatcgtaatgtctgttaaggaaatgctgagcgacatgatacgacgtagaaaccttatcctgaataggggcggtgatgagaacccccgggggcctgtgtcccgcgaacacgtcgagtggtgtagagagtttgtgaaaggaaagtacattatggccttcaatccaccctggggcgacatcaacaaatcaggcaggagtgggattgctttggtggccaccggactcgcaaagctggctgaaactgagggtaaaggcgtctttgatgaagccaagaagacagttgaggacctgaatgggtatctcgataaacataaggacgaagtggacaaagcgagcgccgatggaatggtaaccaacttactgaagcacatcgcaaaagctcaagagctttacaagaactcttccgccttgcgggctcagggcgcccagatagacacgcctttcagctcattttactggctgtataaggccggtgtgagtccagagactttccccaccgtctctcagttcctatttgaactcgggaaacaacctcgcggaacaaagaaaatgaagaaagcactgctttccactccaatgaagtggggcaagaaactgtacgagttgttcgctgatgacagctttcaggaaaatcgaatttatatgcatccggcggtgctcaccgcaggcagaatctcggagatgggggtttgcttcggaacaattcccgtggccaaccctgatgacgctgcccagggttctggccacaccaagtccatcctgaatttaaggacgaacactgaaacaaataacccatgtgcaaaaaccatcgtcaagctgtttgagattcagaaaactgggttcaatatacaagatatggacatcgtggcctcagagcatctccttcaccagagtctggtaggaaagcagagcccctttcaaaacgcttacaatgttaagggcaacgccacatccgcaaatattatctga

SEQ ID NO: 6036 - RNA, 1449 nt, synthetic construct
  misc_feature 1..1449: note = derived and/or modified CDS sequence (opt3) from CCHFV(UGANDA 3010)__U88416.1__N
  source 1..1449: mol_type = other RNA
atggagaacaagatcgaagtgaccagcaaagacgagatgaatagatggttcgaagagtttaagaaatccaacggcctggtcgatacattcactaattcttactcattttgcgaaagtgttcccaacctcgacaggttcgtgtttcagatggccagcgctacggatgacgcacaaaaggattccatttatgcctctgcgcttgtagaggctaccaaattctgtgcccctatatacgagtgcgcatgggtgtcgtcaacagggatcgtcaagaagggactggaatggtttgagaaaaatgccggtactattaagagctgggacgaaagttataccgagttgaaagtgggcgttccaaagatcgagcagttagctaactaccagcaggcagccctgaaatggcggaaggatattgggttccgcgtgaatgctaacacagccgcgctatccaataaggtcctcgcagaatataaagtgccgggagagatcgtaatgtctgttaaggaaatgctgagcgacatgatacgacgtagaaaccttatcctgaataggggcggtgatgagaacccccgggggcctgtgtcccgcgaacacgtcgagtggtgtagagagtttgtgaaaggaaagtacattatggccttcaatccaccctggggcgacatcaacaaatcaggcaggagtgggattgctttggtggccaccggactcgcaaagctggctgaaactgagggtaaaggcgtctttgatgaagccaagaagacagttgaggacctgaatgggtatctcgataaacataaggacgaagtggacaaagcgagcgccgatggaatggtaaccaacttactgaagcacatcgcaaaagctcaagagctttacaagaactcttccgccttgctgctacagggcgctcagatagacacgcctttcagctcattttactggctctataaggccggtgtgagtccagagactttccccaccgtctctcagttcctgtttgaacttgggaaacaacctcggggaacaaagaaaatgaagaaagcactgttgtccactccaatgaagtggggcaagaaactctacgagctgttcgccgatgacagctttcaggaaaatcgcatttatatgcatccggctgtgttaaccgcgggccgaatctcggagatgggggtttgcttcggaacaattcccgtggcaaaccctgatgacgccgctcagggttctggccacaccaagtccatcctgaatctcgggacgaacactgaaacaaataacccatgtgccaaaaccatcgtcaaactttttgagattcagaagactggattcaatatacaagatatggacatcgtggcatcagagcatctgttgcaccagagtctagtaggcaagcagagcccctttcaaaacgcctacaatgttaagggtaacgctacatccgccaatattatctga

SEQ ID NO: 6037 - RNA, 1449 nt, synthetic construct
  misc_feature 1..1449: note = derived and/or modified CDS sequence (opt3) from CCHFV(UK ex Bulgaria)__KM201260.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgagattctgtgcccctatatacgagtgcgcatgggtatcctctaccggaatcgtgaagaaaggtctggaatggtttgagaaaaattcgggcacaattaaatcatgggacgaaaactatgccgagttgaaggtcgatgtgccaaaaatcgagcagttagctaattaccagcaggcagccctgaagtggaggaaggacattgggttccgggttaacgctaatactgccgcgctaagcaacaaagtgctcgcagaatataaggtcccgggagagatcgtgatgagtgtaaaagaaatgctgtccgatatgatacgccgacgtaatcttatcctgaacagaggcggtgacgagaatcccagggggcctgtttctcgggaacacgtggagtggtgtcgcgagtttgtcaagggaaaatacattatggccttcaacccaccctggggcgatatcaacaagagcggcagatccgggattgctttggtggccaccggactcgcaaaactggctgaaacagagggtaagggcgtgtttgacgaagccaagaaaaccgtcgaggcgctgaatgggtatctcgataagcatagggacgaagttgacaaagcctcagcagatagtatgatcactaacttactgaagcacatagctaaagcccaagagctttacaagaatagctctgctttgcgggcccagggagcacagattgacacacctttctcctcattttactggctgtataaggccggcgtgaccccagagacgttccccactatcagccagttcctatttgaactcggtaaacaacctcgcgggaccaagaaaatgaagaaagctctgcttagtacaccaatgaagtggggaaagaaactgtacgagttgttcgcggatgactcttttcagcagaaccgaatttatatgcatccggcagtactcactgccggcagaatctccgaaatgggcgtgtgcttcgggaccatccccgtcgctaatcctgatgacgccgcacagggaagcggtcacacaaagtcgattctgaacttaaggacctctacggagactaataacccatgtgccaaaacaatagtgaagctgtttgaaatccaaaagaccggcttcaatattcaggatatggacatcgttgcttccgagcatctccttcaccagtcactggtggggaagcaaagtccctttcagaacgcctacaatgtcaagggaaacgcaactagcgcgaatataatttga

SEQ ID NO: 6038 - RNA, 1449 nt, synthetic construct
  misc_feature 1..1449: note = derived and/or modified CDS sequence (opt3) from CCHFV(Yozgat19-2012)__KR092375.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaaaattcgggcacaattaagtcatgggacgaaaactatgccgagttgaaagtcgatgtgccaaagatcgagcagttagctaattaccagcaggcagccctgaagtggagaaaagacattgggttcagggttaacgctaatactgccgcgctaagcaacaaggtgctcgcagaatataaagtcccgggagagatcgtgatgagtgtaaaggaaatgctgtccgatatgatacggcgccgaaatcttatcctgaaccgttctggcgacgagaatcccagaggtcctgttagcagggaacacgtggagtggtgtcgggagtttgtcaaagggaagtacattatggccttcaacccaccctggggagatatcaacaaatccggccgctcaggcattgctttggtggccaccgggctcgcaaagctggctgaaacagagggaaagggtgtgtttgacgaagccaaaaagaccgtcgaggcgctgaatggctatctcgataaacatagagacgaagttgacaaggccagtgcagatagcatgatcactaacttactgaaacacatagctaaggcccaagagctttacaagaatagctccgctttgagggcccagggggcacagattgacacacctttctcatctttttactggctgtataaagccggagtgaccccagagacgttccccactatcagtcagttcctatttgaactcggcaagcaacctcggggtaccaaaaagatgaaaaaggctctgctttctacaccaatgaagtgggggaaaaagctgtacgagttgttcgcggatgactcctttcagcagaaccgcatttatatgcatccggcagtactcactgccggacgaatcagcgaaatgggcgtgtgcttcggcaccatccccgtcgctaatcctgatgacgccgcacaggggtcgggacacacaaaatctattctgaacttaagaacctccacggagactaataacccatgtgccaagacaatagtgaaactgtttgaaatccaaaagaccggtttcaatattcaggatatggacatcgttgcttcagagcatctccttcaccagagtctggtgggcaagcaaagcccctttcagaacgcctaccacgtcaaagggaatgcaacttccgcgaacataatttga

SEQ ID NO: 6039 - RNA, 1449 nt, synthetic construct
  misc_feature 1..1449: note = derived and/or modified CDS sequence (opt3) from CCHFV(Yozgat207-2011)__KR092377.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaaaattcgggcacaattaagtcatgggacgaaaactatgccgagttgaaagtcgatgtgccaaagatcgagcagttagctaattaccagcaggcagccctgaagtggagaaaagacattgggttcagggttaacgctaatactgccgcgctaagcaacaaggtgctcgcagaatataaagtcccgggagagatcgtgatgagtgtaaaggaaatgctgtccgatatgatacggcgccgaaatcttatcctgaaccgtggcggtgacgagaatcccagagggcctgtttctagggaacacgtggagtggtgtcgggagtttgtcaaaggaaagtacattatggccttcaacccaccctggggcgatatcaacaaaagcggccgctccgggattgctttggtggccaccggactcgcaaagctggctgaaacagagggtaagggcgtgtttgacgaagccaaaaagaccgtcgaggcgctgaatgggtatctcgataaacatagagacgaagttgacaaggcctcagcagatagtatgatcactaacttactgaaacacatagctaaggcccaagagctttacaagaatagctctgctttgagggcccagggagcacagattgacacacctttctcctcattttactggctgtataaagccggcgtgaccccagagacgttccccactatcagccagttcctatttgaactcggtaagcaacctcgggggaccaaaaagatgaaaaaggctctgcttagtacaccaatgaagtggggcaaaaagctgtacgagttgttcgcggatgactcttttcagcagaaccgcatttatatgcatccggcagtactcactgccggacgaatctccgaaatgggcgtgtgcttcgggaccatccccgtcgctaatcctgatgacgccgcacagggaagcggtcacacaaaatcgattctgaacttaagaacctctacggagactaataacccatgtgccaagacaatagtgaaactgtttgaaatccaagagaccggcttcaatattcaggatatggacatcgttgcttccgagcatctccttcaccagtcactggtggggaagcaaagtccctttcagaacgcctacaatgtcaagggaaacgcaactagcgcgaatataatttga

SEQ ID NO: 6040 - RNA, 1452 nt, synthetic construct
  misc_feature 1..1452: note = derived and/or modified CDS sequence (opt3) from DUGV(ArD44313)__AF434161.1__N
  source 1..1452: mol_type = other RNA
atggagaaccagatcaaggccaataacaaaaaggagttcgacgaatggtttaaacccttcagcgaaaagctgcaactcagatccaatcttaccaactctgcttcactgtgcgatagggtgcctgacttggcattagccgagatgaaaatggcgctggctacagatgacaaggaaaaggatagtatttttagcaatgccctagtcgaggcaactcggttctgtgccccaatatacgagtgcgcttggacgtgttccaccggcgttgtgcagaaatctctctcgtggtttgacaagaacaaagatttcatcaagctgtgggacgcaaaatatatggatcttaagaaggggattccggaacccgagcagctggtatcataccagcaagccgctcagaaatggcgcaaggacgtgggatatgaaatcaatcagtttacacgtagcttgactcaccctgtcgtggccgagtacaaagttccaggtgagattgcggtggatgtcaaggaaatgctcagtgacatgatccgaagaaggaacgtgctgctgaatggcgatggggagaacgcaggcaaaaagggacccatatcccgggaacatgtatcttggggtcgcgagctcgccgggggaaaattccaggttgtgtttaatcctccatggggcgacatcaacaagtgcggcaagagcgggattcccttagctgccaccgcaatggtcaaagtggctgaactggacggatccaagaaacttgaggatatcagacaagccttgctggacctaaagaaatgggtggaggataataaggacgcgctcgaagatggtaagggcaacgagctggtccagacaatgaccaaacaccttgcccaggcagttgaactgtcaaagaaaagtaatgctttgagggcccagggggctcaaattgacactcctttcagcgcctattactgggcatggtctgccggagtgaagccagagacatttttcaccctctcccagtttctgttcgaaatgggccagtcagctcggggtgggaaaaagatgatcaaggcgttaacgagcactccgctgcgctggggaaaaggcctcataaaccttttcgcagatgacgattttctgggcaaccgattgtatatgcatcccgccgtactaacccctgggagaatgagtgagatgggagcttgtttcggtgtgattccagtcgcctctcccgaggacgcaatcctgggctccgggcacagcaagaatattctcaactttaaaatcgatacatcggtgcaaaatccttgcgcctctactatcgttcagctgtacaggattcagaagtccggattcgaccttgaatcactggaggtggtcagtaccgaacatttgctccaccagagctttgtgggcaaacggtgtccaacacaaaacgcttacaaggtacgtggtaatgccaccaacgttaatataatctga

SEQ ID NO: 6041 - RNA, 1452 nt, synthetic construct
  misc_feature 1..1452: note = derived and/or modified CDS sequence (opt3) from DUGV(ArD16095)__AF434162.1__N
  source 1..1452: mol_type = other RNA
atggagaaccagatcaaggccaataacaaaaaggagttcgacgaatggtttaaacccttcagcgaaaagctgcaactcagatccaatcttaccaactctgcttcactgtgcgatagggtgcctgacttggcattagccgagatgaaaatggcgctggctacagatgacaaggaaaaggatagtatttttagcaatgccctagtcgaggcaactcggttctgtgccccaatatacgagtgcgcttggacgtgttccaccggcgttgtgcagaaatctctctcgtggtttgacaagaacaaagatttcatcaagctgtgggactcaaaatatatggatcttcgcaaggggattccggaacccgagcagctggtaagctaccagcaagcagcccagaagtggcgaaaagacgtgggatatgaaatcaatcagtttacacgtagtttgactcaccctgtcgtggctgagtacaaggttccaggtgagattgccgtggatgtcaaagaaatgctctccgacatgatcagaaggcggaacgtgctgctgaatggcgatggggagaacgcgggaaagaaaggccccatatctcgcgaacatgtaagctggggtagagagctcgcagggggaaagttccaggttgtgtttaatcctccatggggcgacatcaacaaatgcggcaagtccgggattcccttagccgctaccgccatggtcaaggtggcagaactggacggatcaaagaaacttgaggatatcaggcaagctctactggacttgaaaaagtgggtggaggataataaagacgccctcgaagatggtaagggcaacgagctggtccagacaatgaccaagcaccttgcgcaggccgttgaactgagtaaaaagagcaatgcattgcgggctcagggggcccaaattgacactcctttctctgcttattactgggcctggtccgcaggagtgaaaccagagacatttttcaccctctcacagtttctgttcgaaatgggccagagcgcccgcggtgggaagaaaatgatcaaggctttaacgagtactccgctgcgatggggaaagggcctcataaaccttttcgcggatgacgatttttctggcaacagactgtatatgcatcccgcagtattgacccctgggaggatgtccgagatgggagcctgtttcggtgtgattccagtcgctagccccgaggacgccatcctaggctcggggcactctaaaaatattctgaactttaagatcgatacatccgtgcaaaatccttgcgcatcaactatcgttcagctctaccggattcagaaaagtggattcgacctggaaagccttgaggtggtctccaccgaacatctgttgcaccagtcttttgtgggcaagcgttgtccaacacaaaacgcctacaaagtacgcggtaatgctaccaacgttaatataatctga

SEQ ID NO: 6042 - RNA, 1452 nt, synthetic construct
  misc_feature 1..1452: note = derived and/or modified CDS sequence (opt3) from DUGV(IbH11480)__AF434163.1__N
  source 1..1452: mol_type = other RNA
atggagaaccagatcaaggccaataacaaaaaggagttcgacgaatggtttaaacccttcagcgaaaagctgcaactcagatccaatcttaccaactctgcttcactgtgcgatagggtgcctgacttggcattagccgagatgaaaatggcgctggctacagatgacaaggaaaaggatagtatttttagcaatgccctagtcgaggcaactcggttctgtgccccaatatacgagtgcgcttggacgtgttccaccggcgttgtgcagaaatctctctcgtggtttgacaagaacaaagatttcatcaagctgtgggacgcaaaatatatggatcttcgcaaggggattccggaacccgagcagctggtatcataccagcaagccgctcagaagtggcgaaaagacgtgggatatgaaatcaatcagtttacacgtagcttgactcaccctgtcgtggccgagtacaaggttccaggtgagattgcggtggatgtcaaagaaatgctcagtgacatgatcagaaggcggaacgtgctgctgaatggcgatggggagaacgcaggaaagaaaggccccatatcccgcgaacatgtatcttggggtagagagctcgccgggggaaagttccaggttgtgtttaatcctccatggggcgacatcaacaaatgcggcaagagcgggattcccttagctgccaccgcaatggtcaaggtggctgaactggacggatccaaaaagctagaggatatcaggcaagccttgctggaccttaaaaagtgggtggaggataataaagacgcgctcgaagatggtaagggcaacgagctggtccagacaatgaccaagcaccttgcccaggcagttgaactgagtaaaaagtcaaatgctttgcgggcccagggggctcaaattgacactcctttcagcgccttttattgggcatggtctgccggagtgaaaccagagacattctttaccctctcccagttcctgttcgaaatgggccagtcagctcgcggtgggaagaaaatgatcaaggcgttaacgagcactccgctgcgatggggaaagggcctcataaacctttttgcagatgacgatttcctgggcaacagattgtacatgcatcccgccgtactaacccctgggaggatgagtgagatgggagcttgttttggtgtgattccagtcgcctctcccgaggacgcaatcctgggctccgggcacagcaaaaatattctcaacttcaagatcgatacatcggtgcaaaatccttgcgcctctactatcgttcagctgtatcggattcagaaatccggatttgaccttgaatcactggaggtggtcagtaccgaacatttgctccaccagagcttcgtgggcaagcgttgtccaacacaaaacgcttacaaagtacgcggtaatgccaccaacgttaatataatctga

SEQ ID NO: 6043 - RNA, 1452 nt, synthetic construct
  misc_feature 1..1452: note = derived and/or modified CDS sequence (opt3) from DUGV(IbAr1792)__AF434164.1__N
  source 1..1452: mol_type = other RNA
atggagaaccagatcaaggccaataacaaaaaggagttcgacgaatggtttaaacccttcagcgaaaagctgcaactcagatccaatcttaccaactctgcttcactgtgcgatagggtgcctgacttggcattagccgagatgaaaatggcgctggctacagatgacaaggaaaaggatagtatttttagcaatgccctagtcgaggcaactcggttctgtgccccaatatacgagtgcgcttggacgtgttccaccggcgttgtgcagaaatctctctcgtggtttgacaagaacaaagatttcatcaagctgtgggacgcaaaatatatggatcttcgcaaggggattccggaacccgagcagctggtatcataccagcaagccgctcagaagtggcgaaaagacgtgggatatgaaatcaatcagtttacacgtagcttgactcaccctgtcgtggccgagtacaaggttccaggtgagattgcggtggatgtcaaagaaatgctcagtgacatgatcagaaggcggaacgtgctgctgaatggcgatggggagaacgcaggaaagaaaggccccatatcccgcgaacatgtatcttggggtagagagctcgccgggggaaagttccaggttgtgtttaatcctccatggggcgacatcaacaaatgcggcaagagcgggattcccttagctgccaccgcaatggtcaaggtggctgaactggacggatccaaaaagctagaggatatcaggcaagccttgctggaccttaaaaagtgggtggaggataataaagacgcgctcgaagatggtaagggcaacgagctggtccagacaatgaccaagcaccttgcccaggcagttgaactgagtaaaaagtcaaatgctttgcgggcccagggggctcaaattgacactcctttcagcgcctattactgggcatggtctgccggagtgaaaccagagacatttttcaccctctcccagtttctgttcgaaatgggccagtcagctcgcggtgggaagaaaatgatcaaggcgttaacgagcactccgctgcgatggggaaagggcctcataaaccttttcgcagatgacgattttctgggcaacagattgtatatgcatcccgccgtactaacccctgggaggatgagtgagatgggagcttgtttcggtgtgattccagtcgcctctcccgaggacgcaatcctgggctccgggcacagcaaaaatattctcaactttaagatcgatacatcggtgcaaaatccttgcgcctctactatcgttcagctgtaccggattcagaaatccggattcgaccttgaatcactggaggtggtcagtaccgaacatttgctccaccagagctttgtgggcaagcgttgtccaacacaaaacgcttacaaagtacgcggtaatgccaccaacgttaatataatctga

SEQ ID NO: 6044 - RNA, 1452 nt, synthetic construct
  misc_feature 1..1452: note = derived and/or modified CDS sequence (opt3) from DUGV(KT281/75)__AF434165.1__N
  source 1..1452: mol_type = other RNA
atggagaaccagatcaaggccaataccaaaaaggagttcgacgaatggtttaaacccttcagcgataagctgcaactcagatccacacttactaactctgcttcactgtgcgacagggtgcctgatttggcattagccgaaatgaaaatggcgctggctacggacgataaggagaaggacagtatttttagcaatgccctagtcgaagcaacccggttctgtgccccaatatacgagtgcgcttggacatgttccactggcgttgtgcagaaatctctctcgtggtttgataagaacaaagacttcatcaagctgtgggatgcaaaatatatggaccttcgcaaggggattccggagcccgaacagctggtatcataccagcaagccgctcagaagtggcgaaaagatatcggatatgagattaatcagtttacccgtagcttgacacaccctgtggtcgccgaatacaaggtgccaggtgagatcgcggttgacgtgaaagagatgctcagtgatatgataagaaggcggaacgtcctgctgaatggcgacggggaaaacgcaggaaagaaaggccccatctcccgcgagcatgtgtcttggggtagagaactcgccgggggaaagttccaggtagtttttaatcctccatggggcgacattaacaaatgcggcaagagcgggatccccttagctgccaccgcaatggtgaaggtcgctgagctggatggatccaaaaagctagaagacattaggcaagccttgctggatcttaaaaagtggatcgaggacaataaagatgcgctcgaggacggtaagggcaacgaactgatacagactatgacaaagcaccttgcccaggcagtggagctgagtaaaaagtcaaatgctttgcgggcccagggggctcaaattgatacccctttcagcgccttttattgggcatggtctgccggagtgaaaccagaaacgttctttactctctcccagttcctgttcgagatgggccagtcagctcgcggtgggaagaaaatgatcaaggcgttaaccagcacaccgctgcgatggggaaagggcctcattaacctttttgcagacgatgacttcagtggcaatagactgtacatgcatcccgccgtcttgactcctgggaggatgtctgaaatgggagcttgttttggtgttatcccagtggcctcccccgaggatgcaatcctaggcagcgggcactcgaaaaacattctgaacttcaagatagacacctctgtacaaaatccttgcgcctccacaatcgtgcagctctatcggattcagaaatcaggatttgacctggagagtcttgaagtcgtgagcaccgagcatctgttgcaccagtccttcgttggcaagcgttgtccaacgcaaaacgcttacaaagtgcgcggtaatgccactaacgtcaatatcatatga

SEQ ID NO: 6045 - RNA, 1452 nt, synthetic construct
  misc_feature 1..1452: note = derived and/or modified CDS sequence (opt3) from DUGV(NJT130)__FJ422213.2__N
  source 1..1452: mol_type = other RNA
atggagaaccagatcaaggccaataacaaaaaggagttcgacgaatggtttaaacccttcagcgataagctgcaactcagatccacccttacaaattctgcttcactgtgcgacaaagtgcctgatttggcattagccgaaatgaagatggcgctggctactgacgataaggagaaagacagtatttttagcaacgccctagtcgaagcaacgaggttctgtgccccaatatacgagtgcgcttggacctgttccacaggcgttgtgcagaagtctctctcgtggtttgataaaaataaggacttcatcaaactgtgggatgcaaagtatatggaccttcggaaggggattccggagcccgaacagctggtatcataccagcaagccgctcagaaatggcgcaaggatatcggatatgagattaaccagtttactcgtagcttgacccaccctgtggtcgccgaatacaaagtgccaggtgagatcgcggttgacgtgaaggagatgctcagtgatatgatacgaagaaggaatgtcctgctgaacggcgacggggaaaatgcaggcaaaaagggacccatctcccgggagcatgtgtcttggggtcgcgaactcgccgaggggaaattccaggtagtttttaaccctccatggggagacattaataagtgcggcaagagcggcatccccttagctgccacagcaatggtgaaagtcgctgaactggatgggtccaagaaacttgaggacattagacaagccttgctggatctaaagaaatgggtggaggacaacaaggatgcgctcgaagacggaaagggtaatgagctgatccagaccatgactaaacaccttgcccaggcagtggaactgtcaaagaaaagtaacgctttgagggcccagggcgctcaaatagatacacctttcagcgccttttattgggcatggtctgccggggtcaagccagagaccttctttacgctctcccagttcctgttcgaaatgggacagtcagctcggggcggtaaaaagatgattaaggcgttaactagcaccccgctgcgctgggggaaaggactcatcaatctttttgcagacgatgacttcagtggcaaccgactgtacatgcatcccgccgttttgacacctggcagaatgtctgagatgggggcttgttttggagtgattccagtagcctcccccgaggatgcaatcctaggtagcggccactcgaagaacatcctgaatttcaaaattgacacttctgtgcaaaacccttgcgcctccaccatagtccagctctataggatccagaagtcagggtttgacctggaaagtcttgaggtggttagcacagaacatctgttgcaccagtccttcgtgggaaaacggtgtccaacccaaaatgcttacaaggtccgtggcaacgccacgaatgtgaacattatctga

SEQ ID NO: 6046 - RNA, 1452 nt, synthetic construct
  misc_feature 1..1452: note = derived and/or modified CDS sequence (opt3) from DUGV(IbAr1792)__KU925457.1__N
  source 1..1452: mol_type = other RNA
atggagaaccagatcaaggccaataacaaaaaggagttcgacgaatggtttaaacccttcagcgaaaagctgcaactcagatccaatcttaccaactctgcttcactgtgcgatagggtgcctgacttggcattagccgagatgaaaatggcgctggctacagatgacaaggaaaaggatagtatttttagcaatgccctagtcgaggcaactcggttctgtgccccaatatacgagtgcgcttggacgtgttccaccggcgttgtgcagaaatctctctcgtggtttgacaagaacaaagatttcatcaagctgtgggacgcaaaatatatggatcttcgcaaggggattccggaacccgagcagctggtatcataccagcaagccgctcagaagtggcgaaaagacgtgggatatgaaatcaatcagtttacacgtagcttgactcaccctgtcgtggccgagtacaaggttccaggtgagattgcggtggatgtcaaagaaatgctcagtgacatgatcagaaggcggaacgtgctgctgaatggcgatggggagaacgcaggaaagaaaggccccatatcccgcgaacatgtatcttggggtagagagctcgccgggggaaagttccaggttgtgtttaatcctccatggggcgacatcaacaaatgcggcaagagcgggattcccttagctgccaccgcaatggtcaaggtggctgaactggacggatccaaaaagctagaggatatcaggcaagccttgctggaccttaaaaagtgggtggaggataataaagacgcgctcgaagatggtaagggcaacgagctggtccagacaatgaccaagcaccttgcccaggcagttgaactgagtaaaaagtcaaatgctttgcgggcccagggggctcaaattgacactcctttcagcgccttttattgggcatggtctgccggagtgaaaccagagacattctttaccctctcccagttcctgttcgaaatgggccagaacgctcgcggtgggaagaaaatgatcaaggcgttaacgtcaactccgctgcgatggggaaagggcctcataaacctttttgcagatgacgatttcctgggcaatagattgtacatgcatcccgccgtactaacccctgggaggatgagcgagatgggagcttgttttggtgtgattccagtcgccagtcccgaggacgcaatcctgggctctgggcactccaaaaacattctcaatttcaagatcgatacaagcgtgcaaaacccttgcgcctcgactatcgttcagctgtatcggattcagaaatctggatttgaccttgaatccctggaggtggtctcaaccgaacatttgctccaccagagtttcgtgggcaagcgttgtccaacacaaaatgcttacaaagtacgcggtaacgccaccaatgttaacataatctga

SEQ ID NO: 6047 - RNA, 1449 nt, synthetic construct
  misc_feature 1..1449: note = derived and/or modified CDS sequence (opt3) from NSDV(Jilin)__NC_034386.1__N
  source 1..1449: mol_type = other RNA
atgcagaaccaaatcgtggccgacaataaggatgctattctggcatggcacaaaacctacagcgagaagcatagactcaaatccgtccttacaaactctgcctcattctgcgaaactatacccgacctgagtggctatgaggttagcatgaggttggtgtcctctgaatcggagaaggattcagtatacgcgagcgctttagtggccgcaacgaaattttgtgcccctatcctggaatgcgcttggaccagttgtacagggatggtcgagcggggactagactggttcgagaataacaaggaaactgtgaagatttgggatgcagagtatggtaaactccgcaccgaagccccatccccggagcagctgcttggctaccagcgagctgccctgaagtggcgtaaagacacaaagtatgggatcaatagaaacaccgcggcattggccgctgccattgcaactgagtacagggttcccggatctatcgtggtcaatgtgaaagatatgctcagcgacatgatacggcgcagaaacaagatcctgaatagggatggctccgaagacgtacctaagcggggtccagtttcaaaagagcacattgattgggctcgcgacctggcccaggggaagtttctcgtggtcttcaatcccccttggggagatatcaacaaagcgggcaagagtggcattgccttagcagctacagggatggccaaactgatcgaacttgacggaccaaagatagctgaggacttgcgagaaagcctgaaaggtctagtggcctggattaacgcacataaggatgaggtggagaatggcaaggaagtcgttgacgggctcaccaaacatctgcaaaaggcccttgagctggctaaacagtcttccgcgatgagagcacagggagcccagatcgatacggtgttttcaagctattactggttgtggaaggctggcgtaactgccgaaatgttccccaccgtgagtcaatttctcttcgagctgggtaaagtccctagggggaacaagaagatgaaaaaggcattatcttccatgccactgaaatggggaaagaaactccttgccctgtttgctgacgatagcttcacagccaatcggatttacatgcacccgggcgtgttgactgcaggccgtatgtcggaactaggggtttgctttggagcgatccccgtggctaaccctgacgatgccgcagagggttctggccacatcaagaacattctggcccagaccacagacacccaggctgggaatccatgtgcccagaacatagtcgcactcttcaatatccaaaaggctggatttgatattgagtccatggacatcgtggccctggaacaccttctgcatcagtcattggtaggcaaacgcagtcccttccagaacgcgtataatataagaggtaacgccacgagcattcaaatcatctga

SEQ ID NO: 6048 - RNA, 1449 nt, synthetic construct
  misc_feature 1..1449: note = derived and/or modified CDS sequence (opt3) from NSDV(62873)__HQ286609.1__N
  source 1..1449: mol_type = other RNA
atgcagaaccaaatcgtggccgacaataaggatgctattctggcatggcacaaaacctacagcgagaagcataaactcaagtccgtccttacaaactctgcctcattctgcgaaactatacccgacctgagtggctatgaggttagcatgagattggtgtcctctgaatcggagaaagattcagtatacgcgagcgctttagtggccgcaacgaagttttgtgcccctatcctggaatgcgcttggaccagttgtacagggatgattcagaggggactagactggttcgagaataacggtgagatggtcaagatctgggatgcagactatggcaaactccggactgaaattccatccccggagcagctgcttgggtaccagcgcgccgctctgaagtggcgaaaagataccaagtatggaatcaataaaaacacagccgcgttggcagccgctatagccaccgaataccgtgtgcccggctctatcgttgtgaatgtcaaggacatgctcagcgatatgattagaaggcggaacaagatcctgaatcgcgacggttccgaggatgtgcctaaaagagggccagtatcaaaggagcacattgactgggcaagggatctggctcaaggaaaatttctcgttgtgttcaatcccccttggggcgacatcaacaaggccggcaaaagtgggatagcgttagccgcaactggaatggctaagctgattgaacttgacggtccaaaagtcgccgaggatttgaaggaaagcctgaagtctctagtggcttggatcaacgcccataaagacgaggtggaaaatggcaaggaggtcgttgatgggctcacaaaacatctgcagaaggcacttgagctggccaaacagtcctcagctatgcgggcgcagggagcacaaattgacaccgtgtttagcagttattactggttgtggaaggccggcgtaacggctgaaatgttccccactgtgtctcagtttctcttcgagctgggtaaggtccctcgcgggaacaaaaagatgaaaaaggccttatccagcatgccactgaaatggggaaagaagctccttgcactgtttgccgatgactcgttcaccgctaatcgaatctacatgcacccgggcgtgttgacagccggcagaatgtctgaactaggggtttgctttggagcaatccccgtggcgaaccctgatgacgctgccgagggttccggccacattaaaaacatactgaattataagactgatacccaggcagggaacccatgtgcccagaatatcgtcgctctcttcaacattcaaaaagccggatttgacatcgaatcaatggatatagtggcaagtgagcatctgcttcaccagagcctggtaggcaagaggtcccccttccagaatgcttacaacattcggggtaatgccacatctatccaaatcatttga

SEQ ID NO: 6049 - RNA, 1449 nt, synthetic construct
  misc_feature 1..1449: note = derived and/or modified CDS sequence (opt3) from NSDV(779)__HQ286602.1__N
  source 1..1449: mol_type = other RNA
atgcagaaccaaatcgtggccgacaataaggatgctattctggcatggcacaaaacctacagcgagaagcataaactcaagtccgtccttacaaactctgcctcattctgcgaaactatacccgacctgagtggctatgaggttagcatgagattggtgtcctctgaatcggagaaagattcagtatacgcgagcgctttagtggccgcaacgaagttttgtgcccctatcctggaatgcgcttggaccagttgtacagggatgattcagaggggactagactggttcgataataacggtgagatggtcaagatctgggacgcagattatggcaaactccggactgaggtgccatccccggaacagctgcttgggtaccagcgcgccgctctgaagtggcgaaaagacaccaagtatggaattaataaaaacacagccgcgttggcagccgctatcgccaccgagtaccgtgttcccggctctatagtggtcaatgtgaaggatatgctcagcgacatgatcagaaggcggaacaagattctgaatcgcgatggttccgaagacgtacctaaaagagggccagtttcaaaggagcacatcgattgggcaagggacctggctcaaggaaaatttctcgtggtcttcaatcccccttggggcgacattaacaaggccggcaaaagtgggatcgcgttagccgcaactggaatggctaagctgatagagcttgatggtccaaaagtggccgaagacttgaaggagagcctgaagtctctagtggcttggattaacgcccataaagatgaagtcgagaatggcaaggaagttgtggacgggctcacaaaacatctgcagaaggcacttgagctggccaaacagtcctcagctatgcgggcgcagggagcacaaatcgataccgtatttagcagttattactggttgtggaaggccggcgtgacggctgagatgttccccactgtctctcagtttctcttcgaactgggtaaggtgcctcgcgggaacaaaaagatgaaaaaggccttatccagcatgccactgaaatggggaaagaagctccttgcactgtttgccgacgattcgttcaccgctaatcgaatttacatgcacccgggcgttttgacagccggcagaatgtctgagctaggggtgtgctttggagcaatccccgtcgcgaaccctgacgatgctgccgaaggttccggccacatcaaaaacattctgaattataagactgacacccaggcagggaacccatgtgcccagaatatagtggctctcttcaacatccaaaaagccggatttgatattgagtcaatggacatcgtagcaagtgaacatctgcttcaccagagcctggttggcaagaggtcccccttccagaatgcttacaacatacggggtaatgccacatctattcaaatcatctga

SEQ ID NO: 6050 - RNA, 1449 nt, synthetic construct
  misc_feature 1..1449: note = derived and/or modified CDS sequence (opt3) from NSDV(6233)__HQ286603.1__N
  source 1..1449: mol_type = other RNA
atgcagaaccaaatcgtggccgacaataaggatgctattctggcatggcacaaaacctacagcgagaagcataaactcaagtccgtccttacaaactctgcctcattctgcgaaactatacccgacctgagtggctatgaggttagcatgagattggtgtcctctgaatcggagaaagattcagtatacgcgagcgctttagtggccgcaacgaagttttgtgcccctatcctggaatgcgcttggaccagttgtacagggatgattcagaggggactagactggttcgataataacggtgagatggtcaagatctgggacgcagattatggcaaactccggactgaggtgccatccccggaacagctgcttgggtaccagcgcgccgctctgaagtggcgaaaagacaccaagtatggaattaataaaaacacagccgcgttggcagccgctatcgccaccgagtaccgtgttcccggctctatagtggtcaatgtgaaggatatgctcagcgacatgatcagaaggcggaacaagattctgaatcgcgatggttccgaagacgtacctaaaagagggccagtttcaaaggagcacatcgattgggcaagggacctggctcaaggaaaatttctcgtggtcttcaatcccccttggggcgacattaacaaggccggcaaaagtgggatcgcgttagccgcaactggaatggctaagctgatagagcttgatggtccaaaagtggccgaagacttgaaggagagcctgaagtctctagtggcttggattaacgcccataaagatgaagtcgagaatggcaaggacgttgtggatgggctcacaaaacatctgcagaaggcacttgaactggccaaacagtcctcagctatgcgggcgcagggagcacaaatcgacaccgtatttagcagttattactggttgtggaaggccggcgtgacggctgagatgttccccactgtctctcagtttctcttcgagctgggtaaggtgcctcgcgggaacaaaaagatgaaaaaggccttatccagcatgccactgaaatggggaaagaagctccttgcactgtttgccgatgactcgttcaccgctaatcgaatttacatgcacccgggcgttttgacagccggcagaatgtctgaactaggggtgtgctttggagcaatccccgtcgcgaaccctgatgacgctgccgagggttccggccacatcaaaaacattctgaattataagactgatacccaggcagggaacccatgtgcccagaatatagtggctctcttcaacatccaaaaagccggatttgacattgaatcaatggacatcgtagcaagtgagcatctgcttcaccagagcctggttggcaagaggtcccccttccagaatgcttacaacatacggggtaatgccacatctattcaaatcatctga

SEQ ID NO: 6051 - RNA, 1449 nt, synthetic construct
  misc_feature 1..1449: note = derived and/or modified CDS sequence (opt3) from NSDV(40350)__HQ286608.1__N
  source 1..1449: mol_type = other RNA
atgcagaaccaaatcgtggccgacagcaaggatgctattctggcatggcacaaaacctactccgagaagcataaactcaagtctgtccttacaaattcagccagtttctgcgaaactatacccgacctgagcggctatgaggtttccatgagattggtgtcttcggattcagaaaaagacagcgtatacgcgagtgctttagtggccgcaacgaagttttgtgcccctatcctggagtgcgcttggacctcctgtacagggatgattcagaggggactagattggttcgaaaacaatggtgagatggtcaagatctgggacgcagattatggcaaactccggactgaggtgccatctccggaacagctgcttgggtaccagcgcgccgctctgaagtggcgaaaagacaccaagtatggaattaacaaaaatacagccgcgttggcagccgctatcgccaccgagtaccgtgttcccggcagcatagtggtcaacgtgaaggatatgctctccgacatgatcagaaggcggaataagattctgaaccgcgatggttcagaagacgtacctaaaagagggccagttagtaaggagcacatcgattgggcaagggacctggctcaaggaaaatttctcgtggtcttcaatcccccttggggcgacattaacaaggccggcaaaagcgggatcgcgttagccgcaactggaatggctaagctgatagagcttgatggtccaaaaattgccgaagacttgaaggagtctctgaagtccctagtggcttggatcaatgcccataaagatgaagtggagaacggcaaggaagtcgttgacgggctcacaaaacatctgcagaaggcacttgagctggccaaacagtcaagcgctatgcgggcgcagggagcacaaattgataccgtgtttagttcttattactggttgtggaaggccggcgtaacggctgagatgttccccactgtgtcccagtttctcttcgaactgggtaaggtccctcgcgggaataaaaagatgaaaaaggccttaagctcgatgccactgaaatggggaaagaagctccttgcactgtttgccgacgattctttcaccgctaaccgaatctacatgcacccgggcgtgttgacagccggcagaatgtccgagctaggggtttgctttggagcaatccccgtggcgaatcctgacgatgctgccgaaggttcaggccacattaaaaacatactgaactataagactgacacccaggcagggaatccatgtgcccagaacatcgtcgctctcttcaatattcaaaaagccggatttgatatcgagagtatggacatagtggcaagcgaacatctgcttcaccagtccctggtaggcaagaggtctcccttccagaacgcttacaatattcggggtaacgccacaagcatccaaatcatttga

SEQ ID NO: 6052 - RNA, 1449 nt, synthetic construct
  misc_feature 1..1449: note = derived and/or modified CDS sequence (opt3) from NSDV(616287)__HQ286605.1__N
  source 1..1449: mol_type = other RNA
atgcagaaccaaatcgtggccgacaataaggatgctattctggcatggcacaaaacctacagcgagaagcataaactcaagtccgtccttacaaactctgcctcattctgcgaaactatacccgacctgagtggctatgaggttagcatgagattggtgtcctctgaatcggagaaagattcagtatacgcgagcgctttagtggccgcaacgaagttttgtgcccctatcctggaatgcgcttggaccagttgtacagggatgattcagaggggactagactggttcgataataacggtgagatggtcaagatctgggacgcagattatggcaaactccggactgaggtgccatccccggaacagctgcttgggtaccagcgcgccgctctgaagtggcgaaaagacaccaagtatggaattaataaaaacacagccgcgttggcagccgctatcgccaccgagtaccgtgttcccggctctatagtggtcaatgtgaaggatatgctcagcgacatgatcagaaggcggaacaagattctgaatcgcgatggttccgaagacgtacctaaaaaggggccagtttcaaaagagcacgtggattgggcaagagacctggctcaaggaaagtttctcgtcgtgttcaatcccccttggggcgacatcaacaaagccggcaagagtgggattgcgttagccgcaactggaatggctaaactgatcgagcttgatggtccaaaggtggccgaagacttgaaggagagcctgaaatctctagtcgcttggataaacgcccataaggatgaagttgagaatggcaaagaagtggtagacgggctcacaaagcatctgcagaaagcacttgagctggccaagcagtcctcagctatgagggcgcagggagcacaaattgataccgtgtttagcagttattactggttgtggaaggccggcgtcacggctgagatgttccccactgtgtctcagtttctcttcgaactgggtaaagttcctcgggggaacaagaaaatgaagaaagccttatccagcatgccactgaagtggggaaagaaactccttgcactgtttgccgacgattcgttcaccgctaatcgcatctacatgcacccgggcgtgttgacagccggccgaatgtctgagctaggggtctgctttggagcaattcccgtggcgaaccctgacgatgctgccgaaggttccggccacatcaagaacatcctgaattataaaactgacacccaggcagggaacccatgtgcccagaatattgtagctctcttcaacatacaaaaggccggatttgatatcgagtcaatggacattgttgcaagtgaacatctgcttcaccagagcctggtgggcaaaagatcccccttccagaatgcttacaacatcaggggtaatgccacatctatacaaattatctga

SEQ ID NO: 6053 - RNA, 1449 nt, synthetic construct
  misc_feature 1..1449: note = derived and/or modified CDS sequence (opt3) from NSDV(615526)__HQ286606.1__N
  source 1..1449: mol_type = other RNA
atgcagaaccaaatcgtggccgacaataaggatgctattctggcatggcacaaagcctacagcgagaagcataaactcaagtccgtccttaccaactctgcgtcattctgcgaaacaatacccgacctgagtggctatgaggttagcatgagattggtgtcctctgaatcggagaaagattcagtatacgctagcgccttagtggcagccactaagttttgtgctcctatcctggaatgcgcatggacgagttgtaccgggatgattcagaggggactagactggttcgattccaatggtgagatggtcaagatctgggacgccgattatggcaaactccggacagaggtgccatctccggaacagctgcttgggtaccagcgcgctgccctgaagtggcgaaaagacactaagtatggaattaacaaaaataccgcggcattggccgctgccatcgcaacagagtaccgtgttcccggcagcatagtggtcaacgtgaaggatatgctctccgacatgatcagaaggcggaataagattctgaaccgcgatggttcagaagacgtacctaaagggggaccagttagtaaggagcacatcgattgggctagagacctggcccaaggcaaatttctcgtggtcttcaatcccccttggggcgacattaacaaggcggggaaaagcggaatcgccttagcagctaccggtatggccaagctgatagagcttgatggcccaaaaattgctgaagacttgaaggagtctctgaagtccctagtggcctggatcaatgcacataaagatgaagtggagaacgggaaggaagtcgttgacggactcactaaacatctgcagaaggcccttgagctggctaaacagtcaagcgcgatgagggcacagggcgcccaaattgatacagtgtttagttcttattactggttgtggaaggctggtgtaaccgccgagatgttccccacggtgtcccagtttctcttcgaactggggaaggtccctcggggaaataaaaagatgaaaaaggcattaagctcgatgccactgaaatggggcaagaagctccttgccctgtttgctgacgattctttcactgccaaccgcatctacatgcacccgggcgtgttgaccgcagggcgaatgtccgagctaggagtttgctttggtgcgatccccgtggctaatcctgacgatgccgcagaaggctcagggcacattaaaaacatactgaactataagacagacactcaggccggaaatccatgtgctcagaacatcgtcgccctcttcaatattcaaaaagcaggctttgatatcgagagtatggacatagtggctagcgaacatctgcttcaccagtccctggtaggtaagagatctcccttccagaacgcctacaatattagggggaacgcgaccagcatccaaatcatttga

SEQ ID NO: 6054 - RNA, 1449 nt, synthetic construct
  misc_feature 1..1449: note = derived and/or modified CDS sequence (opt3) from NSDV(708)__AF504293.1__N
  source 1..1449: mol_type = other RNA
atgcagaaccaaatcgtggccgacaataaggatgctattctggcatggcacaaagcctacagcgagaagcataaactcaagtccgtccttaccaactctgcgtcattctgcgaagctatacccgacctgagtggctatgaggttagcatgagattggtgtcctctgattcggaaaaagactcagtatacgccagcgcattagtggccgctacaaagttttgtgcacctatcctggagtgcgcctggacgagttgtactgggatggtcgaaaggggactagattggttcgagaataaccgggagatggtgaagatttgggacaccgaatatggtaaactccgcacagaggttccatccccggaacagctgcttggctaccagcgagctgccctgaagtggcgtaaagatactaagtatgggatcaataaaaacaccgcggcattggccgctgccattgcaacagagtacaaggtgcccggatctctcgtcgtgaatgtaaaggacatgctgagcgatatgatcagaaggcggaacaaaatactgaatcgcgacggctccgaggatgttcctaagagaggtccagtgtcaaaagaacacatcgactgggctagggatctcgcccaggggaagtttttagtcgtgttcaatcccccttggggagacattaacaaagcgggcaagagtggcatcgccctggcagctaccgggatggccaaacttattgagttggacggaccaaagatcgctgaagatctgaaggagagcctaaaatctctcgtggcctggataaacgcacataaggacgaagtcgagaatggtaaagaggttgtggattccctgactaagtatcttcaaaaagccctggaattggctaagcagtcaagcgcgatgcgggcacagggcgcccagattgacacagtatttagttcttactactggctctggaaggctggggtgaccgccgagatgttccccacggtctcccaatttctgttcgaattaggaaaagtgcctcgcggcaacaagaaaatgaagaaagcactgagctcgatgccactcaagtggggtaagaaacttctggccttgtttgctgatgactctttcactgccaatcgaatctatatgcacccgggggttctaaccgcaggaagaatgtccgagctgggcgtgtgctttggcgcgattcccgtcgctaaccctgatgacgccgcagatgggtcaggacatatcaagagtatcctcaactacaaaacagacactcaggccggtaatccatgtgctcagaacattgtggccctgttcaatatacagaaggcaggctttgatatcgaaagcatggacattgtagcttccgagcaccttctgcaccaatctttggttgggaaaaggagccccttccagaacgcctataatatccggggaaacgcgacctcaatacagattatctga

SEQ ID NO: 6055 - RNA, 702 nt, synthetic construct
  misc_feature 1..702: note = derived and/or modified CDS sequence (opt3) from BUNV__NC_001927.1__N
  source 1..702: mol_type = other RNA
atgatcgagctggagttccacgacgtggccgctaacaccagctccacatttgatcccgaagtcgcatacgccaatttcaagagagttcatactacgggcctctcttatgaccacattaggatattttacatcaaagggcgggaaattaagacctcacttgcgaaacgcagtgagtgggaagtgacactgaacttgggaggttggaagatcactgtatataataccaacttccctggcaatcgaaacaatccagtgccggatgacgggttaacactgcatcgtctaagcggatttctcgctagatacctgcttgagaaaatgctgaaggtctccgagcccgaaaagttgattatcaaatctaagataatcaaccctctcgccgagaaaaatggcattacctggaacgatggtgaagaggtgtatctgtcgttctttccagggtcagagatgttcctgggaacttttaggttctaccccctcgcaatcggcatttataaggttcagcggaaagaaatggagcctaagtacttagaaaagacaatgcgccaaagatacatgggcctggaggccgctacctggacggtgagcaaacttactgaagtccagagtgcattgaccgtggtatcctctctggggtggaagaaaacaaatgttagcgccgctgccagggactttctagcgaagttcggaatcaacatgtga

SEQ ID NO: 6056 - RNA, 702 nt, synthetic construct
  misc_feature 1..702: note = derived and/or modified CDS sequence (opt3) from BUNV(SFCrEq231)__KP063894.1__N
  source 1..702: mol_type = other RNA
atgatcgagctggaatttaacgacgtggccgctaataccagctccacatttgatcccgaggtcgcatacattaacttcaagagaatatatactacgggcctctcttacgaccacatcaggattttctatatcaaagggcgggaaattaagacctcacttacaaaacgcagtgagtgggaagttactctgaatttgggaggttggaaggtgaccgtattcaacacaaattttcctggcaaccgaaatagcccagtgccggatgacgggttaaccctgcatcgtctatccggattcctcgccagatacctgcttgagaaaatcctgaaggtctctgagcccgaaaagttgataatcaaatcgaagattatcaaccctctcgcggagaaaaatggcattacttggtcagatggtgaagaggtgtatctgagctttttcccagggagtgagatgtttctgggaacattcaagttttaccccctcgctatcggcatatataaagttcagaggaaggaaatggagcctaagtacttagagaaaaccatgcggcaacgctacatgggcctggaagcctccacgtggactgtgtctaaggtcaacgaagtgcagagcgcacttaccgtagtttccgggttgggatggaaaaagacaaatgtgtcagccgctgcaagagagttcctggccaaatttggtattaacatgtga

SEQ ID NO: 6057 - RNA, 702 nt, synthetic construct
  misc_feature 1..702: note = derived and/or modified CDS sequence (opt3) from BUNV(AMH001130)__JF961342.1__N
  source 1..702: mol_type = other RNA
atgatcgagctggagttccacgacgtggccgctaacaccagctccacatttgatcccgaagtcgcatacgccaatttcaagagagttcatactacgggcctctcttatgaccacattaggatattttacatcaaagggcgggaagtgaagacctcacttgcgaaacgcagtgagtgggaagtaacactgaacttgggaggttggaagattactgtgtataataccaacttccctggcaatcgaaacaatccagtcccggatgacgggttaacactgcatcgtctaagcggatttctcgctagatacctgcttgagaaaatgctgaaggtgtccgagcccgaaaagttgatcattaaatctaagatcataaaccctctcgccgagaaaaatggcatcacctggaacgatggtgaagaggtttatctgtcgttctttccagggtcagagatgttcctgggaacttttaggttctaccccctcgcaattggcatctataaggtgcagcggaaagaaatggagcctaagtacttagaaaagacaatgcgccaaagatacatgggcctggaggccgctacctggacggtcagcaaacttactgaagtgcagagtgcattgaccgtagtttcctctctggggtggaagaaaacaaatgtgagcgccgctgccagggactttctagcgaagttcggaattaacatgtga

SEQ ID NO: 6058 - RNA, 702 nt, synthetic construct
  misc_feature 1..702: note = derived and/or modified CDS sequence (opt3) from BUNV(ArB29051)__AM709778.1__N
  source 1..702: mol_type = other RNA
atgatcgagctggagttccacgacgtggccgctaacaccagctccacatttgatcccgaagtcgcatacgccaatttcaagagagttcatactacgggcctctcttatgaccacattaggatattttacatcaaagggcgggaaattaagacctcacttgcgaaacgcagtgagtgggaagtgacactgaacttgggaggttggaagatcactgtatataataccaacttccctggcaatcgaaacaatccagtgccggatgacgggttaacactgcatcgtctaagcggatttctcgctagatacctgcttgagaaaatgctgaagttgtccgagcccgaaaagctcattatcaaatctaagataatcaaccctctggccgagaaaaatggcattacctggaacgatggtgaagaggtctatctgtcgttctttccagggtcagagatgttcctcggaacttttaggttctaccccttagcaatcggcatttataaggtgcagcggaaagaaatggagcctaagtacctggaaaagacaatgcgccaaagatacatgggccttgaggccgctacctggacggttagcaaattgactgaagtgcagagtgcactgaccgtcgtgtcctctctagggtggaagaaaacaaatgtaagcgccgctgccagggactttctcgcgaagttcggaatcaacatgtga

SEQ ID NO: 6059 - RNA, 702 nt, synthetic construct
  misc_feature 1..702: note = derived and/or modified CDS sequence (opt3) from BUNV(ArB28215)__AM711130.1__N
  source 1..702: mol_type = other RNA
atgatcgagctggaatttaacgacgtggccgtcaataccagctcctcttttgatcccgaggctgcatacgccaacttcaagagagttcacacaactggcctctcatatgaccatattaggatattttacatcaaagggcgggaaattaaggtgagtcttagcaaacgctccgagtgggaagtaacgatcaatctgggaggttggaagattgcggtgtataacaccaatttccctggcaaccgaaattctccagtcccggatgacgggttgacattacaccgtctgtcgggatttctagctagattcctcctggagaaaatgcttaagatgtcagagcccgaaaagctgatcataaaagccaagatcattaaccctttggcagagaaaaataggatcacttggaacgatggcgaagaggtgtacctcagctttttcccaggtagtgagatgtttctggggaccttcaagttttatcccctggccattggaatctacaaagttcagcggaaggaaatggagcctaagtatttcgaaaagacaatgcgccaaagatacatgggcctcgaggcttcctcttggaccgtgagcaaattaactgacgtccagtccgcactgacagtggtatcaggccttgggtggaaaaagaccaatgttagtgccgctgccagggatttcttggcgaaattcggaataaacatgtga

SEQ ID NO: 6060 - RNA, 702 nt, synthetic construct
  misc_feature 1..702: note = derived and/or modified CDS sequence (opt3) from BUNV(Peurto Almendras)__AJ697960.1__N
  source 1..702: mol_type = other RNA
atgagcgagatcgccttcgacgatattggccagatagctgcatccacctttaaccccgacaatcaatacatcgggttcaagaaagtgtttacaattggactgacttatgatcagatcagaattttctttctcaacggtaagaaagccaaggaaacgctttctaaaaggtcagaggaaaccgtcacactgaatttcggcgggtggcggatccctatagttaacactcactttccaggaaatcgcaacatcgacttggcggatgacgctttaaccctgcatcgagtgagtggctacctagcccgttatctcctggagaaggtacttagcgcacaggaaccggagaaggtgattatcaaaacaagaattatcaatcccatagccgcttccaacggtattacctgggatgacgggtacgaggtctatctgtctttctttcctggatcggaatgcttcttggaggcatttaagttctacccactcgccatcggcatttataaagtgcagaagggcatgatggatgttaaatttctggaaaagactatgaggcaaaagtacgctgggctggacgccacagtgtggacccagcagaaatacacggatgtcatcaatgcgctcttagtggtaaacggactgggttggaagaaatcaaatgttagcgcagccgctaaggacttccttagtaaattcggcatccagatttga

SEQ ID NO: 6061 - RNA, 702 nt, synthetic construct
  misc_feature 1..702: note = derived and/or modified CDS sequence (opt3) from BUNV__AF325122.1__N
  source 1..702: mol_type = other RNA
atgatcgagctggagttcaacgacgtggccgctaataccagctccacatttgatcccgaagtcgcatacattaacttcaagagactctatactacgggcctttcttacgaccacataaggatcttttatattaaagggcgggaaatcaagacctcactggccaaacgcagtgagtgggaagttacattgaatttaggaggttggaaggtgactgtattcaacaccaattttcctggcaaccgaaatagcccagtgccggatgacgggctgacactacatcgtctctccggatacctggcgagatatcttctggagaaaattttgaaggtctctgatcccgagaagctcatcataaaatcgaagatcattaaccctctggctgagaaaaatggcatcacctggtcagacggtgaagaagtgtacctgagcttctttccagggagtgagatgttcctcggaacttttaggttctatcccttagccattggcatctacaaggttcagcggaaagagatggaacctaagtacctggagaagacaatgcgccaaagatatatgggccttgaagcatccacctggacggtgtctaaattgaacgaggtccagagcgccctgactgtggtatccgggctaggatggaagaaaaccaatgtttcaagtgctgcaagggaatttctcgccaagttcggtataagcatgtga

SEQ ID NO: 6062 - RNA, 702 nt, synthetic construct
  misc_feature 1..702: note = derived and/or modified CDS sequence (opt3) from Ab-BUNV(Cu20-XJ)__KJ710424.1__N
  source 1..702: mol_type = other RNA
atgctggagctcgagttcgaagacgtgcccaccaacatcggcagcacatttgatcctgaatccgggtacattaatttccagagaaactatcttccaggagtcactctggaccaaataaggatcttttacattaagggtcgggagatcaaaaattctttggccaagcgctcagaatgggaggttacgttaaacctgggcgggtggaaagtgccggtactaaataccaacttccccggaaatcgaagtaacgctgtgcctgattatggcctcacatttcaccgtattagcggttacctggcaagatatcttctggggaagtacttggccgagactgaaccagagaaactcatcatgaggaccaagataatcaatcccctggcggaaaagaacggaattacatgggagtccggccctgaggtctatctgtctttctttccaggcgctgaaatgttcctcgggacctttaaattctaccccttagccatcggaatttacaaggtgcagcggaaagagatggaccctaagtttctggagaaaactatgcgccagagatatcttggtttggatgcacagacatggaccacgactaagctggacgaagttgaaagggccctaaaggtggtctcgggcctcgggtggaaaaagaccaatgtgtcaaacgctgcacgggagttcctgagcaaatttggaatccgcatgtga

SEQ ID NO: 6063 - RNA, 702 nt, synthetic construct
  misc_feature 1..702: note = derived and/or modified CDS sequence (opt3) from ANADV(2513 Irkutsk)__KT313716.1__N
  source 1..702: mol_type = other RNA
atgatcgaactggaatttaacgacgtggccgctaataccagctccacatttgatcccgaggtcgcatacattaacttcaagagaatatatactacgggcctctcttacgaccacatcaggattttctatatcaaagggcgggaaattaagacctcacttgccaaacgcagtgagtgggaagttacactgaatttgggaggttggaaggtgactgtattcaacaccaattttcctggcaaccgaaatagcccagtgccggatgacgggttaacactgcatcgtctatccggattcctcgcgagatacctgcttgagaaaatcctgaaggtctctgatcccgagaagttgataatcaaatcgaagattatcaaccctctcgctgagaaaaatggcattacctgggccgacggtgaagaagtgtatctgtcatttttcccagggagcgagatgtttctgggaactttcaggttttaccccctcgcaatcggcatatataaggttcagcggaaagagatggaacctaagtacttagagaagacaatgcgccaaagatacatgggcctggaagccagtacctggacggtgtccaaacttaacgaggtccagtctgctttgactgtggtaagcgggctgggatggaagaaaaccaatgtttcctcagcagccagggagttcctagctcggtttggtattaacatgtga

SEQ ID NO: 6064 - RNA, 702 nt, synthetic construct
  misc_feature 1..702: note = derived and/or modified CDS sequence (opt3) from ANADV(EIV-23263Tyum)__KT313761.1__N
  source 1..702: mol_type = other RNA
atgatcgaactggaatttaacgacgtggccgctaataccagctccacatttgatcccgaggtcgcatacattaacttcaagagaatatatactacgggcctctcttacgaccacatcaggattttctatatcaaagggcgggaaattaagacctcacttgccaaacgcagtgagtgggaagttacactgaatttgggaggttggaagatcactgtgttcaacaccaattttcctggcaaccgaaatagcccagtaccggatgacgggttaacactgcatcgtctatccggattcctcgcgagatacctgcttgagaaaatactgaaggtgtctgatcccgagaagttgatcattaaatcgaagatcattaaccctctcgctgagaaaaatggcatcacctgggccgacggtgaagaagtctatctgtcatttttcccagggagcgagatgtttctgggaactttcaggttttaccccctcgcaataggcatttataaggtgcagcggaaagagatggaacctaagtacttagagaagacaatgcgccaaagatacatgggcctggaagccagtacctggacggtttccaaacttaacgaggtgcagtctgctttgactgtcgtgagcgggctgggatggaagaaaaccaatgtatcctcagcagccagggagttcctagctcggtttggtatcaacatgtga

SEQ ID NO: 6065 - RNA, 702 nt, synthetic construct
  misc_feature 1..702: note = derived and/or modified CDS sequence (opt3) from BATV__X73464.1__N
  source 1..702: mol_type = other RNA
atgatcgaactggaatttaacgacgtggccgctaataccagctccacatttgatcccgaggtcgcatacattaacttcaagagaatatatactacgggcctctcttacgacaatatcaggattttctatatcaaagggcgggaaattaagacctcacttagtaaacgcagcgagtgggaagttacactgaacttgggaggttggaaggtgactgtattcaataccaactttcctggcaatcgaaactccccagtgccggatgacgggttaacactgcaccgtctatctggattcctcgccagatacctgcttgagaaaatcctgaaggtctcggatcccgagaagttgataatcaaatcaaagattgtgaatcctctcgcggagaaaaacggcatcacctgggctgacggtgaagaagtttatctgagctttttcccagggagtgagatgtttctgggaactttcaggttttaccccctcgccattggcatctataaggtgcagcggaaagagatggaacctaagtacttagagaagacaatgcgccaaagatacatgggcctggaagcatccacctggacggtctctaaacttaatgaggtgcagagcgccttgactgtagtttccgggctgggatggaagaaaaccaacgtgtcaagtgctgcaagggagttcctagccaagtttggtataagcatgtga

SEQ ID NO: 6066 - RNA, 702 nt, synthetic construct
  misc_feature 1..702: note = derived and/or modified CDS sequence (opt3) from BATV(668)__KT313687.1__N
  source 1..702: mol_type = other RNA
atgatcgaactggagttcaacgacgtggccgctaataccagctccacatttgatcccgaagtcgcatacctcaacttcaagagaatttatactacgggcctttcttacgacaatataaggatcttttatattaaagggcgggaaatcaaggtttcactggccaaacgcagtgagtgggaagtgaccttgaacttaggaggttggaaggtaacagtgttcaatactaactttcctggcaatcgaaacagcccagtcccggatgacgggctgaccctacaccgtctctccggattcctggcgagataccttctggagaaaattttgaaggtgtctgatcccgagaagctcatcataaaatcgaagatcattaatcctctggctgagaaaaacggcatcacatggtcagacggtgaagaagtttatctgagctttttcccagggagtgagatgtttctcggaaccttcaggttttaccccttagccattggcatctataaggtgcagcggaaagagatggaacctaagtacctggagaagactatgcgccaaagatacatgggccttgaagcatccacatggaccgtctctaaattgaatgaggtgcagagcgccctgacggtagtttccgggctaggatggaagaaaactaacgtgtcaagtgctgcaagggagttcctcgccaagtttggtataaatatgtga

SEQ ID NO: 6067 - RNA, 702 nt, synthetic construct
  misc_feature 1..702: note = derived and/or modified CDS sequence (opt3) from BATV(804922)__FJ436805.1__N
  source 1..702: mol_type = other RNA
atgatcgaactggaatttaacgacgtggccgctaataccagctccacatttgatcccgaggtcgcatacattaacttcaagagaatatatactacgggcctctcttacgacaatatcaggattttctatatcaaagggcgggaaattaagacctcacttgccaaacgcagtgagtgggaagttacactgaacttgggaggttggaaggtgactgtattcaataccaactttcctggcaatcgaaacagcccagtgccggatgacgggttaacactgcaccgtctatccggattcctcgcgagatacctgcttgagaaaatcctgaaggtctctgatcccgagaagttgataatcaaatcgaagattgtgaatcctctcgctgagaaaaacggcatcacctgggccgacggtgaagaagtttatctgtcatttttcccagggagcgagatgtttctgggaactttcaggttttaccccctcgcaattggcatctataaggtgcagcggaaagagatggaacctaagtacttagagaagacaatgcgccaaagatacatgggcctggaagccagtacctggacggtctccaaacttaatgaggtgcagtctgctttgactgtagttagcgggctgggatggaagaaaaccaacgtgtcctcagcagccagggagttcctagctaagtttggtataagtatgtga

SEQ ID NO: 6068 - RNA, 702 nt, synthetic construct
  misc_feature 1..702: note = derived and/or modified CDS sequence (opt3) from BATV(8627-11)__FJ436802.1__N
  source 1..702: mol_type = other RNA
atgatcgaactggaatttaacgacgtggccgctaataccagctccacatttgatcccgaggtcgcatacattaacttcaagagaatatatactacgggcctctcttacgacaatatcaggattttctatatcaaagggcgggaaattaagacctcacttgccaaacgcagtgagtgggaagttacactgaacttgggaggttggaaggtgactgtattcaataccaactttcctggcaatcgaaacagcccagtgccggatgacgggttaacactgcaccgtctatccggattcctcgcgagatacctgcttgagaaaatcctgaaggtctctgatcccgagaagttgataatcaaatcgaagattgtgaatcctctcgctgagaaaaacggcatcacctgggccgacggtgaagaagtttatctgtcatttttcccagggagcgagatgtttctgggaactttcaggttttaccccctcgcaattggcatctataaggtgcagcggaaagagatggaacctaagtacttagagaagacaatgcgccatagatacatgggcctggaagccagtacctggacggtctccaaacttaatgaggtgcaatctgctttgactgtagttagcgggctgggatggaagaaaaccaacgtgtcctcagcagccagggagttcctagctaagtttggtataagtatgtga

SEQ ID NO: 6069 - RNA, 702 nt, synthetic construct
  misc_feature 1..702: note = derived and/or modified CDS sequence (opt3) from BATV(G-20217)__FJ436806.1__N
  source 1..702: mol_type = other RNA
atgatcgaactggaatttaacgacgtggccgctaataccagctccacatttgatcccgaggtcgcatacattaacttcaagagaatatatactacgggcctctcttacgacaatatcaggattttctatatcaaagggcgggaaattaagacctcacttgccaaacgcagtgagtgggaagttacactgaacttgggaggttggaaggtgactgtattcaataccaactttcctggcaatcgaaacagcccagtgccggatgacgggttaacactgcaccgtctatccggattcctcgcgagatacctgcttgagaaaatcctgaaggtctctgatcccgagaagttgataatcaaatcgaagattgtgaatcctctcgctgagaaaaacggcatcacctgggccgacggtgaagaagtttatctgtcatttttcccagggagcgagatgtttctgggaactttcaggttttaccccctcagtattggcatctataaggtgcagcggaaagagatggaacctaagtacttagagaagacaatgcgccaaagatacatgggcctggaagcatccacctggacggtctctaaacttaatgaggtgcagagcgccttgactgtagtttccgggctgggatggaagaaaaccaacgtgtcaagtgctgcaagggagttcctagccaagtttggtataagcatgtga

SEQ ID NO: 6070 - RNA, 702 nt, synthetic construct
  misc_feature 1..702: note = derived and/or modified CDS sequence (opt3) from BATV(MS50)__JX846604.1__N
  source 1..702: mol_type = other RNA
atgatcgagctggaatttaacgacgtggccgctaataccagctccacatttgatcccgaggtcgcatacgccaacttcaagagagttcacactacgggcctctcttatgaccatgtgaggattttctacataaaagggcgggaaatcaagacctcacttagtaaacgcagcgagtgggaagtaacactgaatttgggaggttggaagattgcggtgtataacactaatttcccttccaaccgaaataacccagtcccggatgacggcttaaccctgcaccgtctatctgggtacctcgctagatatctgtttgagaaaatcgtgaaggtttcggagcccgaaaaacttctgattaaatcaaagatcataaatcctttggccgagaaaaacggaatcacatgggcagatggcgaagagatttacctcagcttctttccaggtagtgagatgttcctggggacctttaagttctatcccctggccatcggaatttacaaagtgcagaggaaggaaatggagcctaagtacctcgaaaagactatgcggcaacgctatatgggcttagaggctggcacatggaccgtctccaaggtgaatgaagtacaggcagccgttaacgtggtctctacgctggggtggaaaaagactaatgtgagcgctgccgcgagagagtttcttgcaaaattcggaatcgccatgtga

SEQ ID NO: 6071 - RNA, 702 nt, synthetic construct
  misc_feature 1..702: note = derived and/or modified CDS sequence (opt3) from BATV(ON-1/E/94)__AB257761.1__N
  source 1..702: mol_type = other RNA
atgatcgaactggagttcaacgacgtggccgctaataccagctccacatttgatcccgaagtcgcatacattaacttcaagagagtttatactacgggcctctcttacgacaatataaggatcttttatattaaagggcgggaaatcaagacctcacttgccaaacgcagtgagtgggaagtgacactgaacttgggaggttggaaggtaactgtgttcaataccaactttcctggcaatcgaaacagcccagtcccggatgacgggttaacactgcaccgtctatccggattcctcgcgagatacctgcttgagaaaattctgaaggtgtctgatcccgagaagttgatcataaaatcgaagatcgttaatcctctcgctgagaaaaacggcattacctgggccgacggtgaagaagtgtatctgtcatttttcccagggagcgagatgtttctgggaactttcaggttttaccccctcgcaatcggcatttataaggtccagcggaaagagatggaacctaagtacttagagaagacaatgcgccaaagatacatgggcctggaagccagtacctggacggtgtccaaacttaatgaggtacagtctgctttgactgttgtgagcgggctgggatggaagaaaaccaacgtctcctcagcagccagggagttcctagctaagtttggtatcagtatgtga

SEQ ID NO: 6072 - RNA, 702 nt, synthetic construct
  misc_feature 1..702: note = derived and/or modified CDS sequence (opt3) from BATV(UgMP-6830)__JX846601.1__N
  source 1..702: mol_type = other RNA
atgatcgaactggaatttaacgacgtggccgctaataccagctccacatttgatcccgaggtcgcatacattaacttcaagagaatatatactacgggcctctcttacgacaatatcaggattttctatatcaaagggcgggaaattaagacctcacttgccaaacgcagtgagtgggaagttacactgaacttgggaggttggaaggtgactgtattcaataccaactttcctggcaatcgaaacagcccagtgccggatgacgggttaacactgcaccgtctatccggattcctcgcgagatacctgcttgagaaaatcctgaaggtctctgatcccgagaagttgataatcaaatcgaagattatcaatcctctcgctgagaaaaacggcattacctgggccgacggtgaagaagtgtatctgtcatttttcccagggagcgagatgtttctgggaactttcaggttttaccccctcgcaatcggcatatataaggttcagcggaaagagatggaacctaagtacttagagaagacaatgcgccaaagatacatgggcctggaagccagtacctggacggtgtccaaacttaatgaggtccagtctgctttgactgtggtaagcgggctgggatggaagaaaaccaacgtttcctcagcagccagggagttcctagctaagtttggtattagtatgtga

SEQ ID NO: 6073 - RNA, 702 nt, synthetic construct
  misc_feature 1..702: note = derived and/or modified CDS sequence (opt3) from BIRV(ArB2198)__AM711131.1__N
  source 1..702: mol_type = other RNA
atgatcgagctggagttccaccatgtggccgctaacaccagctccacatttgaccccgaagtcgcatacgccaatttcaagaggattcacactaacggcctctcttatgataatataagaatcttttacattaaagggcgggaaatcaagacgtcacttgcgaaacgcagtgagtgggaagttaccctgaacttgggaggttggaaggtggctgtatataatacaaacttccctggcaatcgaaacaatccagtgccggacgatgggttaactctgcatcgtctaagcggatttctcgccagatacctgcttgagaaaatgctgaaggtctccgagcccgaaaagttgattatcaaaaccaagataatcaaccctctcgcagagaaaaatggcattacatggaaggacggtgaagaggtgtatctgtctttctttccagggtcggagatgttcctgggaacctttaaattctaccccctcgccatcggcatttataaggttcagaagaaagaaatggatcctaagtacttagagaaaactatgaggcaacggtacatgggcctggaggcttcaacatggaccgtgagcaaggtcagtgaagtgcagtccgcacttacggtagtttctagcttggggtggaaaaagactaacgtgaccgccgctgcccgcgactttttcgcgaaatttggaatcaatatgtga

SEQ ID NO: 6074 - RNA, 702 nt, synthetic construct
  misc_feature 1..702: note = derived and/or modified CDS sequence (opt3) from BOZOV(ArB13529)__AM711132.1__N
  source 1..702: mol_type = other RNA
atgatcgagctggagttcaacgacgtggccgctaataccagctccacatttgatcccgaagcagcctacgcgaacttcaagagagtccacactacgggcctcacctatgaccatattaggatattttacatcaaagggtctgaaattaagacatcacttgctaaacggagtgagtgggaagttactctgaatttgggaggttggaagatcaccgtgtataacacaaatttccctggcaaccgcaataacccaagcccggatgacgggttaaccctgcactttttctgcggatttctagccaaatccctcctggagaagatgcttaaggtatctgcacccgagaaactgattatcaagtcgaaaataacttcacctttggccgaaaagaatggcatcacatggaacgatggtgaggaagtgtacctcagcttctttccagggagtgagatgttcctgggaacctttcatttctatcccctgcctattggcatctaccagggcctccgacgtgacttagagccaaaatattttgggaagacgctgagacttatgtacatgggattggaggcttcctcttggactgtcagcaagctgaccgaaggtcaatccgcactaacagtggtttcaggcctcgggtggaaaaagactaatgtgagtgccgctgccagggatttcctggcgaaattcggaattaacatgtga

SEQ ID NO: 6075 - RNA, 702 nt, synthetic construct
  misc_feature 1..702: note = derived and/or modified CDS sequence (opt3) from CVV__X73465.1__N
  source 1..702: mol_type = other RNA
atgatcgagctggaatttaacgacgtggccgctaataccagctccacatttgatcccgagattgcatacgtcaacttcaagagaatacacactacgggcctctcttatgaccatatcaggattttctacatcaaagggcgggaaattaagacctcacttacaaaacgcagtgagtgggaagttactctgaatttgggaggttggaaggtgaccgtattcaacacaaattttcctggcaaccgaaatagcccagtgccggatgacgggttaaccctgcaccgtctatccggatatctcgccagatacctgcttgagaaaatcctgaaggtctctgatcccgagaaggtgataatcaaatcgaagattatcaaccctttggcggagaaaaatggcattacttggtcagacggtgaagaagtttatctcagcttctttccagggagtgagatgttcctgggaacatttaagttctaccccctggctatcggcatatataaagtgcagaggaaggagatggaacctaagtacctcgagaaaaccatgcggcaacgctacatgggcttagaagcctccacgtggactatttctaaggtcaacgaggtgcaggcagccctgaccgtagttagcgggcttggatggaaaaagacaaatgtgtccgctgcagccagagaatttttggctaaattcggtatctcaatgtga

SEQ ID NO: 6076 - RNA, 702 nt, synthetic construct
  misc_feature 1..702: note = derived and/or modified CDS sequence (opt3) from CVV(10081)__KP835932.1__N
  source 1..702: mol_type = other RNA
atgatcgagctggaatttaacgacgtggccgctaataccagctccacatttgatcccgagattgcatacgtcaacttcaagagaatatatactacgggcctctcttacgaccacatcaggattttctatatcaaagggcgggaaattaagacctcacttacaaaacgcagtgagtgggaagttactctgaatttgggaggttggaagatcaccgtgttcaacacaaattttcctggcaaccgaaatagcccagtaccggatgacgggttaaccctgcatcgtctatccggatacctcgccagatatctgcttgagaaaatactgaaggtgtctgatcccgagaaggtcatcattaaatcgaagatcattaaccctttggcggagaaaaatggcatcacttggtcagacggtgaagaagtgtacctcagcttctttccagggagtgagatgttcctgggaacatttaagttctatcccctggctataggcatttacaaagttcagaggaaggagatggaacctaagtacctcgagaaaaccatgcggcaacgctatatgggcttagaagcctccacgtggactatctctaaggtgaacgaggtccaggcagccctgaccgtggtaagcgggcttggatggaaaaagacaaatgtttccgctgcagccagagaatttttggctaaattcggtatttcaatgtga

SEQ ID NO: 6077 - RNA, 702 nt, synthetic construct
  misc_feature 1..702: note = derived and/or modified CDS sequence (opt3) from CHLV(CHLV-Mex07)__EU879062.3__N
  source 1..702: mol_type = other RNA
atgatcgagctggaatttaacgacgtggccgctaataccagctccacatttgatcccgagattgcatacgtcaacttcaagagaatatatactacgggcctctcttacgaccacatcaggattttctatatcaaagggcgggaaattaagacctcacttacaaaacgcagtgagtgggaagttactctgaatttgggaggttggaaggtgaccgtattcaacacaaattttcctggcaaccgaaatagcccagtgccggatgacgggttaaccctgcatcgtctatccggatacctcgccagatatctgcttgagaaaatcctgaaggtctctgatcccgagaaggtgataatcaaatcgaagattatcaaccctttggcggagaaaaatggcattacttggtcagacggtgaagaagtttacctcagcttctttccagggagtgagatgttcctgggaacatttaagttctatcccctggctatcggcatatacaaagtgcagaggaaggagatggaacctaagtacctcgagaaaaccatgcggcaacgctatatgggcttagaagcctccacgtggactgtctctaaggtgaacgaggtacaggcagccctgaccgttgtgagcgggcttggatggaaaaagacaaatgtctccgctgcagccagagaatttttggctaaattcggtatttcaatgtga

SEQ ID NO: 6078 - RNA, 702 nt, synthetic construct
  misc_feature 1..702: note = derived and/or modified CDS sequence (opt3) from GERV__M19420.1__N
  source 1..702: mol_type = other RNA
atgctggagctcgagttcgaagacgtgcccaacaatatcggcagcacctttgatcctgaatccgggtacacaaacttccagagaaattatcttccaggagtcactctggaccaaattaggatattttacatcaagggtcgggagattaaaaactctttgtcaaagcgcagtgaatgggaggttacgttaaatctgggcgggtggaaagtgccggtactaaacaccaatttccccggaaaccgaaataacgccgtgcctgattatggcctcacatttcaccgtatcagcggttacctggctagatatcttctggggaagtacttggcagagactgaaccagagaaactcattatgaggaccaagatcgtcaatcccctggccgaaaagaacggaataacatgggagtccggccctgaggtgtatctgtctttctttccaggcgcggaaatgttcctcgggacctttcggttctaccccttagctatcggaatttacaaagttcagcgcaaggagatggaccctaaatttctggaaaagactatgagacagaggtatcttggtatcgatgcccagacatggaccacgactaaattgggcgaggtggaagcagccctgaaggtcgtgtcggggctaggatggaagaaaaccaatgtatcaagcgctgcacgggagttcctcagtaagtttggcattcgcatgtga

SEQ ID NO: 6079 - RNA, 702 nt, synthetic construct
  misc_feature 1..702: note = derived and/or modified CDS sequence (opt3) from IACOV(BeAn314206)__JN572067.1__N
  source 1..702: mol_type = other RNA
atgagcgagatcattttcgacgatgtgggccagataacctcctctacatttaaccccgacgtccaatacatcaatttcaagaaaaaccacactacggggctgaattatgatcagattagagtgtttttcctcaacggaaagaaagccaaggaaacccttgctaaaaggtcagaggaaagtctgcagttgaattttggtggctggcgggttgtagtgatgaacacacatttccctgggaatcgcaacatgttaatcccagacgaggcaatgactctgcaccgactaagcggatacctcgcccgttatctgcttgaaaggattctgtccggcccggagcatgagaaggtcgtgatcacctctaagatagttaatcccatcgcggcttcgaacggtattacatggaccgatgggcctgaagtgtacttgtcatttttcccaggaactgagatgtttctcgagagcttcaaattttatcccctggccatcggcatttacaaggtccagaaaaagatgatggaaagtaaatatctggagaaggcaatgagacaaaagtactccggcatggacgccacactctggacccagcagaaatacgctgaagtgacgaatgcattagccgtagtttctaacctggggtggaagaaaagcaatgtgtccgctgccgcgcgggatttccttgcaaagtttggaatccagttgtga

SEQ ID NO: 6080 - RNA, 702 nt, synthetic construct
  misc_feature 1..702: note = derived and/or modified CDS sequence (opt3) from ILEV(ArB16282)__AM709780.1__N
  source 1..702: mol_type = other RNA
atgatcgagctggagttccacgacgtgaccgccaacacaagctccacttttgatcccgaagtcgcttacgcaaatttcaagaggattcatacgaacggcctcaattatgaccacataagaatcttttacattaaagggcgggaaatcaagacctctcttgccaaacgctcagagtgggaagttacactgaacttgggaggttggaagattagtgtgtataatactaaattccctggcaaccgaaataacccagtaccggatgacgggttaaccctgcatcgtctaagcggatttctcgcgagatacctgcttgagaagatgctgaaggtgtccgagcccgaaaaattgatcataaagtctaaaatcattaatcctctcgctgagaagaacggcatcacatggtatgatggtgaagaggtctacctgtcgttctttccagggtcagagatgtgcctgggaacccaggacttctatcccatggccattgaattttaccaagtgcagaggaaagagatggaacctaagttcctcgagaagactttaaaacagcggagcctgggccttgaaccaagtacatggaccatctcccagttggttaagctgcaatctgcactaacggtggtcagcggcctcgggtggaaaaagactaatgtgggagccgctgcacgcaactttctggccaaattcggtataaatatgtga

SEQ ID NO: 6081 - RNA, 702 nt, synthetic construct
  misc_feature 1..702: note = derived and/or modified CDS sequence (opt3) from ILEV(HB80P125)__AM709779.1__N
  source 1..702: mol_type = other RNA
atgatcgagctggaatttcacgacgtgaccgccaacacaagctccacttttgatcccgaggtcgcttacgcaaatttcaagaggattcatacgaacggcctcaattatgaccacataagaatcttttacattaaagggcgggaaatcaagacctctcttgccaaacgctcagagtgggaagttacactgaacttgggaggttggaagattgcggtgtataatactaacttccctggcaatcgaaacaatccagtaccggatgacgggttaaccctgcatcgtctaagtggatacctcgctagatgcctgcttgagaaaatgctgaaggtgagcgagcccgaaaagcagatcataaaatccaagatcattaaccctttggccgagaaaaatggcatcacatgggatgacggtgaagaggtctatctctctttcttcccagggtcggagatgtttctgggaaccttcaggttttaccccctggcaattggcatctataaggtgcaacggaaagaaatggagcctaagtacctcgaaaagactatgcgccagagatacatgggcttagaggcctcaacatggaccataagcaaactggctgaagttcagagtgcacttacggtggtctccgggttgggatggaagaaaactaacgtgtctgccgctgccagggatttcctggcgaagtttggtattaatatgtga

SEQ ID NO: 6082 - RNA, 702 nt, synthetic construct
  misc_feature 1..702: note = derived and/or modified CDS sequence (opt3) from ILEV(ILESHA/8e)__KC608151.1__N
  source 1..702: mol_type = other RNA
atgatcgagctggaatttcacgacgtgaccgccaacacaagctccacttttgatcccgaggtcgcttacgcaaatttcaagaggattcatacgaacggcctcaattatgaccacataagaatcttttacattaaagggcgggaaatcaagacctctcttgccaaacgctcagagtgggaagttacactgaacttgggaggttggaagattgcggtgtataatactaacttccctggcaatcgaaacaatccaatcccggatgacgggttaaccctgcatcgtctaagtggatacctcgctagatatctgcttgagaaaatgctgaaggtaagcgagcccgaaaagcagataatcaaatccaagattatcaaccctttggccgagaaaaatggcattacatgggatgacggtgaagaggtgtacctctctttcttcccagggtcggagatgtttctgggaaccttcaggttttatcccctggcaatcggcatatacaaggtccaacggaaagaaatggagcctaagtacctcgaaaagactatgcgccagagatatatgggcttagaggcctcaacatggaccattagcaaactggctgaagtgcagagtgcacttacggttgtgtccgggttgggatggaagaaaactaacgtctctgccgctgccagggatttcctggcgaagtttggtatcaatatgtga

SEQ ID NO: 6083 - RNA, 702 nt, synthetic construct
  misc_feature 1..702: note = derived and/or modified CDS sequence (opt3) from ILEV(R5964)__AY729651.1__N
  source 1..702: mol_type = other RNA
atgatcgagctggaatttcacgacgtgaccgccaacacaagctccacttttgatcccgaggtcgcttacgcaaatttcaagaggattcatacgaacggcctcaattatgaccacataagaatcttttacattaaagggcgggaaatcaagacctctcttgccaaacgctcagagtgggaagttacactgaacttgggaggttggaagattgcggtgtataatactaacttccctggcaatcgaaacaatccaatcccggatgacgggttaaccctgcatcgtctaagtggatacctcgctagatatctgcttgagaaaatgctgaaggtaagcgagcccgaaaagcagataatcaaatccaagattatcaaccctttggccgagaaaaatggcattacatgggatgacggtgaagaggtgtacctctctttcttcccagggtcggagatgtttctgggaaccttcaggttttatcccctggcaatcggcatatacaaggtccaacggaaagaaatggagcctaagtacctcgaaaagactatgcgccagagatatatgggcttagaggcctcaacatggaccattagcaaactggctgaagtgcagagtgcacttacggttgtgtccgggttgggatggaagaaaactaacgtctctgccccagctagggatttcctggccaagtttggtatcaatatgtga

SEQ ID NO: 6084 - RNA, 702 nt, synthetic construct
  misc_feature 1..702: note = derived and/or modified CDS sequence (opt3) from MAGV__D13783.1__N
  source 1..702: mol_type = other RNA
atgatcgagctggagttcaacgacgtggccgctaataccagctccacatttgatcccgaaattgcatacgtcaacttcaagagaatacacactacgggcctctcttatgaccatatcagggttctttacattaaagggcgggaaatcaagacctcactgacaaaacgcagtgagtgggaagtgactttgaatttaggaggttggaaggtagccgtgtttaacaccaatttccctggcaaccgaaatagcccagtcccggatgacgggctgacactacaccgtctctccggatttctggcgagatatcttctggagaaaattttgaaggtgtctgatcccgagaagctcatcataaaatcgaagatcattaaccctctggctgagaaaaatggcatcacctgggccgacggtgaagaagtttacctgtcattctttccagggagcgagatgttcctcggaacttttaagttctatcccttagcaattggcatctacaaagtgcagaagaaggagatggaacctaaatatctggagaagacaatgaggcaacggtacatgggccttgaagccgctacctggacggtcagtaaagtgaacgaggtacaggcagccttgactgttgtgtccgggctgggatggaagaaaaccaatgtctctgctgccgcgcgcgaatttctagcaaagttcggtataaacatgtga

SEQ ID NO: 6085 - RNA, 702 nt, synthetic construct
  misc_feature 1..702: note = derived and/or modified CDS sequence (opt3) from MAGV(7272)__KX100103.1__N
  source 1..702: mol_type = other RNA
atgatcgagctggagttcaacgacgtggccgctaataccagctccacatttgatcccgaaattgcatacgtcaacttcaagagaatacacactacgggcctctcttatgaccatatcagggttctttacattaaagggcgggaaatcaagacctcactgacaaaacgcagtgagtgggaagtgactttgaatttaggaggttggaaggtagccgtgtttaacaccaatttccctggcaaccgaaatagcccagtcccggatgacgggctgacactacaccgtctctccggatttctggcgagatatcttctggagaaaattttgaaggtgtctgatcccgagaagctcatcataaaatcgaagatcattaaccctctggctgagaaaaatggcatcacctgggccgacggtgaagaagtttacctgtcattctttccagggagcgagatgttcctcggaacttttaagttctatcccttagcaattggcatctacaaagtgcagaggaaggagatggaacctaagtatctggagaaaacaatgcggcaacgctacatgggccttgaagccgctacctggacggtcagtaaggtgaacgaggtacaggcagccttgactgttgtgtccgggctgggatggaaaaagaccaatgtctctgctgccgcgagagaatttctagcaaaattcggtataaacatgtga

SEQ ID NO: 6086 - RNA, 702 nt, synthetic construct
  misc_feature 1..702: note = derived and/or modified CDS sequence (opt3) from MAGV(3363)__KX100106.1__N
  source 1..702: mol_type = other RNA
atgatcgagctggaatttaacgacgtggccgctaataccagctccacatttgatcccgagattgcatacgtcaacttcaagagaatatatactacgggcctctcttacgaccacatcaggattttctatatcaaagggcgggaaattaagacctcacttacaaaacgcagtgagtgggaagttactctgaatttgggaggttggaaggtgaccgtattcaacacaaattttcctggcaaccgaaatagcccagtgccggatgacgggttaaccctgcatcgtctatccggatacctcgccagatatctgcttgagaaaatcctgaaggtctctgatcccgagaaggtgataatcaaatcgaagattatcaaccctttggcggagaaaaatggcattacttggtcagacggtgaagaagtttacctcagcttctttccagggagtgagatgttcctgggaacatttaagttctatcccctggctatcggcatatacaaagtgcagaggaaggagatggaacctaagtacctcgagaaaaccatgcggcaacgctatatgggcttagaagcctccacgtggactatttctaaggtcaacgaggtgcaggcagccctgaccgtagttagcgggcttggatggaaaaagacaaatgtgtccgctgcagccagagaatttttggctaaattcggtatctcaatgtga

SEQ ID NO: 6087 - RNA, 702 nt, synthetic construct
  misc_feature 1..702: note = derived and/or modified CDS sequence (opt3) from NRIV(DakArY357/6e)__AY593727.1__N
  source 1..702: mol_type = other RNA
atgatcgagctggaatttcacgacgtgaccgccaacacaagctccacttttgatcccgaggtcgcttacgcaaatttcaagaggattcatacgaacggcctcaattatgactacataagaatcttttatattaaagggcgggaaatcaagacctctcttgccaaacgctcagagtgggaagttacactgaacttgggaggttggaagattgcggtgtacaatactaacttccctggcaatcgaaacaatccaatcccggatgacgggttaaccctgcaccgtctaagtggatatctcgctagatacctgcttgagaaaatgctgaaggtaagcgagcccgaaaagcagataatcaaatccaagattatcaaccctttggccgagaaaaatggcattacatgggatgacggtgaagaggtgtatctctctttcttcccagggtcggagatgtttctgggaaccttcaggttttaccccctggcaatcggcatatacaaggtccaacggaaagaaatggagcctaagtatctcgaaaagactatgcgccagagatacatgggcttagaggcctcaacatggaccattagcaaactggctgaagtgcagagtgcacttacggttgtgtccgggttgggatggaagaaaactaacgtctctgccgctgccagggatttcctggcgaagtttggtatcaatatgtga

SEQ ID NO: 6088 - RNA, 702 nt, synthetic construct
  misc_feature 1..702: note = derived and/or modified CDS sequence (opt3) from NORV__X73470.1__N
  source 1..702: mol_type = other RNA
atgatcgagctggagttcaacgacgtggccgctaataccagctccacatttgatcccgaagtcgcatacattaacttcaagagagtttatactacgggcctctcttacgaccacataaggatcttttatattaaagggcgggaaatcaagacctcacttacaaaacgcagtgagtgggaagtgactctgaatttgggaggttggaaggtaaccgtgttcaacacaaattttcctggcaaccgaaatagcccagtcccggatgacgggttaaccctgcatcgtctatccggattcctcgccagatacctgcttgagaaaattctgaaggtgtctgagcccgaaaagttgatcataaaatcgaagatcattaaccctctcgcggagaaaaatggcatcacttggacagatggtgaagaggtttatctgtcatttttcccagggagcgagatgtttctgggaaccttcaagttttaccccctcgctattggcatctataaagtgcagaggaaggaaatggagcctaagtacttagagaaaacgatgcggcaacgctacatgggcctggaagccagtacttggaccatatccaaggtcaacgaagtgcaggcagcccttacagtagtttctgggttgggatggaaaaagactaatgtgagcgctgcagccagagagttcctggctaaatttggtattaacatgtga

SEQ ID NO: 6089 - RNA, 702 nt, synthetic construct
  misc_feature 1..702: note = derived and/or modified CDS sequence (opt3) from POTV(89-3380)__AY729652.1__N
  source 1..702: mol_type = other RNA
atgatcgagctggaatttaacgacgtggccgctgataccagctccacatttgaccccgagattgcatacgtcaatttcaagagaatacacactacgggcctctcttatgatcatatcaggattttctacatcaaagggcgggaaattaagacctcacttacaaaacgcagtgagtgggaagttactctgaacttgggaggttggaagatcaccgtgttcaatacaaactttcctggcaatcgaaacagcccagtaccggacgatgggttaaccctgcaccgtctatccggatatctcgccagatacctgcttgagaaaatactgaaggtgtctgaccccgagaaggtcatcattaaatcgaagatcattaatcctttggcggagaaaaacggcatcacttggtcagatggtgaagaagtgtatctcagcttctttccagggagtgagatgttcctgggaacatttaagttctaccccctggctataggcatttataaagttcagaggaaggagatggaacctaagtacctcgagaaaaccatgcggcaacgctacatgggcttagaagcctccacgtggactgtgtctaaggtcaatgaggtgcaggcagccctgaccgtagttagcgggcttggatggaaaaagacaaacgtgtccgctgcagccagagaatttttggctaaattcggtatctcaatgtga

SEQ ID NO: 6090 - RNA, 702 nt, synthetic construct
  misc_feature 1..702: note = derived and/or modified CDS sequence (opt3) from SHOV(4042)__EU564831.1__N
  source 1..702: mol_type = other RNA
atgatcgagctggagttccacgacgtggccgctaacaccagctccacatttgatcccgaagtcgcatacgccaatttcaagagagttcatactacgggcctctcttatgaccacattaggatattttacatcaaagggcgggaaattaagacctcacttgcgaaacgcagtgagtgggaagtgacactgaacttgggaggttggaagatcactgtatataataccaacttccctggcaatcgaaacaatccagtgccggatgacgggttaacactgcatcgtctaagcggatttctcgctagatacctgcttgagaaaatgctgaaggtctccgagcccgaaaagttgattatcaaatctaagataatcaaccctctcgccgagaaaaatggcattacctggactgatggtgaagaggtgtatctgtcgttctttccaggggcagagatgttcctgggaacatttaagttctaccccctcgccatcggcatttataaagttcagaggaaggaaatggagcctaagtacttagaaaagaccatgcggcaacgctacatgggcctggaggctgcaacgtggactgtgtcaaaacttaccgaagtccaggccgctttgacagtggtaagcgggctgggatggaaaaagactaacgttagtgccgcggcaagagactttctagccaaattcggtatctccatgtga

SEQ ID NO: 6091 - RNA, 702 nt, synthetic construct
  misc_feature 1..702: note = derived and/or modified CDS sequence (opt3) from TENV(TSV-FE3-66FB)__FJ943505.1__N
  source 1..702: mol_type = other RNA
atgatcgaactggagttcaacgacgtggccgctaataccagctccacatttgatcccgaagtcggctacgttaacttcaagagagtgcacactacggggctctcttatgaccatattaggatattttacatcaaaggacgggaaattaagacctcacttacaaaacgcagtgagtgggaagtaactctgaatttgggtggctggaaggtgaccgtcttcaacacaaattttcctgggaaccgaaatagcccagtgccggatgacggattaaccctgcaccgtctatccggcttcctcgcaagatatctgcttgagaaaatcctgaaggtttctgatcccgagaagttgattatcaaatcgaagataatcaaccctctcgccgagaaaaatggtattacttgggcggacggggaagaagtgtacctgtcatttttcccaggaagcgagatgtttctgggcacattcaagttttatcccctcgctatcggcatttacaaagtccagaggaaggagatggaacctaagtatttagagaaaaccatgcggcaacgctacatggggctggaagccgcaacgtggactatcagtaaggtgaacgaggtacagtccgcccttaccgttgtgtctggattgggttggaaaaagacaaatgtcagcgctgcagccagagagttcctggctaaatttggcataaacatgtga

SEQ ID NO: 6092 - RNA, 702 nt, synthetic construct
  misc_feature 1..702: note = derived and/or modified CDS sequence (opt3) from XINV(BeH388464)__EU564830.1__N
  source 1..702: mol_type = other RNA
atgctggaactcgaatttaacgacgtggccgctaataccagctccacatttgatcccgaggtcggctacgcaaacttcaagagaatccacactaatgggctttcttatgacaacattaggatattttacatcaaaggacgggaaattaagacgtcactggccaaacgcagtgagtgggaagttaccttgaatttaggtggctggaagatcacagtgtataacactaatttccctgggaaccgaaatcatccaattccggatgacggactgaccatccaccgtctaagcggctacctcgcgagatatctgcttgagaaaatactgaaggtatccgatcccgagaagttgctcatcaaaacaaagattatcaaccctctggctgagaaaaatggtattacctggaacgacggggaagaagtgtacctgtctttcttcccaggatcggagatgtttctcggcactttcaagttttatcccttagccatcggcatatacaaagtccagaggaaggagatggaacctaagtacctggagaaagcaatgcggcaacgctatatggggcttgaatcagccacatggaccgtgagcaagttgaatgaggttcagagtgctctgacggtggtctccggactaggttggaaaaagactaacgtgtctgcagccgctagagagttcctcgccaaatttggcattaatatgtga

SEQ ID NO: 6093 - RNA, 702 nt, synthetic construct; identical to SEQ ID NO: 6055
  misc_feature 1..702: note = derived and/or modified CDS sequence (opt3) from NRIV(9800535)__JX857328.1__N
  source 1..702: mol_type = other RNA

SEQ ID NO: 6094 - RNA, 702 nt, synthetic construct
  misc_feature 1..702: note = derived and/or modified CDS sequence (opt3) from NRIV(Adrar)__KJ716848.1__N
  source 1..702: mol_type = other RNA
atgatcgagctggagttccacgacgtggccgctaacaccagctccacatttgatcccgaagtcgcatacgccaatttcaagagaatttatactacgggcctctcttacgaccatataaggatcttttatattaaagggcgggaaatcaagacctcacttgcgaaacgcagtgagtgggaagttacactgaacttgggaggttggaagattactgtgtacaataccaacttccctggcaatcgaaacaatccagtaccggatgacgggttaacactgcaccgtctaagcggatttctcgctagatatctgcttgagaaaatgctgaaggtgtccgagcccgaaaagttgatcataaaatctaagatcattaaccctctcgccgagaaaaatggcatcacctggaacgatggtgaagaggtctacctgtcgttctttccagggtcagagatgttcctgggaacttttaggttctatcccctcgcaattggcatctacaaggtgcagcggaaagaaatggagcctaagtacttagaaaagacaatgcgccaaagatatatgggcctggaggccgctacctggacggttagcaaacttactgaagtgcagagtgcattgaccgtcgtgtcctctctggggtggaagaaaacaaatgtaagcgccgctgccagggactttctagcgaagttcggaataaacatgtga

SEQ ID NO: 6095 - RNA, 702 nt, synthetic construct
  misc_feature 1..702: note = derived and/or modified CDS sequence (opt3) from NRIV(D28542/4e)__KC608154.1__N
  source 1..702: mol_type = other RNA
atgatcgagctggagttccacgacgtggccgctaacaccagctccacatttgatcccgaagtcgcatacgccaatttcaagagagtttatactacgggcctctcttacgaccatattaggatattttatatcaaagggcgggaaattaagacctcacttgcgaaacgcagtgagtgggaagtgacactgaacttgggaggttggaagatcactgtatacaataccaacttccctggcaatcgaaacaatccagtgccggatgacgggttaacactgcaccgtctaagcggatttctcgctagatatctgcttgagaaaatgctgaaggtctccgagcccgaaaagttgattatcaaatctaagataatcaaccctctcgccgagaaaaatggcattacctggaacgatggtgaagaggtgtacctgtcgttctttccagggtcagagatgttcctgggaacttttaggttctatcccctcgcaatcggcatttacaaggttcagcggaaagaaatggagcctaagtacttagaaaagacaatgcgccaaagatatatgggcctggaggccgctacctggacggtgagcaaacttactgaagtccagagtgcattgaccgtggtatcctctctggggtggaagaaaacaaatgttagcgccgctgccagggactttctagcgaagttcggaatcaacatgtga

SEQ ID NO: 6096 - RNA, 702 nt, synthetic construct
  misc_feature 1..702: note = derived and/or modified CDS sequence (opt3) from NRIV(SUD-HKV141)__JX857322.1__N
  source 1..702: mol_type = other RNA
atgatcgagctggagttccacgacgtggccgctaacaccagctccacatttgatcccgaagtcgcatacgccaatttcaagagagttcatactacgggcctctcttatgaccacattaggatattttacatcaaagggcgggaaattaagacctcacttgcgaaacgcagtgagtgggaagtgacactgaacttgggaggttggaaggtaactgtgtataataccaacttccctggcaatcgaaacaatccagtcccggatgacgggttaacactgcatcgtctaagcggatttctcgctagatacctgcttgagaaaatgctgaaggtgtccgagcccgaaaagttgatcattaaatctaagatcataaaccctctcgccgagaaaaatggcatcacctggaacgatggtgaagaggtttatctgtcgttctttccagggtcagagatgttcctgggaacttttaggttctaccccctcgcaattggcatctataaggtgcagcggaaagaaatggagcctaagtacttagaaaagacaatgcgccaaagatacatgggcctggaggccgctacctggacggtcagcaaacttactgaagtgcagagtgcattgaccgtagtttcctctctggggtggaagaaaacaaatgtgagcgccgctgccagggactttctagcgaagttcggaattaacatgtga

SEQ ID NO: 6097 - RNA, 705 nt, synthetic construct
  misc_feature 1..705: note = derived and/or modified CDS sequence (opt3) from BWAV(M459)__NC_034480.1__N
  source 1..705: mol_type = other RNA
atgagcgacctgatcttctacgatgtggactccgtcaacgccaatgagtttgatcccgacaccggctatctcgatttcaagaacaattaccctggggctcttaacacaaatactgcaagaacgtttttcctgaacgccgcgaaagctaagaatgttttgaggaacaaaccagacaagaaagtgaatccgaagtttggaaactgggaagtagaggtggtcaataaccacttccccggtaatcggaacaatcctattggcaaggatgacttaaccctgcatcgcatatctgggtatctagcccgatggatcctcgaagagtacaaacgtgatgacgaatcagagaaggagattatcgaaagtacagtgattaacccaatcgcagagagcaacggaataagatggtccgatggcgccgaaatctatctgtcgtttttccccggtactgagatgtttcttgagcctttcaaattttacccactggctattgggatctatagggttaagcacaaaatgatggacgcacagttcttgaagaaggccctccggcaacgctacggaaaaatgaccgctgaaaagtggatgtctacaaaagtgaagaccattggcgaggccgtcagaaatgtggaaaaactgaagtggggcaaagggggactgtcagatgcggcaaggaactttctcaagaagttcgacatcgccatgatatga

SEQ ID NO: 6098 - RNA, 705 nt, synthetic construct
  misc_feature 1..705: note = derived and/or modified CDS sequence (opt3) from BWAV(M459)__EU564827.1__N
  source 1..705: mol_type = other RNA
atgagcgacctgatcttctacgatgtggactccgtcaacgccaatgagtttgatcccgacaccggctatctcgatttcaagaacaattaccctggggctcttaacacaaatactgcaagaacgtttttcctgaacgccgcgaaagctaagaatgttttgaggaacaaaccagacaagaaagtgaatccgaagtttggaaactgggaagtagaggtggtcaataaccacttccccggtaatcggaacaatcctattggcaaggatgacttaaccctgcatcgcatatctgggtatctagcccgatggatcctcgaagagtacaaacgtgatgacgaatcagagaaggagattatcgaaagtacagtgattaacccaatcgcagagagcaacggaataagatggtccgatggcgccgaaatctatctgtcgtttttccccggtactgagatgtttcttgagcctttcaaattttacccactggctattgggatctatagggttaagcacaaaatgatggacgcacagttcttgaagaaggccctccggcaacgctacggaaaaatgaccgctgaaaagtggatgtctacaaaagtgaaggccattggcgaggcggtcagaaatgtggaaaaactgaagtggggcaaagggggactgtcagatgcagccaggaactttctcaagaagttcgacatcgctatgatatga

SEQ ID NO: 6099 - RNA, 705 nt, synthetic construct
  misc_feature 1..705: note = derived and/or modified CDS sequence (opt3) from BWAV(UgAr1888)__KJ867185.1__N
  source 1..705: mol_type = other RNA
atgagcgacctgatcttctacgatgtggactccgtcaacgccaatgagtttgatcccgacaccggctatctcgatttcaagaacaattaccctggggctcttaacacaaatactgcaagaacgtttttcctgaacgccgcgaaagctaagaatgttttgaggaacaaaccagacaagaaagtgaatccgaagtttggaaactgggaagtagagattgtgaataaccacttccccggtaatcggaacaatcctataggcaaggatgacttaaccctgcatcgcatctctgggtatctagcccgatggattctcgaagagtacaaacgtgatgacgaatcagagaaggagatcattgaaagtacagtcatcaacccaatagcagagagcaacggaatcagatggtccgatggcgccgaaatttatctgtcgtttttccccggtactgagatgtttcttgagcctttcaaattttacccactggctatcgggatttatagggtgaagcacaaaatgatggacgcacagttcttgaagaaggccctccggcaacgctacggaaaaatgaccgctgaaaagtggatgtctacaaaagttaaggccatcggcgaggcggtgagaaatgtcgaaaaactgaagtggggcaaagggggactgtcagatgcagccaggaactttctcaagaagttcgacatagctatgatttga

SEQ ID NO: 6100 - RNA, 708 nt, synthetic construct
  misc_feature 1..708: note = derived and/or modified CDS sequence (opt3) from BWAV/PGAV(SAAr1)__EU564828.1__N
  source 1..708: mol_type = other RNA
atgagcggcgacctggtgttctacgatgtcgactccgttaactctaatgcctttgatcccgacgctgggtatgtggcattctcaaacaatcaccctggagccctcaacatcaccacagcgagaacgtttttccttaatgctgccaaggcaaaaggtgtactgaggaacaagccagataaaaaggtgaaaccgaagtttggcgactgggaggtcgaaattgtgaataaccatttccccgggaatcggaacaatactataggagaggatgacttgaccttacaccgcatcagtggctacctggcccgatgggttctagaggaacatagcaaggatgacgaatccgagaaagagctcattgaatctacaatcgtgaaccctattgctgagtcgaatggtatcaagtggtcagatggggcagccatatatctgagctttttcccaggaactgaaatgtttcttgagcccttcaaatttttccctctggctatcggcatttaccgtgtcaagcacaaaatgatggacgcccagtttttgaagaaggcgctcagacaaaggtatggcaaactgaccgcagagaagtggatggccacaaaagtgaagagtatcggggaagctgtacgggccgttgagaaactgaagtggggaaaaggtggcatttccgatgcagctcgcaccttcctcaagaagttcgacatcgccttaatatga

SEQ ID NO: 6101 - RNA, 708 nt, synthetic construct; identical to SEQ ID NO: 6100
  misc_feature 1..708: note = derived and/or modified CDS sequence (opt3) from BWAV/PGAV(191B-07)__KJ867179.1__N
  source 1..708: mol_type = other RNA

SEQ ID NO: 6102 - RNA, 708 nt, synthetic construct
  misc_feature 1..708: note = derived and/or modified CDS sequence (opt3) from CEV(283)__KX817314.1__N
  source 1..708: mol_type = other RNA
atgagcgacctggtgttctacgatgtcgcctccaccggcgctaacgggtttgaccccgatgcaggatatgttgacttctgcgccaagtacggtgagtctatcaatctcgcggctgtgagaatatttttccttaacgccgcaaaagccaaggctgcactgtcaaggaaacctgaacggaaggccaatccaaaatttggcgagtggcaggtagaagtggtcaacaatcacttcccggctaaccgcaataaccccattgggaataacgatttgacaatccatcgaattagtggatatttagcccgttgggtgctggagcaatacaaggaaaatgaggacgagagccagagagagctagttaagactacggtgatcaaccctattgcggaatccaatggcatcaggtgggaaaacggtgcagagatatatctcgcctttttcccagggaccgagatgtttctggaaacattcaaattttacccccttactatcggaatttatcgggtcaagaatggcatgatggattctcagtacctgaaaaaggctttgcgccagagatacggctcgctcaccgccgagaaatggatgtcacaaaagacagggatgatcgcaaagagcctgaaagaagtggagcagctgaagtggggaaggggtggcctcagtgacaccgctcggactttcttacagaaatttgggattaagctgccttga

SEQ ID NO: 6103 - RNA, 708 nt, synthetic construct
  misc_feature 1..708: note = derived and/or modified CDS sequence (opt3) from CEV(BFS-283)__U12797.1__N
  source 1..708: mol_type = other RNA
atgagcgacctggtgttctacgatgtcgcctccaccggcgctaacgggtttgaccccgatgcaggatatgttgacttctgcgccaagcacggtgagtctatcaatctcgcggctgtgagaatatttttccttaacgccgcaaaagccaaggctgcactgtcaaggaaacctgaacggaaggccaatccaaaatttggcgagtggcaggtagaagtggtcaacaatcatttcccggctaaccgcaataaccccattgggaataacgatttgacaatccaccgaattagtggatacttagcccgttgggtgctggagcaatataaggaaaatgaggacgagagccagagagagctagttaagactacggtgatcaaccctattgcggaatccaatggcatcaggtgggaaaacggtgcagagatatacctcgcctttttcccagggaccgagatgtttctggaaacattcaaattttatccccttactatcggaatttaccgggtcaagaatggcatgatggattctcagtatctgaaaaaggctttgcgccagagatacggctcgctcaccgccgagaaatggatgtcacaaaagacagggatgatcgcaaagagcctgaaagaagtggagcagctgaagtggggaaggggtggcctcagtgacaccgctcggactttcttacagaaatttgggattaagctgccttga

SEQ ID NO: 6104 - RNA, 708 nt, synthetic construct
  misc_feature 1..708: note = derived and/or modified CDS sequence (opt3) from CHATV(Mohko ILO8-3)__KF719221.1__N
  source 1..708: mol_type = other RNA
atgagcgacctggtgttctacgatgtcgcctccaccggcgctaacgggtttgaccccgatgagggatatatggcattctgcgttaagcacgccgaatctatctcactcgcggctgtgagaatatttttccttaatgccgcaaaagccaaggctgcactggccaggaaacctgagaagaaagctagtccaaagtttggtgaatggcaggtagagattgtgaacaatcatttcccgggcaaccggaataaccccatcgggaataacgacttgacagtccaccgcttaagcggatacctggcccgatgggtgctagaacaatataaggagaatgaggatgaatcccagcgtgagctcattaaaactacggttatcaaccctattgcggaatctaatggcgtgagatgggactcgggtccagagatctacctgtcatttttccccgggaccgagatgtttcttgaaacattcaagttttatcctctgactataggaatctacagggtcaaacagggcatgatggatccacagtatttgaagaaagcactccggcaacgctacggcaccctgacagccgacaagtggatgagccagaaggtgaccgctattgccaaaagtctgaaggaggtagaacagctcaaatgggggagaggaggtttatccgatactgcaaggacattcctgcagaagtttggcatccggcttccctga

SEQ ID NO: 6105 - RNA, 708 nt, synthetic construct
  misc_feature 1..708: note = derived and/or modified CDS sequence (opt3) from CHATV(Mohko M07-1)__KF719224.1__N
  source 1..708: mol_type = other RNA
atgagcgacctggtgttctacgatgtcgcctccaccggcgctaacgggtttgaccccgatgagggatatatggcattctgcgttaagcacgccgaatctatcaatctcgcggctgtgagaatatttttccttaacgccgcaaaagccaaggctgcactggccaggaaacctgagaagaaggcttcaccaaaatttggtgaatggcaggtagagattgtgaataaccatttcccgggcaatcggaacaatcccatcgggaacaatgacttgacagtccaccgcttaagtggatacctggcccgatgggtgctagaacaatataaggagaacgaggatgaaagccagcgtgagctcattaaaactacggttatcaatcctattgcggaatccaacggcgtgagatgggactctggtccagagatctacctgtcgtttttccccgggaccgagatgtttcttgaaacattcaagttttatcctctgactataggaatctacagggtcaaacagggcatgatggatccacagtatttgaagaaagcactccggcaacgctacggcaccctgacagccgacaagtggatgtcacagaaggtgaccgctattgccaaaagcctgaaggaggtagaacagctcaaatgggggagaggaggtttaagtgatactgcaaggacattcctgcagaagtttggcatccggcttccctga

SEQ ID NO: 6106 - RNA, 708 nt, synthetic construct
  misc_feature 1..708: note = derived and/or modified CDS sequence (opt3) from CHATV(Mohko S07-2)__KF719233.1__N
  source 1..708: mol_type = other RNA
atgagcgacctggtgttctacgatgtcgcctccaccggcgctaacgggtttgaccccgatgagggatatatggcattctgcgttaagcacgccgaatctatcaatctcgcggctgtgagaatatttttccttaacgccgcaaaagccaaggctgcactggccaggaaacctgagaagaaggcttcaccaaaatttggtgaatggcaggtagagattgtgaataaccatttcccgggcaatcggaacaatcccatcgggaacaatgacttgacagtccaccgcttaagtggatacctggcccgatgggtgctagaacaatataaggagaacgaggatgaaagccagcgtgagctcattaaaactacggttatcaatcctattgcggaatccaacggcgtgagatgggactctggtccagagatctacctgtcgtttttccccgggaccgagatgtttcttgaaacattcaaggtctatcctctgactaccggaatatacagggtgaaacagggcatgatggatccacagtatttgaagaaagcactccggcaacgctacggcacactgaccgccgacaagtggatgtcacagaaggtaactgctatcgccaaaagcctgaaggaggttgaacagctcaaatgggggagaggaggtttaagtgatacagcaaggacctttctgcagaagttcggcattcggcttccctga

SEQ ID NO: 6107 - RNA, 708 nt, synthetic construct
  misc_feature 1..708: note = derived and/or modified CDS sequence (opt3) from CHATV(LEIV-11483)__FJ853592.1__N
  source 1..708: mol_type = other RNA
atgagcgacctggtgttctacgatgtcgcctccaccggcgctaacgggtttgaccccgatgagggatatatggcattctgcgttaagcacggtcagtctgtgaatctcgccgcggtaagaatctttttccttaacgctgccaaagcaaaggccgctctggcaaggaaacctgaaaagaaagcctcaccaaagtttggcgagtggcaagtggaaattgtcaataaccatttcccggggaatcggaacaatcccataggaaacaatgacttgacaatccaccgcttaagtggctacctggctcgatgggtgctagagcagtataaggaaaacgaggatgagagccagcgtgaactcattaaaactacggttatcaatcctattgccgagtccaacggtgtgagatgggactctggggcggaaatctacctgtcgtttttcccaggaaccgagatgtttcttgagacattcaagttttatcccctgactataggcatctacagggtcaaacagggcatgatggatcctcaatatttgaagaaagcactccggcagcgctacgggaccctgacagccgacaagtggatgtcacagaaggtgaccgctattgccaaaagcctgaaggaagtagagcagctcaaatggggaagaggtggcttaagtgatactgcaaggacattcctgcaaaagtttgggatccggcttccatga

SEQ ID NO: 6108 - RNA, 708 nt, synthetic construct
  misc_feature 1..708: note = derived and/or modified CDS sequence (opt3) from CHATV(LEIV-11552)__EU479702.1__N
  source 1..708: mol_type = other RNA
atgagcgacctggtgttctacgatgtcgcctccaccggcgctaacgggtttgaccccgatgagggatatatggcattctgcgttaagcacggtcagtctgtgaatctcgccgcggtaagaatctttttccttaacgctgccaaagcaaaggccgctctggcaaggaaacctgaaaagaaagcctcaccaaagtttggcgagtggcaagtggaaattgtcaataaccatttcccggggaatcggaacaatcccataggaaacaatgacttgacaatccaccgcttaagtggctacctggctcgatggattctagagcagtataaggaaaacgaggatgagagccagcgtgaactcatcaaaactacggtgattaatcctatcgccgagtccaacggtgttagatgggactctggggcggaaatatacctgtcgtttttcccaggaaccgagatgtttcttgagacattcaagttttatcccctgactatcggcatttacagggtgaaacagggcatgatggatcctcaatatttgaagaaagcactccggcagcgctacgggaccctgacagccgacaagtggatgtcacagaaggtcaccgctatcgccaaaagcctgaaggaagtggagcagctcaaatggggaagaggtggcttaagtgatactgcaaggacattcctgcaaaagtttgggattcggcttccatga

SEQ ID NO: 6109 - RNA, 708 nt, synthetic construct
  misc_feature 1..708: note = derived and/or modified CDS sequence (opt3) from CHATV(LEIV-13107)__FJ946829.1__N
  source 1..708: mol_type = other RNA
atgagcgacctggtgttctacgatgtcgcctccaccggcgctaacgggtttgaccccgatgagggatatatggcattctgcgttaagcacggtcagtctgtgaatctcgccgcggtaagaatctttttccttaacgctgccaaagcaaaggccgctctggcaaggaaacctgaaaagaaagccaatccaaagtttggcgagtggcaagtggaaattgtcaacaatcatttcccggggaaccggaataaccccataggaaataacgacttgacaatccaccgcttatcaggctacctggctcgatgggtgctagagcagtataaggaaaatgaggatgagagtcagcgtgaactcattaaaactacggttatcaaccctattgccgagagcaatggtgtgagatgggactccggggcggaagtctacctgtcgtttttcccaggaaccgagatgtttcttgagacattcaagttttatcccctgactatcggcatatacagggtgaaacagggcatgatggatcctcaatatttgaagaaagcactccggcagcgctacgggaccctgacagccgacaagtggatgtctcagaaggtaaccgctatcgccaaatcactgaaggaagttgagcagctcaaatggggaagaggtggcttaagcgatactgcaaggacattcctgcaaaagtttgggattcggcttccatga

SEQ ID NO: 6110 - RNA, 708 nt, synthetic construct
  misc_feature 1..708: note = derived and/or modified CDS sequence (opt3) from CHATV(LEIV-17794)__FJ913879.1__N
  source 1..708: mol_type = other RNA
atgagcgacctggtgttctacgatgtcgcctccaccggcgctaacgggtttgaccccgatgagggatatatggcattctgcgttaagcacggtcagtctgtgaatctcgccgcggtaagaatctttttccttaacgctgccaaagcaaaggccgctctggcaaggaaacctgaacggaaggcctcaccaaaatttggcgagtggcaagtggaaattgtcaataaccatttcccggggaatcgcaacaatcccataggaaacaatgacttgacaatccaccgattaagtggctacctggctcgttgggtgctagagcagtataaggaaaacgaggatgagagccagagagaactcattaagactacggttatcaatcctattgccgagtccaacggtgtgaggtgggactctggggcggaaatctacctgtcgtttttcccaggaaccgagatgtttcttgagacattcaaattttatcccctgactataggcatctaccgggtcaagcagggcatgatggatcctcaatatttgaaaaaggcactccgccagagatacgggaccctgacagccgacaaatggatgtcacagaaggtgaccgctattgccaagagcctgaaagaagtagagcagctcaagtggggaaggggtggcttaagtgatactgcacggacattcctgcaaaaatttgggatccgccttccatga

SEQ ID NO: 6111 - RNA, 708 nt, synthetic construct
  misc_feature 1..708: note = derived and/or modified CDS sequence (opt3) from CHATV(LEIV-17827)__GQ330475.1__N
  source 1..708: mol_type = other RNA
atgagcgacctggtgttctacgatgtcgcctccaccggcgctaacgggtttgaccccgatgagggatatatggcattctgcgttaagtacggtgaatctatcaatctcgccgcggtgagaatatttttccttaacgctgccaaagcaaaggccgctctggcaaggaaacctgagaagaaagccaatccaaagtttggcgaatggcaggtagagattgtgaacaatcacttcccggggaaccggaataaccccatcggaaataacgacttgacaattcatcgcttatcaggctatctggctcgatgggtcctagaacaatacaaggagaatgaggatgaaagtcagcgtgagctcatcaaaactacgattatcaaccctatagccgaaagcaatggtgtgagatgggagtccggggcggaggtttatctgtcgtttttcccaggaaccgaaatgtttcttgagatcttcaagttttaccccctgacaattggcatctatagggtgaaacagggcatgatggaccctcagtacttgaagaaagcactccggcaacgctacgggactctgaccgccgataagtggatgtctcagaaggtcacagctattgccaaatcactgaaggaagtggagcagctcaaatggggaagaggtggcttaagcgacaccgcaaggactttcctgcagaagtttgggatccggcttccatga

SEQ ID NO: 6112 - RNA, 708 nt, synthetic construct
  misc_feature 1..708: note = derived and/or modified CDS sequence (opt3) from CHATV(LEIV-17829)__GQ330476.1__N
  source 1..708: mol_type = other RNA
atgagcgacctggtgttctacgatgtcgcctccaccggcgctaacgggtttgaccccgatgagggatatatggcattctgcgttaagtacggtgaatctatcaatctcgccgcggtgagaatatttttccttaacgctgccaaagcaaaggccgctctggcaaggaaacctgagaagaaagccaatccaaagtttggcgaatggcaggtagagattgtgaacaatcacttcccggggaaccggaataaccccatcggaaataacgacttgacaattcatcgcttatcaggctatctggctcgatgggtcctagaacaatacaaggagaatgaggatgaaagtcagcgtgagctcatcaaaactacgattatcaaccctatagccgaaagcaatggtgtgagatgggactccggggcggaggtttatctgtcgtttttcccaggaaccgagatgtttcttgaaatcttcaagttttaccccctgacaattggcatctatagggtgaaacagggcatgatggatcctcagtacttgaagaaagcactccggcaacgctacgggactctgaccgccgacaagtggatgtctcagaaggtcacagctattgccaaatcactgaaggaggtggaacagctcaaatggggaagaggtggcttaagcgataccgcaaggactttcctgcagaagtttgggatccggcttccatga

SEQ ID NO: 6113 - RNA, 708 nt, synthetic construct
  misc_feature 1..708: note = derived and/or modified CDS sequence (opt3) from CHATV(LEIV-18733)__HQ734824.1__N
  source 1..708: mol_type = other RNA
atgagcgacctggtgttctacgatgtcgcctccaccggcgctaacgggtttgaccccgatgagggatatatggcattctgcgttaagtacggtgaatctatcaatctcgccgcggtgagaatatttttccttaacgctgccaaagcaaaggccgctctggcaaggaaacctgagaagaaagccaatccaaagtttggcgaatggcaggtagagattatcaacaatcacttcccggggaaccggaataaccccattggaaataacgacttgacaatccatcgcttatcaggctatctggctcgatgggtgctagaacaatacaaggagaatgaggatgaaagtcagcgtgagctcattaaaactacgatcataaaccctatcgccgaaagcaatggtgtcagatgggactccggggcggaggtgtatctgtcgtttttcccaggaaccgagatgtttcttgaaattttcaagttttaccccctgacaatcggcatttatagggttaaacagggcatgatggatcctcagtacttgaagaaagcactccggcaacgctacgggactctgaccgccgacaagtggatgtctcagaaggtgacagctatcgccaaatcactgaaggaggtcgaacagctcaaatggggaagaggtggcttaagcgataccgcaaggactttcctgcagaagtttgggatacggcttccatga

SEQ ID NO: 6114 - RNA, 708 nt, synthetic construct
  misc_feature 1..708: note = derived and/or modified CDS sequence (opt3) from CHATV(LEIV-18895)__GQ330482.1__N
  source 1..708: mol_type = other RNA
atgagcgacctggtgttctacgatgtcgcctccaccggcgctaacgggtttgaccccgatgagggatatatggcattctgcgttaagtacggtgaatctatcaatctcgccgcggtgagaatatttttccttaacgctgccaaagcaaaggccgctctggcaaggaaacctgagcggaaggccaatccaaaatttggcgaatggcaggtagagattgtgaacaatcacttcccggggaaccgcaataaccccatcggaaataacgacttgacaattcatcgattatcaggctatctggctcgttgggtcctagaacaatacaaggagaatgaggatgaaagtcagagagagctcatcaagactacgattatcaaccctatagccgaaagcaatggtgtgaggtgggactccggggcggaggtttatctgtcgtttttcccaggaaccgagatgtttcttgaaatcttcaaattttaccccctgacaattggcatctatcgggtgaagcagggcttgatggatcctcagtacctcaaaaaggcactgcgccaaagatacgggactctgaccgccgacaaatggatgtctcagaaggtcacagctattgccaagtcactcaaagaggtggaacagttaaagtggggaaggggtggcctgagcgataccgcacggactttccttcagaaatttgggatccgcttgccatga

SEQ ID NO: 6115 - RNA, 708 nt, synthetic construct
  misc_feature 1..708: note = derived and/or modified CDS sequence (opt3) from CHATV(LEIV-22712)__HQ734825.1__N
  source 1..708: mol_type = other RNA
atgagcgacctggtgttctacgatgtcgcctccaccggcgctaacgggtttgaccccgatgagggatatatggcattctgcgttaagcacggtgaatctatcaatctcgccgcggtgagaatatttttccttaacgctgccaaagcaaaggccgctctggcaaggaaacctgagaagaaagcctcaccaaagtttggcgaatggcaggtagagattatcaataaccatttcccggggaatcggaacaatcccattggaaacaatgacttgacaatccaccgcttaagtggctacctggctcgatgggtgctagaacaatataaggagaacgaggatgaaagccagcgtgagctcattaaaactacggtcatcaatcctatagccgaatccaacggtgtgagatgggactctggggcggagatctacctgtcgtttttcccaggaaccgagatgtttcttgaaacattcaagttttatcccctgactattggcatctacagggttaaacagggcatgatggatcctcagtatttgaagaaagcactccggcaacgctacgggaccctgacagccgacaagtggatgtcacagaaggtgaccgctattgccaaaagcctgaaggaggtcgaacagctcaaatggggaagaggtggcttaagtgatactgcaaggacattcctgcagaagtttgggatccggcttccatga

SEQ ID NO: 6116 - RNA, 708 nt, synthetic construct
  misc_feature 1..708: note = derived and/or modified CDS sequence (opt3) from CHATV(LEIV-23500)__EU479701.1__N
  source 1..708: mol_type = other RNA
atgagcgacctggtgttctacgatgtcgcctccaccggcgctaacgggtttgaccccgatgcaggatatatggccttctgcgttaagcacggtgagtctatcaatctcgcggctgtgagaatatttttccttaacgccgcaaaagccaaggctgcactggccaggaaacctgaaaagaaagctaatccaaagtttggcgagtggcaggtagaaattgtgaacaatcatttcccggggaaccggaataaccccatcggaaataacgacttgacaattcaccgcttatcaggctacctggcccgatgggtcctagagcaatataaggaaaatgaggatgagagtcagcgtgaactcatcaaaactacggtgattaaccctatcgcggagagcaatggtgttagatgggaaaacggggcagaggtgtacctgtcctttttcccaggaaccgagatgtttcttgaaacattcaagttttatcccctgactataggcatctacagggtcaaacagggcatgatggaccctcagtatttgaagaaagccctccggcaacgctacgggaccctgacagctgataagtggatgtctcagaaggtgaccgccattgcaaaatcgctgaaggaggtagaacagctcaaatggggaagaggtggcttatcagacactgctaggacattcctgcagaagtttgggatccggcttccatga

SEQ ID NO: 6117 - RNA, 708 nt, synthetic construct
  misc_feature 1..708: note = derived and/or modified CDS sequence (opt3) from INKV__Z68496.1__N
  source 1..708: mol_type = other RNA
atgggcgacctggtgttctacgatgaggccagcaccggggctaacggatttgaccccgatgcaggtttcgtcgcctttatggcggaccacggcgaatccatcaatctcgctgccgttagaattttctttcttaacgcagccaaggctaaagcagccctggctaggaagcctgagcggaaagccacaccaaagttcggggaatggcaagtggagatagtaaataaccattttccgggaaatcgcaacaatcccatcggcaacaatgatttgactattcaccgattatctggttatctggcgcgttgggtgctagaacatttcacggaggacgatgacgagtcacagagagaactcatcaggagtaccattatcaaccctatagcagagagcaatgggatccactggaacaatggaccagaaatttacctgtcctttttccccggcacagagatgtttcttgaggtcttcaaattttatcctctgactatcggcatttaccgggtgaagcatgggatgatggatccacagtatttgaagaaagccctccgccagagatacggaaccctgacagctgaaaagtggatggcccagaaaaccgttctgatcgcaaagtctctcaaagacgtggagcaattaaagtggggtaggggcgggctgtcggatgctgcccggactttccttataaagttcggagtcaaattgccctga

SEQ ID NO: 6118 - RNA, 708 nt, synthetic construct
  misc_feature 1..708: note = derived and/or modified CDS sequence (opt3) from INKV(KN3641)__U47137.1__N
  source 1..708: mol_type = other RNA
atgggcgacctggtgttctacgatgtcgccagcaccggggctaacggatttgaccccgatgcaggtttcgttgcctttatggcggaccacggcgagtccatcaatctcgctgccgtgagaattttctttcttaacgcagccaaggctaaagcagccctggctaggaagcctgaacggaaagccacaccaaagttcggggagtggcaggtagaaatagtgaataaccattttccgggaaatcgcaacaatcccatcggcaacaatgatttgactattcaccgattatctggttatctggcgcgttgggtcctagagcatttcacggaagacgatgacgagtcacaaagagagctcatcaggagtaccattatcaaccctatagcagaaagcaatgggatccactggaacaatggaccagagatttacctgtcctttttccccggcacagaaatgtttcttgaggtgttcaaattttatcctctgactatcggcatttaccgggttaagcatgggatgatggatccacagtatttgaagaaagccctccgccagagatacggaaccctgacagctgagaagtggatggcccagaaaaccgtgctgatcgcaaagtctctcaaagacgtcgaacaattaaagtggggtaggggcgggctgtcggatgctgcccggactttccttataaagttcggagtgaaattgccctga

SEQ ID NO: 6119 - RNA, 708 nt, synthetic construct
  misc_feature 1..708: note = derived and/or modified CDS sequence (opt3) from INKV(Lovanger)__KU302751.1__N
  source 1..708: mol_type = other RNA
atgggcgacctggtgttctacgatgtcgccagcaccggggctaacggatttgaccccgatgcaggtttcgttgcctttatggcggaccacggcgagtccatcaatctcgctgccgtgagaattttctttcttaacgcagccaaggctaaagcagccctggctaggaagcctgaacggaaagccacaccaaagttcggggagtggcaggtagaaatagtgaataaccattttccgggaaatcgcaacaatcccatcggcaacaatgatttgactattcaccgattatctggttatctggcgcgttgggtcctagagcatttcacggaagacgatgacgagtcacaaagagagctcatcaggagtaccattatcaaccctatagcagaaagcaatgggatccactggaacaatggaccagagatttacctgtcctttttccccggcacagaaatgtttcttgaggtgttcaaattttatcctctgactatcggcatttaccgggttaagcatgggatgatggatccacagtatttgaagaaagccctccgccagagatacggaaccctgacagctgagaagtggatgacccagaaaactgtgctgatcgccaagtctctcaaagacgtcgaacaattaaagtggggtaggggcgggctgtcggatgcagctcggacattccttataaagttcggagtgaaattgccctga

SEQ ID NO: 6120 - RNA, 708 nt, synthetic construct
  misc_feature 1..708: note = derived and/or modified CDS sequence (opt3) from INKV(SW AR 83-161)__U47138.1__N
  source 1..708: mol_type = other RNA
atgggcgacctggtgttctacgatgtcgccagcactggggctaacggatttgaccccgatgcaggtttcgttgcctttatggcggaccacggcgagtccatcaatctcgctgccgtgagaattttctttcttaacgcagccaaggctaaagcagccctggctaggaagcctgaacggaaagccacaccaaagttcggggagtggcaggtagaaatagtgaataaccattttccgggaaatcgcaacaatcccatcggcaacaatgatttgactattcaccgattatctggttatctggcgcgttgggtcctagagcatttcacggaagacgatgacgagtcacaaagagagctcatcaggagtaccattatcaaccctatagcagaaagcaatgggatccactggaacaatggaccagagatttacctgtcctttcttcccggcacagaaatgttcctggaggtgtttaaattctatcctttgactatcggcatttaccgggttaagcatgggatgatggatccacagtatctcaagaaagccctgcgccagagatacggaaccctgacagctgagaagtggatggcccagaaaaccgtgctcatcgcaaagtctttaaaagacgtcgaacaactgaagtggggtaggggcgggctttcggatgctgcccggacctttttgataaagttcggagtgaaactgccctga

SEQ ID NO: 6121 - RNA, 708 nt, synthetic construct
  misc_feature 1..708: note = derived and/or modified CDS sequence (opt3) from LUMV__X73468.1__N
  source 1..708: mol_type = other RNA
atgagcgacctggtgttctacgatgtcgcctccaccggcgctaacgggtttgaccccgatgcaggatatgttgacttctgcgtgaagcacggtgagtctatcaatctccattcagtaagaatatttttccttaacgccgcgaaagctaaggccgcactggccaggaaacctgaacggaaggctagtccaaaatttggcgagtggcaagtggaaattgtcaataaccacttcccggggaatcgcaacaatcccatcgataacaatgacttgacaattcatcgattaagcggatacctggcacgttgggtgctagagcagtttaaggaaaacgaggatgccgctcagagagagctcatcaagactacggttattaatcctatcgccgaatccaacggcataaggtgggacaatggtgcggagatctatctggcattctttccagggaccgaaatgttccttgagacatttaacttctaccccctgactattggaatctatcgggtgaaacacggcatgatggatcctcagtacttgaagaaagccctccgcagaaggtatggctctctgaccgctgacaagtggatgtcgcagaaaacagtcgccattgcaaagtcactgaaggatgtggagcaactcaaatgggggcggggaggtttaagcgacaccgctcgcgtatttctgcagaagttcggcatcaaacttccatga

SEQ ID NO: 6122 - RNA, 708 nt, synthetic construct
  misc_feature 1..708: note = derived and/or modified CDS sequence (opt3) from LUMV(SAAr 1881)__KX817326.1__N
  source 1..708: mol_type = other RNA
atgagcgacctggtgttctacgatgtcgcctccaccggcgctaacgggtttgaccccgatgcaggatatgttgacttctgcgtgaagcacggtgagtctatcaatctccattcagtaagaatatttttccttaacgccgcgaaagctaaggccgcactggccaggaaacctgaacggaaggctagtccaaaatttggcgagtggcaagtggaaattgtcaataaccacttcccggggaatcgcaacaatcccatcgataacaatgacttgacaattcatcgattaagcggatacctggcacgttgggtgctagagcaatttaaggaaaacgaggatgccgctcagagagagctcatcaagactacggttattaatcctatcgccgaatccaacggcataaggtgggacaatggtgcggagatctatctggcattctttccagggaccgaaatgttccttgagacatttaacttctaccccctgactattggaatctatcgggtgaaacacggcatgatggatcctcagtacttgaagaaagccctccgccagagatatggctctctgaccgctgacaagtggatgtcgcagaaaacagtcgccattgcaaagtcactgaaggatgtggagcagctcaaatgggggaggggaggtttaagcgacaccgctcgggtatttctgcagaagttcggcatcaaacttccatga

SEQ ID NO: 6123 - RNA, 708 nt, synthetic construct
  misc_feature 1..708: note = derived and/or modified CDS sequence (opt3) from MELV(TRVL 9375)__KX817329.1__N
  source 1..708: mol_type = other RNA
atgggcgacctgatcttctacgatgtggccagcaccggggctaacggatttgaccccgatgcaggttatctcgccttcacaattgcgcacggcgaggctataaatctttccgccgtcagaatctttttcctgaacgcagccaaggctaaagcagccttgtctaggaagcctgaacggaaagctactccaaagtttggggactggcaggttgagattgtgaataaccatttcccgggaaatcgcaacaatcccatcggcaacaatgatttaacgattcaccgactgtcaggttacctagcccgttgggtactcgacctgtttaaagaaaacgaggatgaaagtcaaaaggagcttatccagagcaccataatcaatcctattgcggagtccaacgggatccattgggcaaatggagtggaaatttatctgtctttctttccaggcacagagatgttcttggaagcctttagattctaccccctcactatcggcatatatagggtcaagcacgggctgatggaccctcagtacctgaaaaaggctctccggcagcgctatggaaccttaacagccgataaatggatggcacaaaagaccactatgattgctaaatcgctgaaggacgtggagcagcttaagtggggtaaaggcgggttgtcagatgccgcgagaacatttctgcagaagttcggagttaggctaccatga

SEQ ID NO: 6124 - RNA, 708 nt, synthetic construct
  misc_feature 1..708: note = derived and/or modified CDS sequence (opt3) from MBV__U31989.1__N
  source 1..708: mol_type = other RNA
atgagcgacctggtgttctacgatgtcgcctccaccggcgctaacgggtttgaccccgatgcaggatatgttgacttctgcgccaagcacggtgagtctatcaatctcgcggctgtgagaatatttttccttaacgccgcaaaagccaaggctgcactgtcaaggaaacctgaacggaaggccaatccaaaatttggcgagtggcaggtagaaattgtgaacaatcatttcccggctaaccgcaataaccccatcgggaataacgatttgacaattcaccgaatcagtggatacttagcccgttgggtcctggagcaatatagagaaaatgaggacgagagccagagggagctagtgaagactacggttattaaccctatcgcggaatccaatggcatacggtgggaaaacggtccagagatctacctcgcatttttccccgggaccgagatgtttctggaaacattcaagttttatcctcttactattggaatctaccgcgtgaaacatggcatgatggatccacagtatctgaagaaagccttgagacagaggtacggctctctcaccgctgagaagtggatgtcgcagaaaacagggatgattgccaagtcactgaaggaagtcgagcaactgaaatggggacggggtggcctcagcgacaccgcacgcactttcttacagaagtttgggatccgactgccctga

SEQ ID NO: 6125 - RNA, 708 nt, synthetic construct
  misc_feature 1..708: note = derived and/or modified CDS sequence (opt3) from SAV(VR723)__U47139.1__N
  source 1..708: mol_type = other RNA
atgagcgagctggtgttctacgacgtcgcctccaccggcgctaacgggtttgatcccgacgcaggatatctcgccttctgcgttaagcacggtgaatctatctcacttagtagcgtgagaatatttttcctgaatgcggctaaagccaaggcagccttgtccaggaaacctgagcggaaggctaacccaaaatttggcgaatggcaggtagagattgtgaataaccatttcccggggaatcgcaacaatcccatcgataacttagacctgacaattcaccgactatctggatacctcgcacgttgggtcctggaacaatttatcgagaatgaggatgaatcgcagagagagcttattaagactacggtgatcaaccctatagccgaatcaaatggcatcaagtgggagaacggtgctgagatttatctgagcttctttccagggaccgaaatgttcttggagatctttaaattctaccccctcacaattggaatctatagggttaagcagggcatgatggaccctcagtacctgaaaaaggccctgcggcaacgctatggcagtctcactgcggataaatggatgtcccagaaggtgggggcaatagccaagtctttaaaagacattgaacagctgaagtggggaaaaggtggccttagcgataccgctagaacatttttgcagaagttcgggatcaaactgccatga

SEQ ID NO: 6126 - RNA, 708 nt, synthetic construct
  misc_feature 1..708: note = derived and/or modified CDS sequence (opt3) from SDNV(BeAr 103645)__U47140.1__N
  source 1..708: mol_type = other RNA
atgggcgacctggtgttctacgatgtcgccagcaccggggctaacggatttgaccccgatgcaggtttcgttgcctttatggcgggccacggggagtccatcaatctcacagctgtgagaattttctttcttaacgccgcaaaggccaaagctgcactgtctaggaagcctgaacggaaagccactccaaagttcggagactggcaggtagagatagtgaataaccattttccgggcaatcgcaacaatcccatcggtaacaatgatttgacgattcaccgaatctcagggtatttagctcgttggaccctggaacatttcagagagggaggcgacgaagcccaaaaagagctaattaggacaactatcataaaccctatcgcggagagtaatggcattcactgggcaaacggggccgaaatctacctcagctttttcccaggaaccgagatgtttctggaggctttcaagttttatccccttacaattggtatctaccgggtcaagcatggcatgatggatgcccagtatctgaaaaaggcattgcgccagagatacgggaccctcactgctgacgaatggatggcccagaaaacagtgctgataaccaagtccctgaaagatgttgagcaactcaagtggggaaggggcggtttatctgacgcggcccggacgttcctgtcgaagttcggggtgaaacttccttga

SEQ ID NO: 6127 - RNA, 708 nt, synthetic construct
  misc_feature 1..708: note = derived and/or modified CDS sequence (opt3) from SDNV(BeAr 103645)__KX817335.1__N
  source 1..708: mol_type = other RNA
atgggcgacctggtgttctacgatgtcgccagcaccggggctaacggatttgaccccgatgcaggtttcgttgcctttatggcgggccacggggagtccatcaatctcacagctgtgagaattttctttcttaacgccgcaaaggccaaggctgcactgtctaggaagcctgaacggaaagccactccaaagttcggagactggcaggtagagatagtgaataaccattttccgggcaatcgcaacaatcccatcggtaacaatgatttgacgattcaccgaatctcagggtatttagctcgttggaccctggaacatttcagagagggagaagacgaggcccaaaaagagctaattaggacaactatcataaaccctatcgcggaaagtaatggcattcactgggcaaacggcgccgagatctacctcagctttttcccagggaccgaaatgtttctggaggctttcaagttttatccccttacaattggaatctaccgggtcaagcatggtatgatggatgcccagtatctgaaaaaggcattgcgccagagatacggcaccctcactgctgacaaatggatggcccagaagacagtgctgataaccaaatccctgaaggatgttgagcaactcaagtgggggaggggaggcttatctgacgcggcccggacgttcctgtcgaaattcggtgtgaaacttccttga

SEQ ID NO: 6128 - RNA, 708 nt, synthetic construct
  misc_feature 1..708: note = derived and/or modified CDS sequence (opt3) from SSHV__EU294510.1__N
  source 1..708: mol_type = other RNA
atgagcgacctggtgttctacgatgtcgcctccaccggcgctaacgggtttgaccccgatgcaggatatatggccttctgcgttaagtacgcggagtctgtgaatctcgctgccgtaagaatctttttccttaacgcagccaaagctaaggcagccctgtcaaggaaacctgaacggaaggctaatccaaaatttggtgagtggcaagtggaagtcgtgaacaatcacttcccgggcaaccgcaataaccccattaatagtgacgatttgacaatacatcgattaagcgggtatctggcccgttgggttctagagcagtacaaggaaaacgaggacgagtccagaagggaactcatcaagactacgattatcaatcctattgcggagtctaacggagtgcggtgggattcgggcgcagaaatctatctgtcatttttcccaggtaccgagatgtttcttgagacattcaaattttaccccctgactatagggatctatcgcgtcaagcagggaatgatggaccctcagtacttgaaaaaggccctcagacagaggtacggcagcctgaccgctgataaatggatgagtcaaaaggtgacagccattgcaaagtccctgaaagaagtagagcagctcaagtggggccgcgggggattatctgacaccgctcggagcttcctgcagaaatttggtatccgacttccatga

SEQ ID NO: 6129 - RNA, 708 nt, synthetic construct
  misc_feature 1..708: note = derived and/or modified CDS sequence (opt3) from SSHV(F10838)__KM215563.1__N
  source 1..708: mol_type = other RNA
atgagcgacctggtgttctacgatgtcgcctccaccggcgctaacgggtttgaccccgatgcaggatatatggccttctgcgttaagtacgcggagtctgtgaatctcgctgccgtaagaatctttttccttaacgcagccaaagctaaggcagccctgtcaaggaaacctgaacggaaggctaatccaaaatttggtgagtggcaagtggaagtcgtgaacaatcacttcccgggcaaccgcaataaccccattaatagtgacgatttgacaatacatcgattaagcgggtatctggcccgttgggttctagagcagtacaaggaaaacgaggacgagtccagaagggaactcatcaagactacgattatcaatcctattgcggagtctaacggagtgcggtgggattcgggcgcagaaatctatctgtcatttttcccaggtaccgagatgtttcttgagacattcaaattttaccccctgactatagggatctatcgcgtcaagcagggaatgatggaccctcagtacttgaaaaaggccctcagacagaggtacggcagcctgaccgctgataaatggatgagtcaaaaggtgacagccattgcaaagtccctgaaagaagtagagcagctcaagtggggccgcgggggattatctgacaccgctcggagcctgcttcagaaattcggtatccgattgccatga

SEQ ID NO: 6130 - RNA, 708 nt, synthetic construct
  misc_feature 1..708: note = derived and/or modified CDS sequence (opt3) from SORV(SORV-252)__GU018050.2__N
  source 1..708: mol_type = other RNA
atgggcgacctggtgttctacgatgtcgccagcaccggggctaacggatttgaccccgatgcaggtttcgttgcctttatggcggaccacggcgagtccatctctctctcagctgtgagaattttctttcttaatgccgcaaaggccaaagctgcactggccaggaagcctgaacggaaagctaacccaaagttcggggagtggcaggtagaaatagtgaataaccattttccgggaaatcgcaacaatcccatcggcaacaatgatttgacaattcaccgattaagtggttatctggcccgttgggtcctagagcatttcactgaagacgaggatgagagccaaagagaactcatcaggtccacgattatcaaccctatagcggagtctaatgggatccggtggaacaatggaccagaaatttacctgtcgtttttccccggcaccgagatgtttcttgaggcattcaaattttatcctctgacaatcggcatttaccgcgtgaagcacgggttgatggacccacagtatctcaagaaagccctgagacagaggtacggaactctgaccgctgaaaagtggatggcccagaaaacagttctcatcgcaaagtcattaaaagatgtggagcaactgaagtggggtcggggcgggcttagcgacgctgcccgcaccttcttgataaagttcggagtcaaactgccctga

SEQ ID NO: 6131 - RNA, 708 nt, synthetic construct
  misc_feature 1..708: note = derived and/or modified CDS sequence (opt3) from SORV(NJO 94F)__U47141.1__N
  source 1..708: mol_type = other RNA
atgggcgacctggtgttctacgatgtcgccagcaccggggctaacggatttgaccccgatgcaggtttcgttgcctttatggcggaccacggcgagtccatcaatctctctgctgtgagaattttctttcttaacgccgcaaaggccaaagctgcactggccaggaagcctgaacggaaagctaatccaaagttcggggagtggcaggtagaaatagtgaacaatcattttccgggaaaccgcaataaccccatcggcaataacgatttgacaattcaccgattatcaggttatctggcccgttgggtcctagagcatttcactgaagacgaggatgagagtcaaagagaactcatcaggagcacgattatcaatcctatagcggagtccaacgggatccactggaataacggaccagaaatttacctgtcgtttttccccggcaccgagatgtttcttgaggcattcaaattttatcctctgacaatcggcatttaccgggtgaagcatgggatgatggacccacagtatttgaagaaagccctccgccagagatacggaactctgaccgctgaaaagtggatggcccagaaaacagttctgatcgcaaagtctctcaaagatgtggagcaattaaagtggggtaggggcgggctgtcagacgctgcccggaccttccttataaagttcggagtcaaattgccctga

SEQ ID NO: 6132 - RNA, 708 nt, synthetic construct
  misc_feature 1..708: note = derived and/or modified CDS sequence (opt3) from SORV(NJO-94F)__KX817338.1__N
  source 1..708: mol_type = other RNA
atgggcgacctggtgttctacgatgtcgccagcaccggggctaacggatttgaccccgatgcaggtttcgttgcctttatggcggaccacggcgagtccatcaatctctctgctgtgagaattttctttcttaacgccgcaaaggccaaagctgcactggccaggaagcctgaacggaaagctaatccaaagttcggggagtggcaggtagaaatagtgaacaatcattttccgggaaaccgcaataaccccatcggcaataacgatttgacaattcaccgattatcaggttatctggcccgttgggtcctagagcatttcactgaagacgaggatgagagtcaaagagaactcatcaggagcacgattatcaatcctatagcggagtccaacgggatccactggaataacggaccagaaatttacctgtcgtttttccccggcaccgagatgtttcttgaggcattcaaattttatcctctgacaatcggcatttaccgggtgaagcatgggttgatggacccacagtatctcaagaaagccctgcgccagagatacggaactctgaccgctgaaaagtggatggcccagaaaacagttctcatcgcaaagtctttaaaagatgtggagcaactgaagtggggtaggggcgggctttcagacgctgcccggaccttcttgataaagttcggagtcaaactgccctga

SEQ ID NO: 6133 - RNA, 708 nt, synthetic construct
  misc_feature 1..708: note = derived and/or modified CDS sequence (opt3) from TAHV__Z68497.1__N
  source 1..708: mol_type = other RNA
atgagcgacctggtgttctacgatgtcgcctccaccggcgctaacgggtttgaccccgatgcaggatatgttgacttctgcatcaagcacggtgaggccattaatctccattctgtgagaatatttttccttaacgcggctaaagccaaggcagccctggctaggaaacctgaacggaaggcatcaccaaaatttggcgagtggcaggtagaagtggtcaattaccacttcccggggaaccgcaataaccccatcgataataacgacttgacaattcatcgattatatggatacctggcccgttgggtgctagagcaatttaaggaaaatgaggatgctgcccagagagagctcatcaagactacggttattaaccctatcgcggaaagtaatggcataaggtgggacaacggtgcagagatctatctggccttctttccagggaccgaaatgttccttgagacatttaatttctaccccctgactattggaatctatcgggtgaaacagggcatgatggatcctcagtacttgaagaaagctctccgccaaagatacggcagcctgaccgccgacaagtggatgtcccagaaaacaaccgcaattgctaagtctctgaaggatgtcgagcagctcaaatgggggaggggaggtttatcggacactgcccggacatttctgcagaagttcggcatccgccttccatga

SEQ ID NO: 6134 - RNA, 708 nt, synthetic construct
  misc_feature 1..708: note = derived and/or modified CDS sequence (opt3) from TAHV(22595-6)__HM036217.1__N
  source 1..708: mol_type = other RNA
atgagcgacctggtgttctacgatgtcgcctccaccggcgctaacgggtttgaccccgatgcaggatatgttgacttctgcatcaagcacggtgaggccattaatctccattctgtgagaatatttttccttaacgcggctaaagccaaggcagccctggctaggaaacctgaacggaaggcatcaccaaaatttggcgagtggcaggtagaagtggtcaataaccacttcccggggaatcgcaacaatcccatcgataacaatgacttgacaattcatcgattaagtggatacctggcccgttgggtgctagagcaatttaaggaaaacgaggatgctgcccagagagagctcatcaagactacggttattaatcctatcgcggaaagcaacggcataaggtgggacaatggtgcagagatctatctggccttctttccagggaccgaaatgttccttgagacatttaacttctaccccctgactattggaatctatcgggtgaaacagggcatgatggatcctcagtacttgaagaaagctctccgccaaagatatggctccctgaccgccgacaagtggatgtctcagaaaacaaccgcaattgctaagtcgctgaaggatgtcgagcagctcaaatgggggaggggaggtttatcagacactgcccggacatttctgcagaagttcggcatccgccttccatga

SEQ ID NO: 6135 - RNA, 708 nt, synthetic construct
  misc_feature 1..708: note = derived and/or modified CDS sequence (opt3) from TAHV(NM08003)__HQ541823.1__N
  source 1..708: mol_type = other RNA
atgagcgacctggtgttctacgatgtcgcctccaccggcgctaacgggtttgaccccgatgcaggatatgttgacttctgcatcaagcacggtgaggccattaatctccattctgtgagaatatttttccttaacgcggctaaagccaaggcagccctggctaggaaacctgaacggaaggcatcaccaaaatttggcgagtggcaggtagaagtggtcaataaccacttcccggggaatcgcaacaatcccatcgataacaatgacttgacaattcatcgattaagtggatacctggcccgttgggtgctagagcaatttaaggaaaacgatgacgctgcccagagagagctcatcaagactacggttattaatcctatcgcggagagcaacggcataaggtgggataatggtgcagaaatctatctggccttctttccagggaccgagatgttccttgaaacatttaacttctaccccctgactattggaatctatcgggtgaaacagggcatgatggaccctcagtacttgaagaaagctctccgccaaagatatggctccctgaccgccgataagtggatgtctcagaaaacaaccgcaattgctaagtcgctgaaggacgtcgagcagctcaaatgggggaggggaggtttatcagatactgcccggacatttctgcagaagttcggcatccgccttccatga

SEQ ID NO: 6136 - RNA, 708 nt, synthetic construct
  misc_feature 1..708: note = derived and/or modified CDS sequence (opt3) from TAHV(XJ0625)__EU622820.2__N
  source 1..708: mol_type = other RNA
atgagcgacctggtgttctacgatgtcgcctccaccggcgctaacgggtttgaccccgatgcaggatatgttgacttctgcgtgaagtacggtgaggccatcaatctccactctgtaagaatatttttccttaacgcggctaaagccaaggcagccctggctaggaaacctgaacggaaggcatcaccaaaatttggcgagtggcaagtggaagtcgtgaataaccatttcccggggaatcgcaacaatcccattgataacaatgacttgacaatccaccgattaagtggatatctggcccgttgggttctagagcagtttaaggaaaacgaggatgctgcccagagagagctcattaagactacggtgatcaatcctattgcggaaagcaacggcatcaggtgggacaatggtgcagagatatacctggccttctttccagggaccgaaatgttccttgagacatttaacttctatcccctgactatcggaatttaccgggtcaaacagggcatgatggatcctcagtatttgaagaaagctctccgccaaagatacggcccactgaccgccgacaagtggatgtcccagaaaacagtggcaatcgctaagtctctgaaggatgtagagcagctcaaatgggggaggggaggtttatcggacaccgcccggacttttctgcagaagttcggcattcgccttccctga

SEQ ID NO: 6137 - RNA, 708 nt, synthetic construct
  misc_feature 1..708: note = derived and/or modified CDS sequence (opt3) from TAHV(XJ0708)__HM243139.1__N
  source 1..708: mol_type = other RNA
atgagcgacctggtgttctacgatgtcgcctccaccggcgctaacgggtttgaccccgatgcaggatatgttgacttctgcgccaagtacggtgaggcgatcaatctccactctgtgagaatatttttccttaacgctgccaaagcaaaggccgctctggcaaggaaacctgaacggaaggcctcaccaaaatttggcgagtggcaggtagaagtggtcaataaccatttcccggggaatcgcaacaatcccattgataacaatgacttgacaatccaccgattaagtggatatctggctcgttgggtgctagagcaatttaaggaaaacgaggatgccgcgcagagagagctcattaagactacggttatcaatcctattgcagaaagcaacggcatcaggtgggacaatggtgccgagatatacctggctttctttccagggaccgaaatgttccttgagacatttaacttctatcccctgactatcggaatttaccgggtgaaacagggcatgatggatcctcagtatttgaagaaagccctccgccaaagatacggcccactgaccgcagacaagtggatgtcccagaaaacagtcgctatcgccaagtctctgaaggatgtggagcagctcaaatgggggaggggaggtttatcggacaccgcgcggacttttctgcagaagttcggcattcgccttccctga

SEQ ID NO: 6138 - RNA, 708 nt, synthetic construct
  misc_feature 1..708: note = derived and/or modified CDS sequence (opt3) from TVTV(AR42)__KX891323.1__N
  source 1..708: mol_type = other RNA
atgagcgagctggtgttctacgacgccccctccaccggcgctaacgggtttgatcctgacgcaggatatgtcgccttcatcgcggctcacgccggttcttacgatctctcagcagttagaatatttttccttaatgccgctaaggccaaaaacgcactgagtaggaagccagaaggcaaagtgagcattaagtttggggagtggtccgtagaagtggtcaataaccatttcccgggaaatcggaacaatcccatcggcaacaatgacttgacaattcaccgcatctctggttatttagctcgatgggtgctggaggaatttaaagggcaggatgacgaggcccaaaaggatattatccgttcgactatagttaaccctatcgcggagtcaaatggcattcattgggacagcggagcagatgcctacctaagtttctttccaggcacggaaatgttcctcgagtcctttgacttcctgccccttgctatcgggatttatagagtgaagaacggaatgatggatgtccagtacctgaaaaaggccttgaggcagcggtatggtaccatgacagcagacaaatggatgtctactaagaccacagtgatcgctaaaaccctcaagcgcgtagagagctttaagtggggcaaagggggactgtccgaagccgcgagagccttcctgtcaaagttcaatgttaaaataccttga

SEQ ID NO: 6139 - RNA, 708 nt, synthetic construct
  misc_feature 1..708: note = derived and/or modified CDS sequence (opt3) from TVTV(ND3374)__KM215564.1__N
  source 1..708: mol_type = other RNA
atgagcgagctggtgttctacgacgccccctccaccggcgctaacgggtttgatcctgacgcaggatatgtcgccttcatcgcggctcacgccggttcttacgatctctcagcagttagaatatttttccttaatgccgctaaggcaaagaacgccctgagtaggcggccagaaggcaaggtgagcattaaatttggggagtggtccgtagaagtggtcaataaccatttcccgggaaatcgcaacaatcccatcggcaacaatgacttgacaattcaccgaatctctggttatttagctcgttgggtgctggaggaatttaaggggcaggatgacgaggcccaaaaagatattatcagatcgactatagttaaccctatcgcggagtcaaatggcattcattgggacagcggagcagatgcctacctaagtttctttccaggcacggaaatgttcctcgagtcctttgacttcctgccccttgctatcgggatttatagggtgaagaacggaatgatggatgtccagtacctgaagaaagccttgcggcagcgctatggtaccatgacagcagacaagtggatgtctactaaaaccacagtgatcgctaagaccctcaaaagagtagagagctttaagtggggcaaagggggactgtccgaagccgcgagggccttcctgtcaaaattcaatgttaagataccttga

SEQ ID NO: 6140 - RNA, 708 nt, synthetic construct
  misc_feature 1..708: note = derived and/or modified CDS sequence (opt3) from JCV(3324-04)__HM007356.1__N
  source 1..708: mol_type = other RNA
atgggcgacctggtgttctacgatgtcgccagcaccggggctaacggatttgaccccgatgcaggtttcgttgcctttatggcggaccacggcgagtccgtgtctctctcagctgtaagaatcttctttcttaatgccgcaaaggccaaagctgcactggccaggaagcctgaacggaaagctacaccaaagttcggggagtggcaagtggaaattgtcaacaatcattttccgggaaaccgcaataaccccataggcaataacgatttgactatccaccgattaagtggttatctggcccgttgggtgctagagcatttcacgaccgacgatgacgaaagccagagagagctcattaggtccacaatcattaatcctatcgcggagtctaacgggatacactggaataacggaccagaaatctacctgtcgtttttccccggcactgagatgtttcttgaaattttcaaattttatcctctgaccatcggcatttaccgggttaagcatgggatgatggatccacagtatttgaagaaagcactccgccagagatacggaacactgaccgccgagaagtggatggctcagaaaactgtgctgatcgccaagtcactcaaagacgtcgagcaattaaagtggggtaggggcgggctgagcgatgcagctcggacattccttataaagttcggagtgaaattgccctga

SEQ ID NO: 6141 - RNA, 708 nt, synthetic construct
  misc_feature 1..708: note = derived and/or modified CDS sequence (opt3) from JCV(61v2235)__U12796.1__N
  source 1..708: mol_type = other RNA
atgggcgacctggtgttctacgatgtcgccagcaccggggctaacggatttgaccccgatgcaggtttcgttgcctttatggcggaccacggcgagtccatcaatctctctgctgtgagaattttctttcttaacgccgcaaaggccaaagctgcactggccaggaagcctgaacggaaagctacaccaaagttcggggagtggcaggtagaaatagtgaataaccatttttcaggaaatcgcaacaatccgatcggcaacaatgatttgactattcaccgattaagtggttatctggcccgttgggtcctagagcatttcaacagcgacgatgacgaatcccaaagagagctcatcaggtctacgattatcaatcccatagcggagtcgaacgggatccactggaataacggacctgaaatttacctgtcatttttcccaggcaccgagatgtttcttgaaatcttcaaattttatcccctgacaattggcatctaccgggtgaagcatgggatgatggatcctcagtatttgaagaaagcactccgccagagatacggaactctgaccgccgagaagtggatggctcagaaaacagttctgatagccaagagcctcaaagacgtggagcaattaaagtggggtaggggcgggctgagtgatgcagctcggaccttccttattaagttcggagtcaaattgccatga

SEQ ID NO: 6142 - RNA, 708 nt, synthetic construct
  misc_feature 1..708: note = derived and/or modified CDS sequence (opt3) from JCV(1064-03)__EF681816.1__N
  source 1..708: mol_type = other RNA
atgggcgacctggtgttctacgatgtcgccagcaccggggctaacggatttgaccccgatgcaggtttcgttgcctttatggcggaccacggcgaggctatcaatctcgccgcagtgagaattttctttcttaacgccgctaaggcaaaagccgctctggccaggaagcctgaacggaaagcgacaccaaagttcggggagtggcaggtagaaatagtgaataaccattttccgggaaatcgcaacaatcccatcggcaacaatgatttgactattcaccgattatccggttatctggcacgttgggtcctagagcatttcacggaagacgatgacgagtctcaaagagagctcatcaggtcaaccattatcaaccctatagccgaaagtaatgggatccactggaacaatggaccagagatttacctgagctttttccccggcacagaaatgtttcttgaggtgttcaaattttatcctctgactatcggcatttaccgggttaagcatgggatgatggatccacagtatttgaagaaagctctccgccagagatacggaaccctgacagccgagaagtggatggcacagaaaaccgtgctgatcgctaagtccctcaaagacgtcgaacaattaaagtggggtaggggcgggctgtctgatgccgcgcggactttccttataaagttcggagtgaaattgccctga

SEQ ID NO: 6143 - RNA, 708 nt, synthetic construct
  misc_feature 1..708: note = derived and/or modified CDS sequence (opt3) from JCV(33909)__EF681853.1__N
  source 1..708: mol_type = other RNA
atgggcgacctggtgttctacgatgtcgccagcaccggggctaacggatttgaccccgatgcaggtttcgttgcctttatggcggaccacggcgaggtgatcaatctcgctgccgtaagaattttctttcttaacgcagccaaggctaaagcagccctggctaggaagcctgaacggaaagccacaccaaagttcggggagtggcaagtggaaatagtcaataaccattttccgggaaatcgcaacaatcccatcggcaacaatgatttgactattcaccgattatccggttatctggcgcgttgggtgctagagcatttcacggaagacgatgacgagtctcagagagagctcatcaggtcaaccattatcaaccctatagcagaaagtaatgggatccactggaacaatggaccagagatttacctgagctttttccccggcacagaaatgtttcttgaggttttcaaattttatcctctgactatcggcatttaccgggtgaagcatgggatgatggatccacagtatttgaagaaagccctccgccagagatacggaaccctgacagctgagaagtggatggcccagaaaaccgtcctgatcgcaaagtccctcaaagacgtggaacaattaaagtggggtaggggcgggctgtctgatgctgcccggactttccttataaagttcggagtaaaattgccctga

SEQ ID NO: 6144 - RNA, 708 nt, synthetic construct
  misc_feature 1..708: note = derived and/or modified CDS sequence (opt3) from JCV(2179-00)__EF681808.1__N
  source 1..708: mol_type = other RNA
atgggcgacctggtgttctacgatgtcgccagcaccggggctaacggatttgaccccgatgcaggtttcgttgcctttatggcggaccacggcgagtccgtgtctctctcagctgtaagaatcttctttcttaatgccgcaaaggccaaagctgcactggccaggaagcctgaacggaaagctacaccaaagttcggggagtggcaagtggaaattgtcaacaatcattttccgggaaaccgcaataaccccataggcaataacgatttgactatccaccgattaagtggttatctggcccgttgggtgctagagcatttcacgaccgacgatgacgaaagccagagagagctcattaggtccacaatcattaatcctatcgcggagtctaacgggatacactggaataacggaccagaaatctacctgtcgtttttccccggcactgagatgtttcttgaaattttcaaattttatcctctgaccatcggcatttaccgggttaagcatgggatgatggatccacagtatttgaagaaagcactccgccagagatacggaatcctgacagccgagaagtggatggctcagaaaaccgtgctgatagccaagtcactcaaagacgtcgagcaattaaagtggggtaggggcgggctgagcgatgcagctcggactttccttattaagttcggagtgaaattgccctga

SEQ ID NO: 6145 - RNA, 708 nt, synthetic construct
  misc_feature 1..708: note = derived and/or modified CDS sequence (opt3) from JCV(2989-06)__EF681849.1__N
  source 1..708: mol_type = other RNA
atgggcgacctgatcttctacgatgtggccagcaccggggctaacggatttgaccccgatgcaggtttcgtcgcctttatggcggaccacggcgagtccgtttctctctcagctgtgagaattttctttcttaatgccgcaaaggccaaagctgcactggccaggaagcctgaacggaaagctacaccaaagttcggggagtggcaggtagaaatagtgaacaatcattttccgggaaaccgcaataaccccatcggcaataacgatttgactattcaccgattaagtggttatctggcccgttgggtcctagagcatttcacgaccgacgatgacgaaagccaaagagagctcatcaggtccacaattatcaatcctatagcggagtctaacgggatccactggaataacggaccagaaatttacctgtcgtttttccccggcactgagatgtttcttgaaatcttcaaattttatcctctgaccattggcatctaccgggtgaagcatgggatgatggatccacagtatttgaagaaagcactccgccagagatacggaacactgaccgccgagaagtggatggctcagaaaactgttctgatagccaagtcactcaaagacgtggagcaattaaagtggggtaggggcgggctgagcgatgcagctcggacattccttattaagttcggagtcaaattgccctga

SEQ ID NO: 6146 - RNA, 708 nt, synthetic construct
  misc_feature 1..708: note = derived and/or modified CDS sequence (opt3) from JCV(5592-02)__EF681804.1__N
  source 1..708: mol_type = other RNA
atgggcgacctggtgttctacgatgtcgccagcaccggggctaacggatttgaccccgatgcaggtttcgttgcctttatggcggaccacggcgagtccgtgtctctctcagctgtaagaatcttctttcttaatgccgcaaaggccaaagctgcactggccaggaagcctgaacggaaagctacaccaaagttcggggagtggcaagtggaaattgtcaacaatcattttccgggaaaccgcaatagtcccataggcaacaatgatttgactatccaccgattaagcggttatctggcccgttgggtgctagagcatttcacgaccgacgatgacgaatcccagagagagctcattaggtctacaatcattaaccctatcgcggagtcgaatgggatacactggaacaatggaccagaaatctacctgtcatttttccccggcactgagatgtttcttgaaattttcaaattttatcctctgaccatcggcatttaccgggttaagcatgggatgatggatccacagtatttgaagaaagcactccgccagagatacggaacactgaccgccgagaagtggatggctcagaaaactgtgctgatcgccaagagcctcaaagacgtcgagcaattaaagtggggtaggggcgggctgagtgatgcagctcggacattccttataaagttcggagtgaaattgccctga

SEQ ID NO: 6147 - RNA, 708 nt, synthetic construct
  misc_feature 1..708: note = derived and/or modified CDS sequence (opt3) from JCV(F5609)__KM215546.1__N
  source 1..708: mol_type = other RNA
atgggcgacctggtgttctacgatgtcgccagcaccggggctaacggatttgaccccgatgcaggtttcgttgcctttatggcggaccacggcgagtccgtgtctctctcagctgtaagaatcttctttcttaatgccgcaaaggccaaagctgcactggccaggaagcctgaacggaaagctacaccaaagttcggggagtggcaagtggaaattgtcaacaatcattttccgggaaaccgcaataaccccataggcaataacgatttgactatccaccgattaagtggttatctggcccgttgggtgctagagcatttcacgaccgacgatgacgaaagccagagagagctcattaggtccacaatcattaatcctatcgcggagtctaacgggatacactggaataacggaccagaaatctacctgtcgtttttccccggcactgagatgtttcttgaaattttcaaattttatcctctgaccatcggcatttaccgggttaagcatgggatgatggatccacagtatttgaagaaagcactccgccagagatacggaacactgaccgccgagaagtggatggctcagaaaactgtgctgatcgccaagtcactcaaagacgtcgagcaattaaagtggggtaggggcgggctgagcgatgcagctcggacattccttaccaagttcggagtgaaattgccctga

SEQ ID NO: 6148 - RNA, 708 nt, synthetic construct
  misc_feature 1..708: note = derived and/or modified CDS sequence (opt3) from JCV(F6577)__KM215557.1__N
  source 1..708: mol_type = other RNA
atgggcgacctggtgttctacgatgtcgccagcaccggggctaacggatttgaccccgatgcaggtttcgttgcctttatggcggaccacggcgagtccgtgtctctctcagctgtaagaatcttctttcttaatgccgcaaaggccaaagctgcactgagtaggaagcctgaacggaaagccacaccaaagttcggggagtggcaagtggaaattgtcaacaatcattttccgggaaaccgcaataaccccataggcaataacgatttgactatccaccgattaagcggttatctggctcgttgggtgctagagcatttcacgaccgacgatgacgaatcccagagagagctcattaggtctacaatcattaatcctatcgccgagtcgaacgggatacactggaataacggaccagaaatctacctgtcatttttccccggcactgagatgtttcttgaaattttcaaattttatcctctgaccatcggcatttaccgggttaagcatgggatgatggatccacagtatttgaagaaagcgctccgccagagatacggaacactgaccgcagagaagtggatggcccagaaaactgtgctgatcgctaagagcctcaaagacgtcgagcaattaaagtggggtaggggcgggctgagtgatgccgcacggacattccttataaagttcggagtgaaattgccctga

SEQ ID NO: 6149 - RNA, 708 nt, synthetic construct
  misc_feature 1..708: note = derived and/or modified CDS sequence (opt3) from JCV(W13135)__KM215552.1__N
  source 1..708: mol_type = other RNA
atgggcgacctggtgttctacgatgtcgccagcaccggggctaacggatttgaccccgatgcaggtttcgttgcctttatggcggaccacggcgagtccgtgaatctctctgctgtaagaatcttctttcttaacgccgcaaaggccaaagctgcactggccaggaagcctgaacggaaagctacaccaaagttcggggagtggcaagtggaaattgtcaataaccattttccgggaaatcgcaacaatcccataggcaacaatgatttgactatccaccgattatcaggttatctggcccgttgggtgctagagcatttcacgaccgacgatgacgaaagtcagagagagctcattaggagcacaatcattaaccctatcgcggagtccaatgggatacactggaacaatggaccagaaatctacctgtcgtttttccccggcactgagatgtttcttgaaattttcaaattttatcctctgaccatcggcatttaccgggttaagcatgggatgatggatccacagtatttgaagaaagcactccgccagagatacggaacactgaccgccgagaagtggatggctcagaaaactgtgctgatcgccaagtctctcaaagacgtcgagcaattaaagtggggtaggggcgggctgtcagatgcagctcggacattccttataaagttcggagtgaaattgccctga

SEQ ID NO: 6150 - RNA, 708 nt, synthetic construct
  misc_feature 1..708: note = derived and/or modified CDS sequence (opt3) from JCV(W18393)__KM215559.1__N
  source 1..708: mol_type = other RNA
atgggcgacctggtgttctacgatgtcgccagcaccggggctaacggatttgaccccgatgcaggtttcgttgcctttatggcggaccacggcgagtccatcaatctctctgctgtgagaattttctttcttaacgccgcaaaggccaaagctgcactggccaggaagcctgaacggaaagctacaccaaagttcggggagtggcaggtagaaataatcaataaccattttccgggaaatcgcaacaatcccattggcaacaatgatttgactatccaccgattatcaggttatctggcccgttgggtgctagagcatttcacggcggacgatgacgaaagtcaaagagagctcattaggagcaccatcataaaccctatcgcagagtccaatgggattcactggaacaatggaccagaaatctacctgtcgtttttccccggcacagagatgtttcttgaaattttcaaattttatcctctgactatcggcatataccgggtcaagcatgggatgatggatccacagtatttgaagaaagccctccgccagagatacggaaccctgacagctgagaagtggatggcccagaaaaccgtgctgattgcaaagtctctcaaagacgttgagcaattaaagtggggtaggggcgggctgtcagatgctgcccggactttccttatcaagttcggagtgaaattgccctga

SEQ ID NO: 6151 - RNA, 708 nt, synthetic construct
  misc_feature 1..708: note = derived and/or modified CDS sequence (opt3) from KEYV(KEYV/Ochlerotatus atlanticus/USA/KEYVLK01/2005)__KT630290.1__N
  source 1..708: mol_type = other RNA
atgggcgacctggtgttctacgatgtcgccagcaccggggctaacggatttgaccccgatgcaggttatgttgccttcatggcgaatcacggcgagtccatctctctctcaacagtgagaatatttttccttaacgctgccaaggcaaaagccgctctgactaggaagcctgaacggaaagcaacgccaaagtttggggagtggcaggtagaaattgtgaataaccatttcccgggaaatcgcaacaatcccatcggcaacaatgacttgaccttacaccgaattagtggttacctggcccgttgggtcctagagcattttggggaaggagaggatgagagccaaaaagaactcatcaagtccacagtgattaaccctatcgctgagtctaatggcataagatggggcaacggggttgaaatctatctgtcgttctttccaggaactgagatgttccttgagctgtttaagttctaccccttgaccattggtatctatagggtgaaacacggcatgatggacgcccagtacctcaagaaagcgctgcggcagcgctatgggacactgaccgcagataagtggatggcccagaaaacttcaatgattacaaagagcctcaaggacgtcgaacaattaaaatggggaaagggcggtctgagtgataccgctagagcctttcttgcaaaattcggggtgaggttgccttga

SEQ ID NO: 6152 - RNA, 708 nt, synthetic construct
  misc_feature 1..708: note = derived and/or modified CDS sequence (opt3) from KEYV(KEYV/Ochlerotatus atlanticus/USA/KEYVLK02/2005)__KT630293.1__N
  source 1..708: mol_type = other RNA
atgggcgacctggtgttctacgatgtcgccagcaccggggctaacggatttgaccccgatgcaggttatgttgccttcatggcgaatcacggcgagtccatctctctctcaacagtgagaatatttttccttaacgctgccaaggcaaaagccgctctgactaggaagagtgaacggaaagcaacgcctaagtttggggagtggcaggtagaaattgtgaataaccatttcccaggaaatcgcaacaatccgatcggcaacaatgacttgaccttacaccgaattagcggttacctggcccgttgggtcctagagcattttggggaaggagaggatgagtcccaaaaagaactcatcaagtctacagtgattaaccccatcgctgagtcgaatggcataagatggggcaacggggttgaaatctatctgtcattctttcctggaactgagatgttccttgagctgtttaagttctacccattgaccattggtatctatagggtgaaacacggcatgatggacgcccagtacctcaagaaagcgctgcggcagcgctatgggacactgaccgcagataagtggatggcccagaaaactagcatgattacaaagagtctcaaggacgtcgaacaattaaaatggggaaagggcggtctgtccgataccgctagagcctttcttgcaaaattcggggtgaggttgccctga

SEQ ID NO: 6153 - RNA, 708 nt, synthetic construct; identical to SEQ ID NO: 6151
  misc_feature 1..708: note = derived and/or modified CDS sequence (opt3) from KEYV(C14031-33)__U12801.1__N
  source 1..708: mol_type = other RNA

SEQ ID NO: 6154 - RNA, 708 nt, synthetic construct
  misc_feature 1..708: note = derived and/or modified CDS sequence (opt3) from LACV(Human/78)__NC_004110.1__N
  source 1..708: mol_type = other RNA
atgagcgacctggtgttctacgatgtcgcctccaccggcgctaacgggtttgaccccgatgcaggatatatggacttctgcgttaagaatgccgagctccttaacctggcggctgtgagaatctttttcttgaatgccgcaaaagccaaggctgcattatctaggaaacctgaacggaaggccaacccaaaatttggtgagtggcaggtagaagtgattaataaccacttcccgggcaatcgcaacaatcccatagggaacaatgatctgacaatccatcgactatcaggatacctcgctcgttgggtcctggaccaatataacgagaatgatgacgaaagtcagcacgagcttattagaactacgatcattaaccctatcgccgagagcaatggcgtgggttgggattccgggccagaaatatacctgtcgtttttccccggaaccgagatgtttttggaaacattcaagttttatcctctcactatcggcattcatagggttaagcagggcatgatggacccacagtacctgaaaaaggcgctgcggcaacgctatgggaccctcacagcagataaatggatgtctcagaaggtggccgctatcgccaaatcattaaaggacgtcgagcagctgaagtggggaaaaggtggccttagcgataccgcaaagactttcttgcagaaatttgggattagactgccctga

SEQ ID NO: 6155 - RNA, 708 nt, synthetic construct
  misc_feature 1..708: note = derived and/or modified CDS sequence (opt3) from LACV__KP271107.1__N
  source 1..708: mol_type = other RNA
atgagcgacctggtgttctacgatgtcgcctccaccggcgctaacgggtttgaccccgatacaggatatatggacttctgcgttaagaatgcagagtctctcaaccttgccgcggtgagaatctttttcctgaatgctgccaaagcaaaggccgctttgtcaaggaaacctgaacggaaggcaaacccaaaatttggtgagtggcaggtagaagtgattaataaccacttcccgggcaatcgcaacaatcccatagggaacaatgatttaactatccatcgactgagtggatacctagcccgttgggtcctcgaccaatataacgagaatgatgacgaaagccagcacgagctgattagaacgaccatcattaaccctatcgctgagtccaatggcgtgggttgggattctgggccagaaatatacctttcgtttttccccggaacagagatgtttctggaaactttcaagttttatcctttgaccatcggcattcatagggttaagcagggcatgatggacccacagtacctcaaaaaggccctgcggcaacgctatgggacactgaccgcggataaatggatgtcacagaaggtggcagccatcgctaaaagcctcaaggacgtcgagcagttaaagtggggaaaaggtggcctgagtgatactgccaagacattccttcagaaatttgggattagattgccctga

SEQ ID NO: 6156 - RNA, 708 nt, synthetic construct
  misc_feature 1..708: note = derived and/or modified CDS sequence (opt3) from LACV(BEN2_Lafayette_WI_2007)__GU596386.1__N
  source 1..708: mol_type = other RNA
atgagcgacctggtgttctacgatgtcgcctccaccggcgctaacgggtttgaccccgatgcaggatatatggacttctgcgttaagaatgccgagtctctcaaccttgcggctgtgagaatctttttcctgaatgccgcaaaagccaaggctgcattgtcaaggaaacctgaacggaaggccaacccaaaatttggtgagtggcaggtagaagtgattaataaccacttcccgggcaatcgcaacaatcccatagggaacaatgatttaacaatccatcgactgagtggatacctagctcgttgggtcctcgaccaatataacgagaatgatgacgaaagccagcacgagctgattagaactacgatcattaaccctatcgccgagtccaatggcgtgggttgggattctgggccagaaatatacctttcgtttttccccggaaccgagatgtttctggaaacattcaagttttatcctttgactatcggcattcatagggttaagcagggcatgatggacccacagtacctcaaaaaggcgctgcggcaacgctatgggaccctgacagcagataaatggatgtcacagaaggtggccgctatcgccaaaagcctcaaggacgtcgagcagttaaagtggggaaaaggtggcctgagtgataccgcaaagactttccttcagaaatttgggattagattgccctga

SEQ ID NO: 6157 - RNA, 708 nt, synthetic construct
  misc_feature 1..708: note = derived and/or modified CDS sequence (opt3) from LACV(Dallas/TX/2009)__GU591164.1__N
  source 1..708: mol_type = other RNA
atgagcgacctggtgttctacgatgtcgcctccaccggcgctaacgggtttgaccccgatgcaggatatatggacttctgcgttaagaatgccgagtctctcaaccttgcggctgtgagaatctttttcctgaatgccgcaaaagccaaggctgcattgtcaaggaaacctgaacggaaggccaacccaaaatttggtgagtggcaggtagaagtggtcaataaccacttcccgggcaatcgcaacaatcccattgggaacaatgatttaacaatacatcgactgagtggatacctagctcgttgggtgctcgaccaatataacgagaatgatgacgaaagccagagagagctgatcaggactacgattatcaaccctattgccgagtccaatggcgttcggtgggattctggtccagaaatctacctttcgtttttccccgggaccgagatgtttctggaaacattcaagttttatcctttgactataggaatccaccgcgtgaagcagggcatgatggacccacagtacctcaaaaaggcgctgagacaaaggtatggcaccctgacagcagataaatggatgtcacagaaggtcgccgctattgccaaaagcctcaaggacgtggagcagttaaagtgggggaaaggaggtctgagtgataccgcaaagactttccttcagaaatttggcatccggttgccctga

SEQ ID NO: 6158 - RNA, 708 nt, synthetic construct
  misc_feature 1..708: note = derived and/or modified CDS sequence (opt3) from LACV(Fort Bend County/TX/2009)__GU591167.1__N
  source 1..708: mol_type = other RNA
atgagcgacctggtgttctacgatgtcgcctccaccggcgctaacgggtttgaccccgatgcaggatatatggacttctgcgttaagaatgccgagtctctcaaccttgcggctgtgagaatctttttcctgaatgccgcaaaagccaaggctgcattgtcaaggaaacctgaacggaaggccaacccaaaatttggtgagtggcaggtagaagtgattaataaccacttcccgggcaatcgcaacaatcccatagggaacaatgatttaacaatccatcgactgagtggatacctagctcgttgggtcctcgaccaatataacgagaatgatgacgaaagccagagagagctgattaggactacgatcattaaccctatcgccgagtccaatggcgtgcggtgggattctggtccagaaatatacctttcgtttttccccgggaccgagatgtttctggaaacattcaagttttatcctttgactatcggcattcaccgcgttaagcagggaatgatggacccacagtacctcaaaaaggcgctgagacaaaggtatggcaccctgacagcagataaatggatgtcacagaaggtggccgctatcgccaaaagcctcaaggacgtcgagcagttaaagtgggggaaaggaggtctgagtgataccgcaaagactttccttcagaaatttggcattcggttgccctga

SEQ ID NO: 6159 - RNA, 708 nt, synthetic construct
  misc_feature 1..708: note = derived and/or modified CDS sequence (opt3) from LACV(LACV/95/OH-H (CCH-MB96))__GU206135.1__N
  source 1..708: mol_type = other RNA
atgagcgacctggtgttctacgatgtcgcctccaccggcgctaacgggtttgaccccgatgcaggatatatggacttctgcgttaagaatgccgagtctctcaaccttgcggctgtgagaatctttttcctgaatgccgcaaaagccaaggctgcattgtcaaggaaacctgaacggaaggccaacccaaaatttggtgagtggcaggtagaagtggtcaataaccacttcccgggcaatcgcaacaatcccattgggaacaatgatttaacaatacatcgactgagtggatacctagctcgttgggtgctcgaccaatataacgagaatgatgacgaaagccagcacgagctgatcaagactacgattatcaaccctattgccgagtccaatggcgttggttgggattctgggccagaaatctacctttcgtttttccccggaaccgagatgtttctggaaacattcaagttttatcctttgactataggcatccatagagtgaaacagggcatgatggacccacagtacctcaagaaagcgctgaggcaacggtatgggaccctgacagcagataagtggatgtcacagaaagtcgccgctattgccaagagcctcaaggacgtggagcagttaaaatggggaaagggtggcctgagtgataccgcaaaaactttccttcagaagtttgggatccgcttgccctga

SEQ ID NO: 6160 - RNA, 696 nt, synthetic construct
  misc_feature 1..696: note = derived and/or modified CDS sequence (opt3) from OROV(BeAn19991)__NC_005777.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcaaccgtggtagttcccctcgccgaggtgaaaggatgcacatggaatgatggcgacgctatgtatctgggtttcgccgcgggggcagaaatgtttcttcagaccttcactttctttcctctggtcatagagatgcaccgcgtgttgaaggatggaatggacgtgaacttcatgaagaaagtcctcagacaaaggtacggccagaagacagccgagcagtggatgcgggaagagatcgttgctgtgcgcgccgcatttgaagctgtaggcaccctggcctgggcgcgaacggggttctccccagccgcaagagattttctgaggcagttcggaattgacatctga

SEQ ID NO: 6161 - RNA, 696 nt, synthetic construct
  misc_feature 1..696: note = derived and/or modified CDS sequence (opt3) from OROV(AR136921)__HQ830443.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcaaccgtggtagttcccctcgccgaggtgaaaggatgcacatggaatgatggcgacgctatgtatctgggtttcgccgcgggggcagaaatgtttcttcagaccttcactttctttcctctggtcatagagatgcaccgcgtgttgaaggatggaatggacgtgaacttcatgaagaaagtcctcagacaaaggtacggccagaagacagccgagcagtggatgcgggaagagatcgttgctgtgcgcgccgcatttgaagctgtaggcaccctggcctgggcgcgaacggggttctccccagccgcaagagattttctgaggcagttcggaattggtatctga

SEQ ID NO: 6162 - RNA, 696 nt, synthetic construct
  misc_feature 1..696: note = derived and/or modified CDS sequence (opt3) from OROV(AR366927)__HQ830448.1__N
  source 1..696: mol_type = other RNA
atgagcgagttctttttcaacgacgtgccccagagaaccacatccacttttgatcctgaagccgcttacgtcgcattcgaggccaggtatggccaagttctgaatgcgggggtggtacgggtgtttttcctcaaccagaagaaagctaaggacgtccttcgcaaaacgtctcgaccaatggtggatctgacctttggaggtgttcagttcgccatggtgaataaccactttccgcagttccaatcaaatcccgtccctgacaacggcttgacattacatcgtctgagtgggtacctagcaagatgggcctttactcagatgaggagcccaatcaagcaggctgaatttcgggcaaccgtggtagttcccctcgccgaggtgaaaggatgcacatggaatgatggcgacgctatgtatctgggttttgccgcgggggcagaaatgttccttcagaccttcactttcttccctctggtcattgagatgcaccgcgtgttgaaggatggaatggacgtgaactttatgaagaaagtcctcagacaaaagtacggccagaaaacagccgagcagtggatgagggaagagatagttgctgtgcgggccgcattcgaagctgtaggcaccctggcctgggcgcgcacggggttttccccagccgcacgagatttcctgagacagtttggaatcggtatttga

SEQ ID NO: 6163 - RNA, 696 nt, synthetic construct
  misc_feature 1..696: note = derived and/or modified CDS sequence (opt3) from OROV(BeAn 206119)__AY993909.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcagccgtggtagttcccctcgtggaggtcaaaggatgcacctggaatgatggcgacgctatgtatctgggtttcgccgcgggggcagaaatgtttcttcagacattcaccttctttcctctggtgatagagatgcaccgcgtgttgaaggatggaatggacgtcaacttcatgaagaaagttctcagacaaaggtacggccagaagactgccgagcagtggatgcgggaagagatcgtggctgtacgcgccgcatttgaaacagtgggcaccttcgcttgggcccgaacggggttttccccagcggccagagatttcctgaggcagtttggaattggtatctga

SEQ ID NO: 6164 - RNA, 696 nt, synthetic construct
  misc_feature 1..696: note = derived and/or modified CDS sequence (opt3) from OROV(BeAn 208819)__AY993911.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcaaccgtggtagttcccctcgtggaggtcaaaggatgcacatggaatgatggcgacgccatgtatctgggtttcgctgccggggcggaaatgtttcttcagaccttcactttctttcctctggtgatagagatgcaccgcgtgttgaaggatggaatggacgtcaacttcatgaagaaagttctcagacaaaggtacggccagaagacagcagagcagtggatgcgggaagagatcgtggccgtacgcgctgcctttgaagcagtgggcaccctggcttgggcccgaacggggttctccccagcggccagagattttctgaggcagttcggaattggtatctga

SEQ ID NO: 6165 - RNA, 696 nt, synthetic construct
  misc_feature 1..696: note = derived and/or modified CDS sequence (opt3) from OROV(BeAn 208823)__AY993912.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcaaccgtggtagttcccctcgtggaggtcaaaggatgcacatggaatgatggcgacgccatgtatctgggtttcgctgccggggcggaaatgtttcttcagaccttcactttctttcctctggtgatagagatgcaccgcgtgttgaaggatggaatggacgtcaacttcatgaagaaagttctcagacaaaggtacggccagaagacagcagagcggtggatgcgcgaagagatcgtggccgtacgagctgcctttgaagcagtgggcaccctggcttgggccagaacggggttctccccagcggccagggattttctgcggcagttcggaattggtatctga

SEQ ID NO: 6166 - RNA, 696 nt, synthetic construct
  misc_feature 1..696: note = derived and/or modified CDS sequence (opt3) from OROV(H244576)__HQ830444.1__N
  source 1..696: mol_type = other RNA
atgagcgagttctttttcaacgacgtgccccagagaaccacatccacttttgatcctgaagccgcttacgtcgcattcgaggccaggtatggccaagttctgaatgcgggggtggtacgggtgtttttcctcaaccagaagaaagctaaggacgtccttcgcaaaacgtctcgaccaatggtggatctgacctttggaggtgttcagttcgccatggtgaataaccactttccgcagttccaatcaaatcccgtccctgacaacggcttgacatttcatcgtttaagtgggtacctggcaagatgggccttcactcagatgaggagcccaatcaagcaggctgaatttcgggcaaccgtggtagttcccctagccgaggtgaaaggatgcacatggaatgatggcgacgctatgtatctcggtttcgccgcgggggcagaaatgttcctgcagacctttactttctttcctcttgtcattgagatgcaccgcgtgctgaaggatggaatggacgtgaacttcatgaagaaagtcttgagacaaaagtacggccagaaaacagccgagcagtggatgagggaagagatagttgctgtgcgggccgcatttgaagctgtaggcaccctcgcctgggcgcgcacggggttctccccagccgcacgagattttctgagacagttcggaatcggtatttga

SEQ ID NO: 6167 - RNA, 696 nt, synthetic construct
  misc_feature 1..696: note = derived and/or modified CDS sequence (opt3) from OROV(H355186)__HQ830446.1__N
  source 1..696: mol_type = other RNA
atgagcgagttcatcttttccgacgtgccccagagaaccacatctactttcgatcctgaagccgcttacgtcgcatttgaggccaggtatggccaagttctgaacgcgggggtggtacgggtgttctttctcaatcagaagaaagctaaggacgtccttcgcaaaacgtcacgaccaatggtggatctgaccttcggaggtgttcagtttgccatggtgaacaatcacttcccgcagtttcaaagtaaccccgtccctgacaatggcttgacattacatcgtctgagcgggtacctagcaagatgggccttcactcagatgaggtccccaattaagcaggctgaatttcgggcaaccgtggtagttcccctcgccgaggtgaaaggatgcacatggaacgatggcgacgctatgtatctgggtttcgccgcgggggcagaaatgtttcttcagaccttcactttctttcctctggtcatagagatgcaccgcgtgttgaaggatggaatggacgtgaatttcatgaagaaagtcctcagacaaaggtacggccagaagacagccgagcagtggatgcgggaagagatcgttgctgtgcgcgccgcatttgaagctgtaggcaccctggcctgggcgcgaacggggttctctccagccgcaagagattttctgaggcagttcggaattggtatctga

SEQ ID NO: 6168 - RNA, 696 nt, synthetic construct
  misc_feature 1..696: note = derived and/or modified CDS sequence (opt3) from OROV(H356898)__HQ830447.1__N
  source 1..696: mol_type = other RNA
atgagcgagttcatctttaacgacgtgccccagagaaccacatccactttcgatcctgaagccgcttacgtctcttttgaggcaaggtatggccaagttctgaatgccggggtggtacgggtgttctttctcaaccagaagaaagcgaaggacgtccttcgcaaaacgtcacgaccaatggtggatctgaccttcggaggtgttcagtttgctatggtgaataaccacttcccgcagtttcaaagtaatcccgtccctgacaacggcttgacattacatcgtctgagcgggtacctagccagatgggcattcactcagatgaggtccccaattaagcaggccgaatttcgggctaccgtggtagttcccctcgcagaggtgaaaggatgcacatggaatgatggcgacgccatgtatctgggtttcgctgccggggcggaaatgtttcttcagaccttcactttctttcctctggtcatagagatgcaccgcgtgttgaaggatggaatggacgtgaacttcatgaagaaagtcctcagacaaaggtacggccagaagacagcagagcagtggatgcgggaagagatcgttgccgtgcgcgctgcctttgaagcagtaggcaccctggcttgggcccgaacggggttctctccagcggccagagattttctgaggcagttcggaattggtatctga

SEQ ID NO: 6169 - RNA, 696 nt, synthetic construct
  misc_feature 1..696: note = derived and/or modified CDS sequence (opt3) from OROV(H389865)__HQ830453.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcacatgaggagcccaattaagcaggctgaatttcgggcaaccgtggtagttcccctcgccgaggtgaaaggatgcacatggaatgatggcgacgctatgtatctgggtttcgccgcgggggcagaaatgtttcttcagaccttcactttctttcctctggtcatagagatgcatcgcgtgttgaaggatggaatggacgtgaacttcatgaagaaatttctcagacagaggtacggccaaaagacagccgagcagtggatgcgggaagagatcctggctgtcaaagccgcattcgaatccgttggcaccctggcttgggcccgcacggggttttctccagcggcccgagatttcctcagacagtttgcaattggaatctga

SEQ ID NO: 6170 - RNA, 696 nt, synthetic construct
  misc_feature 1..696: note = derived and/or modified CDS sequence (opt3) from OROV(H472433)__HQ830455.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttctcaggagttcagtttgccatggtgaataaccacttcccgcagtttcaaagtaatcccgtccctgacaacggtttgacattacatcgtctgagcggctacctagcaagatgggccttcactcagatgaggtccccaattaagcaggctgaatttcgggcaaccgtggtagttcccctcgccgaggtgaaagggtgcacatggaatgatggagacgctatgtatctgggcttcgccgcgggtgcagaaatgtttcttcagaccttcactttctttcctctggtcatagagatgcaccgcgtgttgaaggatgggatggacgtgaacttcatgaagaaagtcctcagacaaaggtacggacagaagacagccgagcagtggatgcgggaagagatcgttgctgtgcgcgccgcatttgaagctgtaggcaccctggcctgggcgcgaacgggcttctctccagccgcaagagattttctgaggcagttcgggattggaatctga

SEQ ID NO: 6171 - RNA, 696 nt, synthetic construct
  misc_feature 1..696: note = derived and/or modified CDS sequence (opt3) from OROV(H532490)__HQ830463.1__N
  source 1..696: mol_type = other RNA
atgagcgagttcatctttaacgacgtgccccagagaaccacatccactttcgatcctgaagccgcttacgtctcttttgaggcaaggtatggccaagttctgaatgccggggtggtacgggtgttctttctcaaccagaagaaagcgaaggacgtccttcgcaaaacgtcaagtccaatggtggatctgaccttcggaggtgttcagtttgctatggtgaataaccacttcccgcagtttcaaagcaatcccgtccctgacaacggcttgacattacatcgactgtccgggtacctagcccgttgggcattcactcagatgagatctccaattaagcaggccgaatttagggctaccgtggtagttcccctcgcagaggtgaaaggatgcacatggaatgatggcgacgccatgtatctgggtttcgctgccggggcggaaatgtttcttcagaccttcactttctttcctctggtcatagagatgcaccgggtgttgaaggatggaatggacgtgaacttcatgaagaaagtcctccgccaaagatacggccagaagacagcagagcagtggatgagggaagagatcgttgccgtgcgggctgcctttgaagcagtaggcaccctggcttgggcccgcacggggttctcgccagcggcccgagattttctgagacagttcggaattggtatctga

SEQ ID NO: 6172 - RNA, 696 nt, synthetic construct
  misc_feature 1..696: note = derived and/or modified CDS sequence (opt3) from OROV(H543629)__HQ830467.1__N
  source 1..696: mol_type = other RNA
atgagcgagttcctgtttaacgacgtgccccagagaaccacatccactttcgatcctgaagccgcttacgtcgcatttgaggccaggtatggccaagttctcaatgcgggggtggtacgggtgttctttcttaaccagaagaaagctaaggacgtcctgcgcaaaacgtctcgaccaatggtggatttgaccttcggaggtgttcagtttgccatggtgaataaccacttcccgcagtttcaatcaaatcccgtccctgacaacggcttaacactgcatcgtctaagtgggtacctcgcaagatgggccttcactcagatgaggagcccaatcaagcaggctgaatttcgggcaaccgtggtagttcccctggccgaggtgaaaggatgcacatggaatgatggcgacgctatgtatcttggtttcgccgcgggggcagaaatgtttctgcagaccttcactttctttcctttggtcattgagatgcaccgcgtgctcaaggatggaatggacgtgaacttcatgaagaaagtcctgagacaaaggtacggccagaagacagccgagcagtggatgcgggaagagatagttgctgtgcgcgccgcatttgaagctgtaggcaccctggcctgggcgcgaacggggttctccccagccggaagagattttctcaggcagttcggtatcggcatttga

SEQ ID NO: 6173 - RNA, 696 nt, synthetic construct
  misc_feature 1..696: note = derived and/or modified CDS sequence (opt3) from OROV(H543638)__HQ830468.1__N
  source 1..696: mol_type = other RNA
atgagcgagttcctgtttaacgacgtgccccagagaaccacatccactttcgatcctgaagccgcttacgtcgcatttgaggccaggtatggccaagttctcaatgcgggggtggtacgggtgttctttcttaaccagaagaaagctaagaatgtcctgcgcaaaacgtctcgaccaatggtggacttgaccttcggaggtgttcagtttgccatggtgaacaatcacttcccgcagtttcaatcaaaccccgtccctgataatggcttaacactgcatcgtctaagtgggtacctcgcaagatgggccttcactcagatgaggagcccaatcaagcaggctgaatttcgggcaaccgtggtagttcccctggccgaggtgaaaggatgcacatggaacgacggcgatgctatgtatcttggtttcgccgcgggggcagaaatgtttctgcagaccttcactttctttcctttggtcattgagatgcaccgcgtgctcaaggacggaatggatgtgaatttcatgaagaaagtcctgagacaaaggtacggccagaagacagccgagcagtggatgcgggaagagatagttgctgtgcgcgccgcatttgaagctgtaggcaccctggcctgggcgcgaacggggttctccccagccggaagagactttctcaggcagttcggtatcggcatttga

SEQ ID NO: 6174 - RNA, 696 nt, synthetic construct
  misc_feature 1..696: note = derived and/or modified CDS sequence (opt3) from OROV(H706890)__HQ830473.1__N
  source 1..696: mol_type = other RNA
atggccgagttcatctttaacgacgtgccccagagaaccacaagcactttcgatcctgaagctgcatacgtcgcctttgaggcgaggtatggccaagttctgaatgctggggtggtacgggtgttctttctcaaccagaagaaagccaaggacgtccttcgcaaaacgtcccgaccaatggtggatctgaccttcggaggtgttcagtttgcaatggtgaataaccacttcccgcagtttcaatctaatcccgtccctgacaacggcttgacattacatcgtctgtcagggtacctagccagatgggctttcactcagatgaggagtccaattaagcaggcagaatttcgggccaccgtggtagttcccctcgctgaggtgaaaggatgcacatggaatgatggcgacgccatgtatctgggtttcgcggcaggggccgaaatgtttcttcagaccttcactttctttcctctggtcatagagatgcaccgcgtgttgaaggatggaatggacgtgaacttcatgaagaaagtcctcagacaaaggtacggccagaagacagctgagcagtggatgcgggaagagatcgttgccgtgcgcgcagcttttgaagccgtaggcaccctggcgtgggcccgaacggggttcagcccagcagctagagattttctgaggcagttcggaattggtatctga

SEQ ID NO: 6175 - RNA, 696 nt, synthetic construct
  misc_feature 1..696: note = derived and/or modified CDS sequence (opt3) from OROV(H758669)__HQ830479.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccattttgaataaccacttcccgcagtttcaatcaaatcccgtgcctgacaacggcttaacactgcatcgtctaagtgggtacctcgcaagatgggccttcactcagatgaggagcccaataaagcaggctgaatttcgggcaaccgtcgtggtacccctggccgaggttaaaggatgcacatggaatgatggcgacgctatgtatcttggtttcgccgcgggggcagaaatgtttctgcagaccttcactttctttcctttggtgatcgagatgcaccgcgtcctcaaggatggaatggacgtgaacttcatgaagaaagtgctgagacaaaggtacggccagaagacagccgagcagtggatgcgggaagagattgtcgctgttcgcgccgcatttgaagctgtgggcaccctggcctgggcgcgaacggggttctccccagccgcaagagattttctcaggcagttcggaatcggtatttga

SEQ ID NO: 6176 - RNA, 696 nt, synthetic construct
  misc_feature 1..696: note = derived and/or modified CDS sequence (opt3) from OROV(H758687)__HQ830478.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcaaccgtggtagttcccctcgccgaggtgaaaggatgcacatggaatgatggcgacgctatgtatctgggtttcgccgcgggggcagaaatgtttcttcagaccttcactttctttcctttcgtcatagagatgcaccgcgtgctgaaggatggaatggacgtgaactttatgaagaaagtcttgagacaaaggtacggccagaagacagccgagcagtggatgcgggaagagatcgttgctgtgcgcgccgcattcgaagctgtaggcaccctcgcctgggcgcgaacggggttttccccagccgcaagagatttcctgaggcagtttggaattggtatctga

SEQ ID NO: 6177 - RNA, 696 nt, synthetic construct
  misc_feature 1..696: note = derived and/or modified CDS sequence (opt3) from OROV(H759041)__HQ830488.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcaaccgtggtagttcccctcgccgaggtgaaaggatgcacatggaatgatggcgacgctatgtatctgggtttcgccgcgggggcagaaatgtttcttcagaccttcactttctttcctctggtcatagagatgcaccgcgtgttgaacgatggaatggacgtgaatttcatgaagaaggtcctcagacaaaggtacggccagaaaacagccgagcagtggatgcgggaagagatcgttgctgtgcgcgccgcatttgaagctgtaggcaccctggcctgggcgcgaacggggttctccccagccgcaagagattttctgaggcagttcggaattggtatctga

SEQ ID NO: 6178 - RNA, 696 nt, synthetic construct
  misc_feature 1..696: note = derived and/or modified CDS sequence (opt3) from OROV(BeAr473358)__AF164539.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcacatgaggagcccaattaagcaggctgaatttcgggcaaccgtggtagttcccctcgccgaggtgaaaggatgcacatggaatgatggcgacgctatgtatctgggtttcgccgcgggggcagaaatgtttcttcagaccttcactttctttcctctggtcatagagatgcatcgcgtgttgaaggatggaatggacgtgaacttcatgaagaaaatcctcagacagaggtacggccaaaagacagccgagcagtggatgcgggaagagattatcgctgtcaaaaccgcctttgaaacggttggcactctggcatgggctattaccgggttctccccagccgcgcgcaattttctgcgacagttcgagatcgatatatga

SEQ ID NO: 6179 - RNA, 696 nt, synthetic construct
  misc_feature 1..696: note = derived and/or modified CDS sequence (opt3) from OROV(BeH 521086)__AY704559.1__N
  source 1..696: mol_type = other RNA
atgagcgagttcctgtttaacgacgtgccccagagaaccacatccactttcgatcctgaagccgcttacgtcgcatttgagtctaggtatggccaagttctcaatgccggggtggtacgggtgttctttcttaaccagaagaaagcgaaggacgtcctgcgcaaaacgtcacgaccaatggtggatttgaccttcggaggtgttcagtttacaatggtgaataaccacttcccgcagtttcaaagtaatcccgtccctgacaacggcttaactctgcatcgtctaagcgggtacctcgctagatgggccttcacccagatgaggtccccaatcaagcaggcagaatttcgggccacagtggtagttcccctggctgaggtgaaaggatgcacctggaatgatggcgacgcaatgtatcttggtttcgccgctggggccgaaatgtttctgcagactttcacattctttcctttggtcattgagatgcaccgcgtgctcaaggatggaatggacgtgaacttcatgaagaaagtcctgagacaaaggtacggccagaagaccgcggagcagtggatgcgggaagagatagttgcagtgcgcgccgcttttgaagccgtaggcacgctggcatgggctcgaactgggttctctccagccgcgagagattttctcaggcagtcgggaatcggtatttga

SEQ ID NO: 6180 - RNA, 696 nt, synthetic construct
  misc_feature 1..696: note = derived and/or modified CDS sequence (opt3) from OROV(BeH121923)__HM470110.1__N
  source 1..696: mol_type = other RNA
atgagcgagttcatctttaacgacgtgccccagagaaccacatcctctttcgatcctgaagccgcttacgtcgcatttgaggccaggtatggccaagttctgaatgcgtgcgtggtacgggtgttctttctcaaccagaagaaagctaaggacgtccttcgcaaaacttcatggccaatggtggatctgacgttcgggcgagttcagtttgccatggtgaataaccacttcccgcagtttcaaagtaatcccgtccctgacaacggattggcattacatcgtctgagcggttacctagccagatgggctttcacccagatgaggtccccaattaagcaggcagaatttcgggccacagtggtagttcccctcgctgaggtgaaaggctgtacttggaatgatggggacgccatgtatctgggattcgcggcaggcgccgaaatgtttcttcagaccttcacattctttcctctggtcatagagatgcaccgcgtgttgaaggatggtatggacgtgaacttcatgaagaaagtcctcagacaaaggtacgggcagaagaccgctgagcagtggatgcgggaagagatcgttgccgtgcgcgcagcttttgaagccgtaggaactctggcgtgggcccgaacaggcttctctccagcagctagagattttctgaggcagttcggcattgacatctga

SEQ ID NO: 6181 - RNA, 696 nt, synthetic construct
  misc_feature 1..696: note = derived and/or modified CDS sequence (opt3) from OROV(BeH379693)__AF164534.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgccgaacgtctcgtccaatggtggatctgaccttcggaggtgttcagtttgccatggtgaataaccacttcccgcagtttcaatcaaatcccgtccctgacaacggcttgacattacatagactgagtgggtacctagcaaggtgggccttcactcagatgcggagcccaattaaacaggctgaatttcgcgcaaccgtggtagttcccctcgccgaggtgaagggatgcacatggaatgatggcgacgctatgtatctgggtttcgccgcgggggcagaaatgtttcttcagaccttcactttctttcctctggtcatagagatgcacagagtgttgaaagatggaatggacgtgaacttcatgaagaaggtcctcaggcaacggtacggccagaaaacagccgagcagtggatgcgcgaagagatcgttgctgtgcgagccgcatttgaagctgtaggcaccctggcctgggcgagaacggggttctccccagccgcaagggattttctgcggcagttcggaattggtatctga

SEQ ID NO: 6182 - RNA, 696 nt, synthetic construct
  misc_feature 1..696: note = derived and/or modified CDS sequence (opt3) from OROV(BeH381114)__AF164535.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcaaccgtggtagttcccctcgccgaggtgaaaggatgcacatggaatgatggcgacgctatgtatctgggtttcgccgcgggggcagaaatgtttcttcagaccttcactttctttcctctggtcatagagatgcaccgcgtgttgaaggatggaatggacgtgaacttcatgaagaaagtcctcagacaaaggtacggccagaagacagccgagcagtggatgcgggaagagatcgttgctgtgcgcgccgcatttgaagctgtaggcaccctggcctgggcgcgaacggggttctccccagccgcaagagattttctgaggcagttcggaatttgtatctga

SEQ ID NO: 6183 - RNA, 696 nt, synthetic construct
  misc_feature 1..696: note = derived and/or modified CDS sequence (opt3) from OROV(BeH390233)__AF164536.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcaaccgtggtagttcccctcgccgaggtgaaaggatgcacatggaatgatggcgacgctatgtatctgggtttcgccgcgggggcagaaatgtttcttcagaccttcactttctttcctctggtcatagagatgcaccgcgtgttgaaggatggaatggacgtgaacttcatgaagaaagtcctcagacaaaggtacggccagaagacagccgagcagtggatgcgggaagagatcgttgctgtgcgcgccgcatttgaagctgtaggcaccctggcctgggcgcgaacggggttctccccagccgcaagagattttctgggacagttcggtattggcatctga

SEQ ID NO: 6184 - RNA, 696 nt, synthetic construct
  misc_feature 1..696: note = derived and/or modified CDS sequence (opt3) from OROV(BeH472204)__AF164538.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcaaccgtggtagttcccctcgccgaggtgaaaggatgcacatggaatgatggcgacgctatgtatctgggtttcgccgcgggggcagaaatgtttcttcagaccttcactttctttcctctggtcatagagatgcaccgcgtgttgaaggatggaatggacgtgaacttcatgaagaaagtcctcagacaaaggtacgttcagaagacagccgagcagtggatgcgggaagagatcgtggctgtacgcgccgcatttgaagctgtgggcaccctggcctgggcgcgaacgggcttctccccagccgcaagagattttctgaggcagttcgggattggaatctga

SEQ ID NO: 6185 - RNA, 696 nt, synthetic construct
  misc_feature 1..696: note = derived and/or modified CDS sequence (opt3) from OROV(BeH505442)__AF164542.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcaaccgtggtagttcccctcgccgaggtgaaaggatgcacatggaatgatggcgacgctatgtatctgggtttcgccgcgggggcagaaatgtttcttcaggccttcaccttctttcctctggtcatagagatgcaccgcgtgttgaaggatggaatggacgtgaacttcatgaagaaagtcctcagacaaaggtacggccagaagactgctgagcagtggatgcgggaagagatcgttgccgtgcgcgcagcttttgaagccgtaggcacactggcgtgggcccgaaccgggttctccccagcagctagagattttctgaggcagttcggaattgacatctga

SEQ ID NO: 6186 - RNA, 696 nt, synthetic construct
  misc_feature 1..696: note = derived and/or modified CDS sequence (opt3) from OROV(BeH541863)__AF164544.1__N
  source 1..696: mol_type = other RNA
atgagcgagttcatcttttccgacgtgccccagagaaccacatctactttcgatcctgaagccgcttacgtcgcatttgaggccaggtatggccaagttctgaacgcgggggtggtacgggtgttctttctcaatcagaagaaagctaaggacgtccttcgcaaaacgtcacgaccaatggtggatctgaccttcggaggtgttcagtttgccatggtgaacaatcacttcccgcagtttcaaagtaaccccgtccctgacaatggcttgacattacatcgtctgagcgggtacctagcaagatgggccttcactcagatgaggtccccaattaagcaggctgaatttcgggcaaccgtggtagttcccctcgccgaggtgaaaggatgcacatggaacgatggcgacgctatgtatctgggtttcgccgcgggggcagaaatgtttcttcagaccttcactttctttcctctggtcatagagatgcaccgcgtgttgaaggatggaatggacgtgaatttcatgaagaaagtcctcagacaaaggtacggccagaagacagccgagcagtggatgcgggaagagatcgttgctgtgcgcgccgcatttgaagctgtaggcaccctggcctgggcgcgaacggggttctctccagccgcaagaaactttctgaggcagttcggaattggtatctga

SEQ ID NO: 6187 - RNA, 696 nt, synthetic construct
  misc_feature 1..696: note = derived and/or modified CDS sequence (opt3) from OROV(BeH543033)__AF164545.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcaaccgtggtagttcccctcgccgaggtgaaaggatgcacatggaatgatggcgacgctatgtatctgggtttcgccgcgggggcagaaatgtttcttcagaccttcactttctttcctctggtcatagagatgcaccgcgtgttgaaggatggaatggacgtgaacttcatgaagaaagtcctcagacaaaggtacggccagaagacagccgagcagtggatgcgggaagagatcgttgctgtgcgcgccgcatttgaagctgtaggcaccctggcctgggcgcgaacggggttctccccagccgcaagagagtttctgaggcagttcggaattggtatctga

SEQ ID NO: 6188 - RNA, 696 nt, synthetic construct
  misc_feature 1..696: note = derived and/or modified CDS sequence (opt3) from OROV(BeH543618)__AF164548.1__N
  source 1..696: mol_type = other RNA
atgcaggagttcatctttaacgacgtgccccaaagaaccacaagcactttcgatcctgaagccgcttacgtcgcatttgaggccaggtatggccaggttctgaatgcgggggtggtacgggtgttctttctcaaccagaagaaagctaaggacgtccttcgcaaaacgtcccgaccaatggtggatctgaccttcggaggtgttcagtttgccatggtgaataaccacttcccgcaatttcagtctaatcccgtccctgacaacggcttgacattacatcgtctgtcagggtacctagcaagatgggccttcactcagatgaggagtccaattaagcaggctgaatttcgggcaaccgtggtagttcccctcgccgaggtgaaaggatgcacatggaatgatggcgacgctatgtatctgggtttcgccgcgggggcagaaatgtttcttcaaaccttcactttctttcctctggtcatagagatgcaccgcgtgttgaaggatggaatggacgtgaacttcatgaagaaagtcctcagacagaggtacggccagaagacagccgagcagtggatgcgggaagagatcgttgctgtgcgcgccgcatttgaagctgtaggcaccctggcctgggcgcgaacggggttcagcccagccgcaagagattttctgaggcaattcggaattggtatctga

SEQ ID NO: 6189 - RNA, 696 nt, synthetic construct
  misc_feature 1..696: note = derived and/or modified CDS sequence (opt3) from OROV(BeH544552)__AF164546.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcaaccgtggtagttcccctcgccgaggtgaaaggatgcacatggaatgatggcgacgctatgtatctgggtttcgccgcgggggcagaaatgtttcttcagaccttcactttctttcctctggtcatagagatgcaccgcgtgttgaaggatggaatggacgtgaacttcatgaagaaagtcctcagacaaaggtacggccagaagacagccgagcagtggatgcgggaagagatcgttgctgtgcgcgccgcatttgaagctgtaggcaccctggcctgggcgcgaacggggttctccccagccgcaagagattttctgaggcagattggaatcggtatttga

SEQ ID NO: 6190 - RNA, 696 nt, synthetic construct
  misc_feature 1..696: note = derived and/or modified CDS sequence (opt3) from OROV(GML444911)__AF164556.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcaaccgtggtagttcccctcgccgaggtgaaaggatgcacatggaatgatggcgacgctatgtatctgggtttcgccgcgggggcagaaatgtttcttcagaccttcactttctttcctctggtcatagagatgcaccgcgtgttgaaggatggaatggacgtgaacttcatgaagaaagtcctcagacaaaggtacggccagaagacagccgagcagtggatgcgggaagagatcgttgctgtgcgcgccgcatttgaagctgtaggcaccctggcctgggcgcgaacggggttctccccagccgcaagagattttctgaggcagttcggaatttatatctga

SEQ ID NO: 6191 - RNA, 696 nt, synthetic construct
  misc_feature 1..696: note = derived and/or modified CDS sequence (opt3) from OROV(IQT4083)__AF164552.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcaaccgtggtagttcccctcgccgaggtgaaaggatgcacatggaatgatggcgacgctatgtatctgggtttcgccgcgggggcagaaatgtttcttcagaccttcactttctttcctctggtcatagagatgcaccgcgtgttgaaggatggaatggacgtgaacttcatgaagaaagtcctcagacaaaggtacggcaagaaaacagccgagcagtggatgcgggaagagatcgttgctgtgcgcgccgcatttgaagctgtaggcaccctggcctgggcgcgaacggggttctccccagccgcaagagattttctgaggcagttcggaattgacatctga

SEQ ID NO: 6192 - RNA, 696 nt, synthetic construct
  misc_feature 1..696: note = derived and/or modified CDS sequence (opt3) from OROV(PPS 522 H 669314)__EF467370.1__N
  source 1..696: mol_type = other RNA
atgagcgagttcatctccaacgacgtgccccacagaaccacatctacttttgatcctgaagccgcttacgtcgcattcgaggccaggtatggccaggttctgaatgcgggggtggtacgggtgtttttcctcaaccaaaagaaagctaaggacgtccttcgcaaaacgtcacgaccaatggtggatctgacctttggaggtgttcagttcgccatggtgaataaccattttccgcagttccagagtaatcccgtccctgacaacggcttgacattacaccgtctgagcgggtacctagcaagatgggcctttactcaaatgaggtccccaattaagcaggctgagttccgggcaaccgtggtagttcccctcgccgaagtgaaaggatgcacatggaatgatggcgacgctatgtatctgggttttgccgcgggggcagaaatgttccttcagacctttactttcttccctctggtcatagagatgcatcgcgtgttgaaggatggaatggacgtgaactttatgaagaaagtcctcagacagaggtacggccaaaagacagccgagcagtggatgcgggaagagatcgttgctgtgcgcgccgcattcgaagctgtaggcaccctggcctgggcgcgaacggggttttctccagccgcaagagatttcctgaggcagtttggaatttgtatctga

SEQ ID NO: 6193 - RNA, 696 nt, synthetic construct
  misc_feature 1..696: note = derived and/or modified CDS sequence (opt3) from OROV(TVP-19254/GML-480914)__KP795083.1__N
  source 1..696: mol_type = other RNA
atgagcgagttcatctttaacgacgtgccccagagaaccacatccactttcgatcctgaagccgcttacgtcgcatttgaggccaggtatggccaagttctgtctgcgggggtggtacgggtgttctttctcaatcagaagaaagctaaggacgtccttcgcaaaacgtcacgaccaatggtggatctgaccttcggaggtgttcagtttgccatggtgaacaatcacttcccgcagtttcaaagtaaccccgtccctgacaatggcttgacattacatcgtctgagcgggtacctagcaagatgggccttcactcagatgaggtccccaattaagcaggctgaatttcgggcaaccgtggtagttcccctcgccgaggtgaaaggatgcacatggaacgatggcgacgctatgtatctgggtttcgccgcgggggcagaaatgtttcttcagaccttcactttctttcctctggtcatagagatgcaccgcgtgttgaaggatggaatggacgtgaatttcatgaagaaagtcctcagacaaaggtacggccagaagacagccgagcagtggatgcgggaagagatcgttgctgtgcgcgccgcatttgaagctgtaggcaccctggcctgggcgcgaacggggttctctccagccgcaagagattttctgaggcagttcggaattgacatctga

SEQ ID NO: 6194 - RNA, 696 nt, synthetic construct
  misc_feature 1..696: note = derived and/or modified CDS sequence (opt3) from OROV(TVP-19256/IQE-7894)__KP795086.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttacaatggtgaataaccacttcccgcagtttcaatcaaatcccgtccctgacaacggcttgactttacatcgtctgagtgggtacctagccagatgggcattcacccagatgaggagcccaattaagcaggccgaatttcgggctacagtggtagttcccctcgcagaggtgaaaggatgcacctggaatgatggcgacgccatgtatctgggtttcgctgccggggcggaaatgtttcttcagactttcacattctttcctctggtcatagagatgcaccgcgtgttgaaggatggaatggacgtgaacttcatgaagaaagtcctcagacaaaggtacggccagaagaccgcagagcagtggatgcgggaagagatcgttgccgtgcgcgctgcctttgaagcagtaggcacgctggcttgggcccgaactgggttctccccagcggccagagattttctgaggcagttcggaattgacatctga

SEQ ID NO: 6195 - RNA, 696 nt, synthetic construct
  misc_feature 1..696: note = derived and/or modified CDS sequence (opt3) from OROV(TVP-19258/IQT-4083)__KP795092.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcggggaaccgtggtagttcccctcgcagaggtgaaaggctgcacatggaatgatggtgacgccatgtatctggggttcgctgccggagcggaaatgtttcttcagaccttcactttctttcctctggtcatagagatgcaccgcgtgttgaaggatggcatggacgtgaacttcatgaagaaagtcctcagacaaaggtacggccagaagacagcagagcagtggatgcgggaagagatcgttgccgtgcgcgctgcctttgaagcagtagggaccctggcttgggcccgaacgggattctccccagcggccagagattttctgaggcagttcggtattgacatctga

SEQ ID NO: 6196 - RNA, 699 nt, synthetic construct
  misc_feature 1..699: note = derived and/or modified CDS sequence (opt3) from OROV/FPV(Aus Ch 16129)__AF362400.1__N
  source 1..699: mol_type = other RNA
atgaccgacttcgtgtttaacgatgtcccccagagagccacaagcactttcgaccctgaggctgcatacgttgcctttgaaaataggttccgggcgaacctgacggtggatgtagctcgcatctttttcctcaatcaaaagaaagccaaggaccgacttgcaaaaaccgcccgtgctacagtggatattacttttggcggggtcgtgttcccagttgtgaacaatcactatccggagtaccagagaaaccccgtccctgacgatggactgaccttgcataggttatccggttatctggcacggtggctaatagaccagtgcaatgcctctccagtgcgcatgacagaaatcagaaccaaggtaattatccccctcgctgaggttaaaggctgtacttggaacgatggggcctcaatgtacctgggatttgcggcaggcgccgaaatgttccttcagagttttacattctatcctctggtgattgagatgcaaagggtcttgaaggacggtatggatgtgaattttatgcggaaggtgctccgccagcgatacgggaccaaaacggctgagcagtggatgagagacgatatcgtcgccgttaagactgcattcgaagctataaacaccatcagctgggccaggtccggattctctccagcggcccgggagtttctgcgtcagttcggcattaatatctga

SEQ ID NO: 6197 - RNA, 696 nt, synthetic construct
  misc_feature 1..696: note = derived and/or modified CDS sequence (opt3) from OROV/IQTV(IQE3728/PER/06)__KF150535.1__N
  source 1..696: mol_type = other RNA
atgagcgagttcatctttaacgacgtgccccagagaaccacatccactttcgatcctgaagccgcttacgtcgcatttgaggccaggtatggccaagttctgaatgcgggggtggtacgggtgttctttctcaaccagaagaaagctaaggacgtccttcgcaaaacgtctcgaccaatggtggatctgaccttcggaggtgttcagtttgccatggtgaataaccacttcccgcagtttcaatcaaatcccgtccctgacaacggcttgacattacatcgtctgagtgggtacctagcaagatgggccttcactcagatgaggagcccaattaagcaggctgaatttcgggcaaccgtggtagttcccctcgccgaggtgaaaggatgcacatggaatgatggcgacgctatgtatctgggtttcgccgcggggaccgaaatgtttcttcagactttcacattctttcctctggtcatagagatgcaccgcgtgttgaaggatggaatggacgtgaacttcatgaagaaagtcctcagacaaaggtacggccagaagaccgcagagcagtggatgcgggaagagatcgttgccgtgcgcgctgcctttgaagcagtaggcacgctggcttgggcccgaactgggttctccccagcggccagagattttctgaggcagttcggaattggtatctga

SEQ ID NO: 6198 - RNA, 699 nt, synthetic construct
  misc_feature 1..699: note = derived and/or modified CDS sequence (opt3) from OROV/UTIV(Be An 84785)__KF697156.1__N
  source 1..699: mol_type = other RNA
atggccgagttcgtgtttaacgacgtcccccagagaagcacctccacattcgatcctgaagttgcttacgcaacttttgaggccgcgttcaggcaaacgctgaatgtgaacgtagtgcgggtctttttcctcaatcagaagaacgctaaaaatgtgcttcgcaagacctctcgaccaaacgttgacctgacatttggcggggccactttcccgatcgtgaataaccactttccccagttccagtcaaatcctgtcccagataacggattgaccttacatcgtctgagtggttatctagcaagatggagcatggaccaaatgaggacaaatcccattcggcaggccgaatttcgcgctgcagtggtagttcctctcgccgagataaaaggctgcacctggaacgatggggacgctatgtacctggccttcgcggcaggagccgaaatgtttcttaatactttcacattctttccactggtgatcgagatgcacagagtcttgaaggatggcatggacgtgaacttcatgaggaaagtgctccggcagcgctatggtaccaagacggctgagcagtggatgaaggatgaaattatccccattaaagccgcatttgaggctgtcgggatgctgtcctgggcccgaactggattctctcctgcggccagagactttctgaggcaattcggcatcaatgtttga

SEQ ID NO: 6199 - RNA, 738 nt, synthetic construct
  misc_feature 1..738: note = derived and/or modified CDS sequence (opt3) from HRTV(TN)__KJ740146.1__N
  source 1..738: mol_type = other RNA
atgaccgactggagcgccatcgctgtggagattggcaacgaacccctggatgtccctgcactcgttgagttcgccaaggaaatagcgtacgaggggcttgacccagctgtgatcctgggattgttaagagaaaggggtggcgagaattggcggaacgatgtaaaatatattatcgtgtttgccctgacacgcgggaataagattgtcaaagcatgcggaaagatgtccaaaaagggcgccgagcgaatgactaacctagctcgtgtgtacgaactcaaggagaatgcagttgacagaatggccgtgacgccggtcagggtggctcagtgtctgcccacctggacatgcgccgcggcagccgctatcaaagaatatcttcctgtaggtccagccataatgcacaacaagatccaagggtaccccctggagatgatgtgtatggcattcggatctttgattcctcaggctgatgtttcaatcgaggtgattaaagactttatggatgcctatagtctctggcaggacactttcgcgcggaccatcaatgtcgatcagcgcaagatgacaaaagccgaagtgtacgcaaagtttagagacccactgcatgctgccgtgaacagcctgttctttcccaatgctaccaggatatcctggctccaagccaagggcttactgactgcaacaaaagaggcctctggctcggtcaaggctgcggcagccgcttatcggaacatgtga

SEQ ID NO: 6200 - RNA, 738 nt, synthetic construct
  misc_feature 1..738: note = derived and/or modified CDS sequence (opt3) from HRTV(Patient1)__JX005842.1__N
  source 1..738: mol_type = other RNA
atgaccgactggagcgccatcgctgtggagattggcaacgaacccctggatgtccctgcactcgttgagttcgccaaggaaatagcgtacgaggggcttgacccagctgtgatctttggactgttgagagaaaggggtggcgagaattggcggaacgatgtaaaatatattatcgtgttcgccttaacacgcgggaataagattgtcaaagcatgcggaaagatgtccaaaaagggcgccgagcgaatgactaacctggctcgtgtgtacgaactaaaggagaatgcagttgacagaatggccgtgacgccggtcagggtggctcagtgtctccccacctggacatgcgccgcggcagccgctatcaaagaatatctgcctgtaggtccagccataatgcacaacaagatccaagggtacccccttgagatgatgtgtatggcatttggatctctgattcctcaggctgatgtttcaatcgaggtgattaaagacttcatggatgcctatagtttgtggcaggacacttttgcgcggaccatcaatgtcgatcagcgcaagatgacaaaagccgaagtgtacgcaaagttcagagacccactccatgctgccgtgaacagcctgtttttccccaatgctaccaggatatcctggctgcaagccaagggcctcttaactgcaacaaaagaggcctctggctcggtcaaggctgcggcagccgcttatcggaacatgtga

SEQ ID NO: 6201 - RNA, 738 nt, synthetic construct; identical to SEQ ID NO: 6199
  misc_feature 1..738: note = derived and/or modified CDS sequence (opt3) from HRTV(Patient2)__JX005843.1__N
  source 1..738: mol_type = other RNA

SEQ ID NO: 6202 - RNA, 732 nt, synthetic construct
  misc_feature 1..732: note = derived and/or modified CDS sequence (opt3) from PTV(PAN472868)__NC_027202.1__N
  source 1..732: mol_type = other RNA
atgagctacgaggaaatcgccgtgcagttcgcttccgagtctattgacgaacaagcagtcgccggctgggttaccgattttgcgtatcaggggttcgacgctaagagagtgatagccctggtaaaagataggggaggtgaggactggaagcaggatgtgaaaaagatgatcgtcctctcacttacacggggcaacaaacccaataagatggtgctgaagatgagtgacaaagggaaggcaatggttaacgaattggtgttaaaatacaagctgaaaagcggaaatccttcccgcgatgacctaactctctctcgaattacggccgcttttgcaggctggacctgccaggccgctgattatgtccaagagtacctgccagtgacaggtcgtgccatggacgcgatctcgtcaagctatccgagagcaatgatgcaccccagtttcgccgggcttattgatcaggagctgcctgctgacgtattgtccgaaatcactcaggcccattgtctctttatgatacagttctctaagaccatcaacccaagcctgaggggactgtccaaggatgagattgtttcaagttttgaacggcccatgcaagcagctatcagctctacattcctcacctccgccaatcgcagagcgatgttaaaaactctgggcattatcaacgacaatcttaagccttcaagcagtacagtgtctgccgcaaaagtctttaggtccttgtga

SEQ ID NO: 6203 - RNA, 732 nt, synthetic construct
  misc_feature 1..732: note = derived and/or modified CDS sequence (opt3) from PTV(Adames)__KR912210.1__N
  source 1..732: mol_type = other RNA
atgagctacgaggaaatcgccgtgcagttcgcttccgagtctattgacgaacaagcagtcgccggctgggttaccgattttgcgtatcaggggttcgacgctaagagagtgatagccctggtaaaagagaggggaggtgaagattggaagcaggacgtgaaaaagatgatcgtcctctcacttacacggggcaacaaacccaataagatggtgctgaagatgagtgataaagggaaggcaatggttaacgagttggtgttaaaatacaagctgaaaagcggaaatccttcccgcgacgatctaactctctctcgaattacggccgcttttgcaggctggacctgccaggccgctgactatgtccaagagtacctgccagtgacaggtcgtgccatggatactatctcgtcagggtatccgagagcgatgatgcaccccagcttcgcaggacttattgaccaggaactgcctgccgatgtattgagtgagatcacccaggctcattgtctctttatgatacagttctccaagacaatcaacccatctctgaggggcctgagcaaggacgaaattgtttcctcatttgagcggcccatgcaagccgcaatcagtagcaccttcctcacttctgctaatcgcagagccatgttaaaaacactgggcattatcaacgataatcttaagccttcctcaagcaccgtgagtgcggccaaagtctttaggtctttgtga

SEQ ID NO: 6204 - RNA, 732 nt, synthetic construct
  misc_feature 1..732: note = derived and/or modified CDS sequence (opt3) from PTV(Balliet)__KR912211.1__N
  source 1..732: mol_type = other RNA
atgagctacgaggaaatcgccgtgcagttcgcttccgagtctattgacgaacaaaccgtcgcaggctgggttacagattttgcctatcaggggttcgacgcgaagagagtgatagctctggtaaaagataggggaggtgaggactggaagcaggatgtgaaaaagatgatcgtcctctcacttactcggggcaacaaacccaataagatgattctgaagatgagtgacaaagggaaggccatggtgaacgaattggttttaaaatacaagctgaaaagcggaaatccttcccgcgatgacctaacgctctctcgaatcaccgcagcctttgctggctggacatgccaggcagccgattatgtgcaagagtacctgccagtcactggtcgtgctatggacgccatttcgtcaagctatccgagagcgatgatgcaccccagtttcgcagggcttatcgatcaggagctgcctgccgacgtgttttccgaaataacccaggctcattgtttgttcatgatccagttttctaagacaattaacccaagcctcaggggactgtccaaggatgagatcgtatcaagtttcgaacggcccatgcaagccgcaattagctctacctttctgacttccgctaatcgcagagccatgctcaaaacattaggcatcataaacgacaatctgaagccttcaagcagtaccgtttctgcggccaaagtgttcaggtccctttga

SEQ ID NO: 6205 - RNA, 732 nt, synthetic construct
  misc_feature 1..732: note = derived and/or modified CDS sequence (opt3) from PTV(PaAR2381)__KP272006.1__N
  source 1..732: mol_type = other RNA
atgagctacgaggaaatcgccgtgcagttcgcttccgagtctattgacgaacaagcagtcgccggctgggttaccgattttgcgtatcaggggttcgacgctaagagagtgatagccctggtaaaagataggggaggtgacgattggaagcaggacgtgaaaaagatgatcgtcctctcacttacacggggcaacaaacccaataagatggtgctgaagatgagtgataaagggaaggcaatggttaacgagttggtgttaaaatacaagctgaaaagcggaaatccttcccgcgacgatctaactctctctcgaattacggccgcttttgcaggctggacctgccaggccgctgactatgtccaagaatacctgccagtgacaggtcgtgccatggatgcgatctcgtcaagctatccgagagcaatgatgcaccccagtttcgccgggcttattgaccaggagctgcctgctgatgtattgtccgagatcactcaggcccattgtctctttatgatacagttctctaagaccatcaacccaagcctgaggggactgtccaaggacgaaattgtttcaagttttgagcggcccatgcaagcagctatcagctctacattcctcacctccgccaatcgcagagcgatgttaaaaactctgggcattatcaacgacaatcttaagccttcaagcagtacagtgtctgccgcaaaagtctttaggtccttgtga

SEQ ID NO: 6206 - RNA, 732 nt, synthetic construct
  misc_feature 1..732: note = derived and/or modified CDS sequence (opt3) from PTV(GML902876)__KP272012.1__N
  source 1..732: mol_type = other RNA
atgagctacgaggaaatcgccgtgcagttcgcttccgagtctattgacgaacaagcagtcgccggctgggttaccgattttgcgtatcaggggttcgacgctaagagagtgatagccctggtaaaagataggggaggtgacgattggaagcaggacgtgaaaaagatgatcgtcctctcacttacacggggcaacaaacccaataagatggtgctgaagatgagtgataaagggaaggcaatggttaacgagttggtgttaaaatacaagctgaaaagcggaaatccttcccgcgacgatctaactctctctcgaattacggccgcttttgcaggctggacctgccaggccgctgactatgtccaagaatacctgccagtgacaggtcgtgccatggatgcgatctcgtcaagctatccgagagcaatgatgcaccccagtttcgccgggcttattgaccaggagctgcctgctgatgtattgtccgagatcactcaggcccattgtctctttatgatacagttctctaagaccatcaacccaagcctgaggggactgtccaaggacgaaattgtttcaagttttgagcggcccatgcaagcagctatcagctctacattcctcacctccgccaatcgcagagcgatgttaaaaactctgggcattatcaacgacaatcttaagccttcaagcagtacagcctctgcagctaaagtgtttaggtccttgtga

SEQ ID NO: 6207 - RNA, 732 nt, synthetic construct
  misc_feature 1..732: note = derived and/or modified CDS sequence (opt3) from PTV(Adames)__KP272030.1__N
  source 1..732: mol_type = other RNA
atgagctacgaggaaatcgccgtgcagttcgcttccgagtctattgacgaacaagcagtcgccggctgggttacccactttgcgtatcaggggttcgatgctaagagagtgatagccctggtaaaagagaggggaggtgaagactggaagcaggatgtgaaaaagatgatcgtcctctcacttacacggggcaacaaacccaataagatggtgctgaagatgagtgacaaagggaaggcaatggttaacgagttggtgttaaaatacaagctgaaaagcggaaatccttcccgcgatgacctaactctctctcgaattacggccgcttttgcaggctggacctgccaggccgctgattatgtccaagagtacctgccagtgacaggtcgtgccatggacactatctcgtcagggtatccgagagcgatgatgcatcccagcttcgcaggacttattgatcaggaactgcctgccgacgtattgagtgagatcacccaggctcactgtctctttatgatacagttctccaagacaatcaacccatctctgaggggcctgagcaaggatgaaattgtttcctcatttgagcggcccatgcaagccgcaatcagtagcaccttcctcacttctgctaatcgcagagccatgttaaaaacactgggcattatcaacgacaatcttaagccttcctcaagcaccgtgagtgcggccaaagtctttaggtctttgtga

SEQ ID NO: 6208 - RNA, 735 nt, synthetic construct
  misc_feature 1..735: note = derived and/or modified CDS sequence (opt3) from Phlebovirus(CoAr171616)__HM566153.1__N
  source 1..735: mol_type = other RNA
atgagctacgaggaaatcgccgtgaacttcgcttccgagtctattgacgaatcaaccataagtgcatgggtcagcgattttgcctatcagggcttcgacgcgaagagagttatcgctctgattaaagagaggggaggggaaaattggaaggaggatgtgaaaaagatgatcgtactctcccttacacggggtaacaaacccgccaagatgattctgaagatgtctgacaaaggcaagaaagaggtgaatgatttgatcactcgctacaagttaaaatcggggaacccttcacgagacgatctgacgctaagccgtgtcgcagccgcttttgcaggatggacctgccaagccgctgaatatgtgcaggagtacctcccagttacaggcagagccatggacgcgttcagtgcagattttccgagggccctgatgcacccctccttcgctggtcttatagaccaggaactgccttctagcgccatgactgatatcgtgcatgcacactgtttgtttatgattcagttctccaagaccatcaatccaacaattcggtcagctagtaaggacgagatcgtcgccagctttgatcgccccatgcaagcggccataaactctaccttcctcacttccgcacagagaagggctatgctgaaaacactgggggtgattaatgacaacctcaaggtatcaaccgccgttagcagtgctgccaaagcatttaagaaattacagtga

SEQ ID NO: 6209 - RNA, 735 nt, synthetic construct
  misc_feature 1..735: note = derived and/or modified CDS sequence (opt3) from Phlebovirus(CoAr171616)__EF201836.1__N
  source 1..735: mol_type = other RNA
atgagctacgaggaaatcgccattcacttcgcttccgagtctatagacgaatcaaccatcagtgcatgggtgagcgattttgcctatcagggcttcgacgcgaagagagtcattgctctgatcaaagagaggggaggggaaaactggaaggaggatgttaaaaagatgattgtgctctcccttacacggggtaataaacccgccaagatgatcctgaagatgtctgacaaaggcaagaaagaggtaaacgatttgataactcgctacaagttaaaatcggggaatccttcacgagacgatctgacgctaagccgtgtggcagccgcttttgcaggatggacctgccaagccgctgaatatgtccaggagtacctcccagtgacaggcagagccatggacgcgttcagtgcagattttccgagggccctgatgcatccctccttcgctggtcttatcgaccaggaactgccttctagcgccatgactgatattgttcacgcacattgtttgtttatgatccagttctccaagaccattaacccaacaatccggtcagctagtaaggacgagatagtggccagctttgatcgccccatgcaagcggccattaattctaccttcctcacttccgcacagagaagggctatgctgaaaacactgggggtcatcaacgacaatctcaaggtgtcaaccgccgtaagcagtgctgccaaagcatttaagaaattacagtga

SEQ ID NO: 6210 - RNA, 732 nt, synthetic construct
  misc_feature 1..732: note = derived and/or modified CDS sequence (opt3) from Phlebovirus(CoAr170255)__EF201840.1__N
  source 1..732: mol_type = other RNA
atgagctacgaggaaatcgccattcagttcgcttccgagtctgtggacgcaaccacaatagccgcgtgggtctcagaatttgcttatcaaggcttcgatgccagacaggttatcaacctggtgaagcagaggggaggggacgattggaaggaggacgtaaagaaaatgattgtgctcagtcttactcggggtaataagcccagcaaaatgctgaacaagatgtccgaatctggccagaagatcgtcaatgatttgatttcgaaatacaagttaaaatcagggaaccctggacgcaatgacctgacgctaagccgaatcgcagccgcttttgcaggctggacctgccaagccgctgaggtggttcaggattatctcccagtgacaggtcgtgccatggacgcgataagtgataagttcccgagagcactgatgcacccctcctttgccgggcttgtcgaccctactctgccagagggagtggtagaagatatcgttcatgctcactgtttgttcatgattcagttttctaaaaccatcaaccccagcctcaggtcctcaagtaagagcgaggtggtctcttccttcgaccggcctatgcaggccgcaattaattcaccatttctgacagctggcaaccgcagagatatcctgatgagcctcggcttaataaatagtaacctgaagccctctcctgccgtgattgcggccgcaaaagtgtacaggaaactttga

SEQ ID NO: 6211 - RNA, 732 nt, synthetic construct
  misc_feature 1..732: note = derived and/or modified CDS sequence (opt3) from Buenaventura virus(CoAr3319)__KP272003.1__N
  source 1..732: mol_type = other RNA
atgagctacgaggaaatcgccattcagttcgcttccgagtctgtggacgcaaccacaatagccgcgtgggtctcagaatttgcttatcaaggcttcgatgccagacaggttatcaacctggtgaagcagaggggaggggacgattggaaggaggacgtaaagaaaatgattgtgctcagtcttactcggggtaataagcccagcaaaatgctgaacaagatgtccgaatctggccagaagatcgtcaatgatttgatttcgaaatacaagttaaaatcagggaaccctggacgcaatgacctgacgctaagccgaatcgcagccgcttttgcaggctggacctgccaagccgctgaggtggttcaggattatctcccagtgacaggtcgtgccatggacgcgataagtgataagttcccgagagcactgatgcacccctcctttgccgggcttgtcgaccctactctgccagagggagtggtagaagatatcgttcatgctcactgtttgttcatgattcagttttctaaaaccatcaaccccagcctcaggtcctcaagtaagagcgaggtggtctcttccttcgaccggcctatgcaggccgcaattaattcaccatttctgacagctggcaaccgcagagatatcctgatgagcctcggcttaataaatagtaacctgaagccctctcctaccgtggtggccgcggccaaagtctacaggaaactttga

SEQ ID NO: 6212 - RNA, 732 nt, synthetic construct
  misc_feature 1..732: note = derived and/or modified CDS sequence (opt3) from Cocle virus(GML244915)__KP272035.1__N
  source 1..732: mol_type = other RNA
atgagctacgaggaaatcgccgtgcagttcgcttccgagtctattgacgaacaagcagtcgccggctgggttaccgattttgcgtatcaggggttcgacgctagaagggtgatagccctggtaaaggatcggggaggtgaggactggaaacaggatgtgaagaaaatgatcgtcctctcacttacacgcggcaacaagcccaataaaatggtgctgaagatgagtgacaaggggaaagcaatggttaacgaattggtgttaaagtacaaactaaagagcggaaatccttcccgagatgacctgactctctctcgtattacggccgcttttgcaggctggacctgccaggccgctgattatgtccaagagtacctgccagtgacaggtagagccatggacgcgatctcgtcagggtatccgagggcaatgatgcaccccagcttcgccggacttattgatcaggagctgcctgctgacgtattgagtgaaatcactcaggcccattgtctctttatgatacagttctccaaaaccatcaacccatctctgcggggcctgggcaaggatgagattgttagctcctttgaacgccccatgcaagcagctatctcaagtacattcctcaccagcgccaatagaagggcgatgttaaagactctggggattatcaacgacaatcttaaaccttcttcctcaacagtgagcgccgcaaaggtctttcggagtttgtga

SEQ ID NO: 6213 - RNA, 732 nt, synthetic construct
  misc_feature 1..732: note = derived and/or modified CDS sequence (opt3) from Capira virus(VP-366G)__KP272044.1__N
  source 1..732: mol_type = other RNA
atgagctacgaggaaatcgccattcagttcgcttccgagtctatagacgaatcaaccatcgcagcctgggtgagtgattttgcgtatcaaggcttcgacgctaagcaggtcattatcctgattaaaaagagagggggagagaactggaaagaagatgttaagaaaatgatcgtgctcagccttacaaggggtaataagccctccaagatggtaaacaaaatgtctgacgagggcaagaaagtggtcaatgagctgatatcgaagtacaaattgaagactgggaaccctgcccgggatgacttaacgctgtcacgcatcgcagccgcttttgcaggatggacctgccaggccgctgaatatgtgcaggattacctaccagttacaggccgagccatggacgcgctcagcgataagtatccgcgtgcactgatgcaccccagtttcgccggtcttattgaccctactctgccagatgacgctgtgaaagatatcgtccatgcccactgtttgtttatgattcaattctccaagaccatcaatccctctctcagaagctccacaaaaaccgagatagtgaactcatttgacaggcctatgcaggcagctattaatagtccattcctgactgccgaaaaccggcgcgcgatgctgacaaccctcggggtaatcaatagcaacttaaagccctctgccgcagttgtggctgccgctaaagcctacagaaagctgtga

SEQ ID NO: 6214 - RNA, 732 nt, synthetic construct
  misc_feature 1..732: note = derived and/or modified CDS sequence (opt3) from Campana virus(VP-334K)__KP272042.1__N
  source 1..732: mol_type = other RNA
atgagctacgaggaaatcgccattcagttcgcttccgagtctgtggacgcaaccacaatagccgcgtgggtctcagaatttgcttatcaaggcttcgatgccagacaggttatcaacctggtgaagcagaggggaggggacgattggaaagaggacgtaaagaaaatgattgtgctcagtcttactcggggtaataagcccagccgcatggtcacgaaaatgtccgaatctggccagaagatcgtgaacgatctgatttcgaagtacaaattgaagtcagggaatcctggacgaaacgacttaaccctgagccgtgttgcagccgcttttgcaggctggacatgccaagccgctgaggtggtccaggattatctaccagtgactggtagagccatggacgcgctcagtgataaattcccgagggcaatcatgcacccctcctttgccgggctgatagaccctacccttccagagaatgtagttgaagatatcgtgcatgctcactgtctgttcatgattcagttttctaagacaatcaaccccagcttgcggtcctcaagtaaaagcgaggtcgtgtcttccttcgaccgccctatgcaggccgcaattaattcaccatttctcaccgctgccaacagaagggatatgctgatgagcctgggactcatcagttctaatttaaagccctccgcggccgtgactgcagctgccaaggcttaccggaaactgtga

SEQ ID NO: 6215 - RNA, 738 nt, synthetic construct
  misc_feature 1..738: note = derived and/or modified CDS sequence (opt3) from RVFV(ZH-548)__DQ380151.1__N
  source 1..738: mol_type = other RNA
atggacaactaccaggagctggccatccaattcgctgcacaggccgtggatagaaatgaaattgagcagtgggtcagggaatttgcgtatcagggcttcgacgctcggcgcgttatagagctccttaagcaatacgggggagccgattgggaaaaagacgcaaagaaaatgatcgtgctggccttgacccgaggtaacaagccccgtagaatgatgatgaaaatgagcaaggagggcaaggctacagtagaggcattaattaataaatataagctgaaagaagggaacccttccagggatgagctaactctctctcgggtggccgctgccctggcgggatggacgtgccaggcacttgtcgtgctgtcagaatggttgccagttaccggcacaactatggacggtctcagtccggcctacccccgccacatgatgcatcctagctttgctgggatggtggatccatccctgcccggagactatctgagagccatcctcgatgcacactctttatacctgcttcagttctcgagggtcattaatcctaacttgcggggccgcaccaaggaggaggtggctgccacatttacccagccaatgaatgcggccgtaaactcaaatttcatcagccatgaaaaacgaagagagtttctgaaggcattcggcctagttgacagtaacgggaagccctccgctgccgtgatggctgccgcacaagcctataaaactgctgcgtga

SEQ ID NO: 6216 - RNA, 738 nt, synthetic construct
  misc_feature 1..738: note = derived and/or modified CDS sequence (opt3) from RVFV(OV 35/74)__EF530207.1__N
  source 1..738: mol_type = other RNA
atggacaactaccaggagctggccatccaattcgctgcacaggccgtggatagaaatgaaattgagcagtgggtcagggaatttgcgtatcagggcttcgacgctcggcgcgttatagagctccttaagcaatacgggggagccgattgggaaaaagacgcaaagaaaatgatcgtgctggccttgacccgaggtaacaagccccgtagaatgatgatgaaaatgagcaaggagggcaaggctacagtagaggcattaattaataaatataagctgaaagaagggaacccttccagggatgagctaactctctctcgggtggccgctgccctggcgggatggacgtgccaggcacttgtcgtgctgtcagaatggttgccagttaccggcacaactatggacggtctcagtccggcctacccccgccacatgatgcatcctagctttgctgggatggtggatccatccctgcccgaggactatctgagagccatcctcgatgcacactctttatacctgcttcagttctcgagggtcattaatcctaacttgcggggacgcaccaaggaggaagtggctgccacatttacccagccaatgaatgcggccgtaaactcaaatttcatcagccatgagaaacgaagagaatttctgaaggcattcggcctagttgacagtaacggcaagccctccgctgccgtgatggctgccgcacaagcctataaaactgctgcgtga

SEQ ID NO: 6217 - RNA, 762 nt, synthetic construct
  misc_feature 1..762: note = derived and/or modified CDS sequence (opt3) from SFNV(Toscana)__NC_006318.1__N
  source 1..762: mol_type = other RNA
atgagcgacgagaactacagagatatcgccctggctttcctcgacgaatccgcagattctggcaccattaatgcctgggtgaacgagtttgcgtatcaggggttcgaccccaagaggatagtccaacttgttaaagaacggggaacagctaagggtcgcgattggaaaaaggacgtgaaaatgatgatcgtactgaatttggtgcgaggcaacaagcctgaggccatgatgaagaaaatgtcagaaaagggggcaagtattgtcgccaatttaatcagcgtgtaccagctgaaagagggaaacccaggccgtgatactattacgctatccagagtttctgctgcatttgtgccgtggaccgtccaggccctcagggtgctgtcggagtcacttcccgtaagcggtacaactatggacgctatcgccggggttacctatcctcgggcgatgatgcacccaagtttcgcaggaataatcgatctggacttgcccaatggcgccggcgctacaattgccgatgcacatgggctctttatgatcgagttctccaagaccattaacccttctctgcgcactaaacaggctaatgaagtggccgcgacatttgaaaagccaaacatggccgcaatgagcggaagattctttaccagggaggacaagaaaaagctgctcatcgctgtcggtataattgatgaggacttagtgctggcctccgctgtggtccggtcagccgaaaaataccgcgcaaaggttggcaaatga

SEQ ID NO: 6218 - RNA, 762 nt, synthetic construct
  misc_feature 1..762: note = derived and/or modified CDS sequence (opt3) from SFNV__HM566170.1__N
  source 1..762: mol_type = other RNA
atgagcgaggaaaactacagagagatcgccctggctttcctcgacgaagcagccgattccggcaccattacagcgtgggtgaatgagtttgcttatcaggggttcgaccccaagaggatagtccaacttgttaaagaacggggaactgccaagggtcgcgattggaaaaaggacgtgaaaatgatgatcgtactgaacttggtgcgaggcaataagcctgaggcaatgatgaagaaaatgtctgagaagggggccggaattgtcgctcagttaatctcagtgtaccagctgaaagaaggcaacccaggtcgtgatacgattaccctaagtagagttagcgcagcctttgtgccgtggacaatccaggctctcagggtcctgtccgactctcttcccgtgactgggaccacaatggatgccatagcgggagtaacctatcctcgggcaatgatgcacccatcgttcgccggcatcattgacctggatttgcccaatcgcgctggcgaggttatcgccgacgcacatgggctctttatgctggagttctcaaagactattaaccctagcctgagaacaaaacaaccaaatgaaatcgctgccacctttgagaagcccaacatggcggccatgagtggaaggttctttacgcgggaagataagaaaaagctcttaatggcagtgggtatactgaatgaggaccttgtcttgactcctgctattgtgaaatgcgccgaaaagtactgttccaaagtgggcaagtga

SEQ ID NO: 6219 - RNA, 735 nt, synthetic construct; identical to SEQ ID NO: 6208
  misc_feature 1..735: note = derived and/or modified CDS sequence (opt3) from SFNV(Namru)__HM566168.1__N
  source 1..735: mol_type = other RNA

SEQ ID NO: 6220 - RNA, 762 nt, synthetic construct
  misc_feature 1..762: note = derived and/or modified CDS sequence (opt3) from SFNV(NAMRU 840055)__EF201828.1__N
  source 1..762: mol_type = other RNA
atgagcgaggaaaactacagagagatcgccctggctttcctcgacgaagcagccgattccggcaccattacagcgtgggtgaatgagtttgcttatcaggggttcgaccccaagaggatagtccaacttgttaaagaacggggaactgccaagggtcgcgattggaaaaaggacgtgaaaatgatgatcgtactgaacttggtgcgaggcaataagcctgaggcaatgatgaagaaaatgtctgagaagggggccggaattgtcgctcagttaatctcagtgtaccagctgcgtgaaggcaacccaggtagagatacgattaccctaagtagggttagcgcagcctttgtgccgtggacaatccaggctctcaaagtcctgtccgactctcttcccgtgactgggaccacaatggatgccatagcgggagtagtttatcctcgggcaatgatgcacccatcgttcgccggcatcattgacctggatttgcccaatcgcgctggcgaggccatcgcagacgctcatgggctctttatgctggagttctcaaagaccattaaccctagcctgagaactaaacaaccaaatgaaatcgccgcgacatttgagaagcccaacatggccgcaatgagtggaaggttctttacccgggaagataagaaaaagctcttaatggctgtgggtatactgaatgaggaccttgtcttgacgcctgccattgtgaaatgcgctgaaaagtaccgctccaaagtgggcaagtga

SEQ ID NO: 6221 - RNA, 762 nt, synthetic construct
  misc_feature 1..762: note = derived and/or modified CDS sequence (opt3) from SFNV(NAMRU 840055)__EF201829.1__N
  source 1..762: mol_type = other RNA
atgagcgaggaaaactacagagagatcgccctggctttcctcgacgaagcagccgattccggcaccattacagcgtgggtgaatgagtttgcttatcaggggttcgaccccaagaggatagtccaacttgttaaagaacggggaactgccaagggtcgcgattggaaaaaggacgtgaaaatgatgatcgtactgaacttggtgcgaggcaataagcctgaggcaatgatgaagaaaatgtctgagaagggggccggaattgtcgctcagttaatctcagtgtaccagctgaaagaaggcaacccaggtcgtgatacgattaccctaagtagagttagcgcagcctttgtgccgtggacaatccaggctctcagggtcctgtccgactctcttcccgtgactgggaccacaatggatgccatagcgggagtaacctatcctcgggcaatgatgcacccatcgttcgccggcatcattgacctggatttgcccaatcgcgctggcgaggccatcgcagacgctcatgggctctttatgctggagttctcaaagactattaaccctagcctgagaacaaaacaaccaaatgaaatcgccgcgacctttgagaagcccaacatggccgcaatgagtggaaggttctttacgcgggaagataagaaaaagctcttaatggctgttggtatactgaatgaggaccttgtgttgactcctgccattgtcaaatgcgctgaaaagtactgttccaaagtgggcaagtga

SEQ ID NO: 6222 - RNA, 762 nt, synthetic construct
  misc_feature 1..762: note = derived and/or modified CDS sequence (opt3) from SFNV(P-7101795)__EF201830.1__N
  source 1..762: mol_type = other RNA
atgagcgaggaaaactacagagagatcgccctggctttcctcaatgaagcagccgactccggcacaattacagcgtgggtgaacgagtttgcttatcaggggttcgatcccaagaggatagtccaacttgttaaagaacggggaactgccaagggtcgcgactggaaaaaggatgtgaaaatgatgatcgtactgaatttggtgcgaggcaacaagcctgagacgatgatgaagaaaatgtctgagaagggggcaggaattgtcgcccagttaatctcagtgtaccagctgaaagaaggcaatccaggtcgtgacaccattacactaagtagagttagcgctgcatttgtgccgtggactgtccaggccctcagggtgctgtccgattctcttcccgtaaccgggacaaccatggacgctatcgccggagttacttatcctcgggcgatgatgcacccatcgttcgcaggcataatcgatctggacttgcccaaccgcgccggcgagacaattgctgatgcccatgggctctttatgctggagttctcaaagaccatcaatcctagcctgagaacgaaacaaccaaacgaaattgcagctacttttgagaagcccaatatggccgcgatgagtggaaggttctttacccgggaagacaagaaaaagctcttaatggccgtgggtgtcctgaacgaggatcttgtgttgacccctgcaatcgtgaaatgcgctgaaaagtaccgctccaaagtcggcaagtga

SEQ ID NO: 6223 - RNA, 762 nt, synthetic construct
  misc_feature 1..762: note = derived and/or modified CDS sequence (opt3) from SFNV(P-7101795)__EF201832.1__N
  source 1..762: mol_type = other RNA
atgagcgaggaaaactacagagagatcgccctggctttcctcgacgaagcagccgattccggcaccattacagcgtgggtgaatgagtttgcttatcaggggttcgaccccaagaggatagtccaacttgttaaagaacggggaactgccaagggtcgcgattggaaaaaggacgtgaaaatgatgatcgtactgaacttggtgcgaggcaataagcctgaggcaatgatgaagaaaatgtctgagaagggggccggaattgtcgctcagttaatctcagtgtaccagctgcgtgaaggcaacccaggtagagatacgattaccctaagtagggttagcgcagcctttgtgccgtggacaatccaggctctcaaagtcctgtccgactctcttcccgtgactgggaccacaatggatgccatagcgggagtaatgtatcctcgggcaatgatgcacccatcgttcgccggcatcattgacctggatttgcccaatcgcgctggcgaggccatcgcagacgctcatgggctctttatgctggagttctcaaagaccattaaccctagcctgagaactaaacaaccaaatgaaatcgccgcgacatttgagaagcccaacatggccgcaatgagtggaaggttctttacccgggaagataagaaaaagctcttaatggctgttggtatactgaatgaggaccttgtgttgacgcctgccattatcaaatgcgctgaaaagtaccgctccaaagtcggcaagtga

SEQ ID NO: 6224 - RNA, 762 nt, synthetic construct
  misc_feature 1..762: note = derived and/or modified CDS sequence (opt3) from Arrabida virus(PoSFPhlebV/126/2008)__KP863801.1__N
  source 1..762: mol_type = other RNA
atgagcgaggacaactacagaaccatcgccctggctttcctcgatgaatccgcagactctacaactattaatgcctgggtgaacgagtttgcgtatcagggcttcgatcccaagaggatagtccaacttgttaaagaacgggggacggctaagggacgcgactggaaaaaggatgtgaaaatgatgatcgtactgaatttggtgcgaggtaacaagcctgagtcaatgatgaagaaaatgagtgaaaagggcgccgcaattgtcacccagttaatcagcacataccagctgaaagaggggaatccaggacgtgacactattaccctatccagagtgtctgccgcttttgttccgtggacagtgcaggcactcaagaccctgtcggagtcacttcccgtcactggcacaaccatggatagcatcgccggtacgacttatcctaggtgcatgatgcacccaagtttcgctgggataatcgacctggaattgcccaacaataccggagccatgctcgcggatgcacatggcctgtttatgctggagttctccaaaacaattaacccttctctccggactaagcaaccaaatgaaatcgccgctacctttgagaagcccaacatggccgcaatgacaggccgcttctttaccagagacgataaaaagaaattactgattgctatcggggtgcttgacgaggatttggtacctaatccagccatagaaaagtgtgcggagaaatacaaggccaaagttggaaagtga

SEQ ID NO: 6225 - RNA, 765 nt, synthetic construct
  misc_feature 1..765: note = derived and/or modified CDS sequence (opt3) from Gordil virus(Dak ANBr 496d)__KF297902.1__N
  source 1..765: mol_type = other RNA
atgagcgaggaaaactacagagagatcgccatggctttcgcaaatgactccgccgattttaacatgatttctgtgtgggcgaatgacttcgcttatcagggctttgatcccaagaggatagtcgaactggttcggcaacgcgggctcgccaaagcacgaaactggaagcaggacgtgaaaatgatgatcgtacttaatctgatgcgtggaaacaagcctgaggccatggtgagaaaaatgcaggaaaagggtcagaggattgtcttggagttaatctcagtgtacgagctgaaggaaggcaatccagggcgggataccattacactaagtcgcgttagcgctgcattcgtgccgtggactatcatggccctcagacaactggctgagaacatacccgtcacgggatccatcatggactctattcttgatggcgccgtgtatcctagggcgatgatgcacccatcgtttgcaggtatcattgacctggaattgcccgaggggcggggagccgagctcgctgatgcccatggcctgttcatgatcgaattttcaaaaaccataaatcctagcctgcgcacaaagagtgcaattgagatcgctgcctccttcgaaaaaccaaacatggcggccatgactggcaactttttcaccaaggacgataaacgaaagctcttaaagcagattgggatcctggactctgatcttaaattgacacccgtaatcgagaaggcagctgccctgtacagaagcaaaaccaataagtga

SEQ ID NO: 6226 - RNA, 762 nt, synthetic construct
  misc_feature 1..762: note = derived and/or modified CDS sequence (opt3) from Granada virus(GR25)__GU135608.1__N
  source 1..762: mol_type = other RNA
atgagcgaggacaactacagaaccatcgccctggctttcctcgatgaatccgcagactctacaactattaatgcctgggtgaacgagtttgcgtatcagggcttcgatcccaagaggatagtccaacttgttaaagaacgggggacggctaagggacgcgactggaaaaaggatgtgaaaatgatgatcgtactgaatttggtgcgaggtaacaagcctgagtcaatgatgaagaaaatgagtgaaaagggcgccgcaattgtcacccagttaatcagcacataccagctgaaagaggggaatccaggacgtgacactattaccctatccagagtgtctgccgcttttgttccgtggacagtgcaggcactcaagaccctgtcggagtcacttcccgtcactggcacaaccatggatagcatcgccggtacgacttatcctaggtgcatgatgcacccaagtttcgctgggataatcgacctggaattgcccaacaataccggagccatgctcgcggatgcacatggcctgtttatgctggagttctccaaaacaattaacccttctctccggactaagcaaccaaatgaaatcgccgctacctttgagaagcccaacatggccgcaatgacaggccgcttctttaccagagacgataaaaagaaattactgattgctatcggggtgcttaatgaggacttggtacctaacccagccatagaaaagtgtgcggagaaatacaaggccaaagttggaaagtga

SEQ ID NO: 6227 - RNA, 762 nt, synthetic construct
  misc_feature 1..762: note = derived and/or modified CDS sequence (opt3) from Massilia virus(127)__KT906102.1__N
  source 1..762: mol_type = other RNA
atgagcgaggacaactacagaaccatcgccctgtccttcctcgatgaaacagctgtgtctacttcaattaatgcatgcgtcaacgagtttgcctatcagggcttcgaccccaagaggatagttcaacttgtgaaagaacgggggacggcgaagggacgcgattggaaaaaggacgtaaaaatgatgatcgtgctgaatttggtccgaggtaacaagcctgagagtatgatgaagaaaatgagcgaaaagggcgctgccattgtgacccagttaatctccacataccagctgaaagaggggaatccaggacgtgatactattaccctatctagagtttcggcagcctttgtgccgtggacagtccaggctctcaagaccctgtcagagagccttcccgtgactggcacaaccatggacagtatcgcaggtacgacttatcctaggtgtatgatgcacccatccttcgccgggataatcgatctggaattgcccaacaataccggagctatgctcgccgacgcgcatggcctgtttatgctggagttctctaaaacaattaaccctagcctccggactaagcaaccaaatgaaatcgcagccacctttgagaagcccaacatggctgccatgacaggccgcttctttaccagagatgacaaaaagaaattactgattgcaatcggggtacttgatgaggacttggttcctaatccagctatagaaaagtgcgccgagaaatacaaggcgaaagtgggaaagtga

SEQ ID NO: 6228 - RNA, 762 nt, synthetic construct
  misc_feature 1..762: note = derived and/or modified CDS sequence (opt3) from Massilia virus(130)__KT906103.1__N
  source 1..762: mol_type = other RNA
atgagcgaggacaactacagaaccatcgccctgtccttcctcgatgaaacagctgactctacttcaattaatgcatgcgtgaacgagtttgcctatcagggcttcgatcccaagaggatagtccaacttgttaaagaacgggggacggcgaagggacgcgactggaaaaaggatgtgaaaatgatgatcgtactgaatttggtgcgaggtaacaagcctgagagtatgatgaagaaaatgagcgaaaagggcgctgccattgtcacccagttaatctccacataccagctgaaagaggggaatccaggacgtgacactattaccctatctagagtgtcggcagcctttgttccgtggacagtgcaggctctcaagaccctgtcagagagccttcccgtcactggcacaaccatggatagtatcgcaggtacgacttatcctaggtgtatgatgcacccatccttcgccgggataatcgacctggaattgcccaacaataccggagctatgctcgccgatgcgcatggcctgtttatgctggagttctctaaaacaattaaccctagcctccggactaagcaaccaaatgaaatcgcagccacctttgagaagcccaacatggctgccatgacaggccgcttctttaccagagacgataaaaagaaattactgattgcaatcggggtgcttgacgaggatttggtacctaatccagctatagaaaagtgcgccgagaaatacaaggcgaaagttggaaagtga

SEQ ID NO: 6229 - RNA, 762 nt, synthetic construct
  misc_feature 1..762: note = derived and/or modified CDS sequence (opt3) from Naples virus(Yu 8/76)__JF920141.1__N
  source 1..762: mol_type = other RNA
atgagcgaggacgattaccacaagatcgccctggctttcgcagaagagtccgccgacgtgtctaccattgaatcatgggtcaacgattttgcgtatcagggcttcgaccccagaaggatagttcaactcgtgaaagagcgggggacagctaagggacgcgattggaaaaaggacgtaaaaatgatgatcgtgcttaatctggtccgaggtaacaagcctgaagccatgatgaagaaaatgagtgagaagggcgcagccattgtggctcagttgatcagcgtttaccagttaaaagaggggaatccaggacgtgatactattacgctgtccagagtgtctgcagcctttgtcccgtggaccgtgcaggctctaagggtactctcggaccatctgcccgttacaggcactaccatggatgccatcgcgggtgtgacatatcctcgggcaatgatgcacccatcattcgccgggatagtcgaccttgaactgccccgcaagaccggagagatgatcgctgatgcccatggcttgtttatgctcgagttcagcaaaactattaaccctagtctgagaacaaagcaaccaaatgaaatcgcaaccacgtttgagaagcccaacatggctgccatgtccggcaaattcttttctagggaagacaagaaaaagctgctcatgagcgtggggattatcaatgatgacttactgcttactgcgtccgtggtcaaatgcgccgagaagtaccgggcaaaaaccggaaagtga

SEQ ID NO: 6230 - RNA, 762 nt, synthetic construct
  misc_feature 1..762: note = derived and/or modified CDS sequence (opt3) from Punique virus(P1_B4_2008)__FJ848987.1__N
  source 1..762: mol_type = other RNA
atgagcgaggaaaactacagagagatcgccctggctttcctcgacgaatccgcagattctggcaccatttcaacatgggtgaatgactttgcctatcaggggttcgatcccaagaggatagtccaacttgttaaagagcggggaactgcgaagggtcgcgactggaaaaaggatgtgaaaatgatgatcgtactgaacttggtgcgaggcaataagcctgaaagtatgatgaagaaaatgagcgagaagggggctgccattgtcgcacagttaatcgccgcttaccagctgaaagagggaaacccaggccgtgacacgattaccctatccagagtgtctgcagcctttgttccgtggacagtgcaggctctcaggtcgctgtcagatagccttcccgtcactggtaccacaatggacagtatcgccggggtgacctatcctcggtgcatgatgcacccatccttcgcgggaataatcgatctggacttgcccaatgatactggcgcaatgctcgccgacgctcatggcctgtttatgctggagttctctaagacaattaaccctagcctccgcaccaaacaagccaatgaaatcgcagctacgtttgaaaagccaaacatggccgcgatgaatgggagattctttactagggaggataagaaaaagttactgattgccatcggagtacttaacgaggacttgatacccgtttccgcaattgctaaatgtgccgaaaagtaccgggctaaagtgggtaagtga

SEQ ID NO: 6231 - RNA, 762 nt, synthetic construct
  misc_feature 1..762: note = derived and/or modified CDS sequence (opt3) from Saint Floris virus(Dak ANB512)__JF920138.1__N
  source 1..762: mol_type = other RNA
atgagcgaggaaacctacgcccagctggctatggcattcctcgccgagcccgcggactggtccacactttctgtgtgggtcaacgaatttgcttatcaaggcttcgatcctaagagaatcgttgagctgattatggaaagggggaaaaagtttaatcgggagtggaaaaaggacgtgaaaatgatgataactttgaacttaatccgcggaaataagccagaggccatgatgcgaaagatgtcagataaaggtcgtagtattgtaagcgaactgatctccgtgtacgagctaaaggaaggcaacccggggagagacacgattaccctctctagggtctcggcagccttcgtgccctggacagttcgggctctggtggcacttcagaatgatctgcctgtcactggagccgctatggactcaatctgcggcgtgacctatccacgcgccatgatgcaccccagctttgcgggtgtaatagatttggagctccctaacggggttggagcacagctggccgacgctcatggcctgttcatgctcgagtttagtaaaacaatcaatccaggcttaagaaccaagcagcccaacgaaattgccgcaactttcgagaaacctaatctggctgccatgacagggaagtttttcaccaaggaagataaaaggaaggtgcttatctccgtcggagtgattaactctgacttgcaaccaaatagcgtggtcaaaacgtgtgcggagctgtaccgggcccgcgttatgaagtga

SEQ ID NO: 6232 - RNA, 762 nt, synthetic construct
  misc_feature 1..762: note = derived and/or modified CDS sequence (opt3) from Tehran virus(I-47)__JF939848.1__N
  source 1..762: mol_type = other RNA
atgagcgaggaagactacagagccatcgctctgtccttctctgatgagtcagcagacgtgggcattataaccacatgggtcaacgaatttgcctatcaggggttcgatcccaagaggatcgttcaactcgtgaaagagcggggacaggcgaagggtcgcgactggaaaaaggatgtaaaaatgatgattgtgcttaatctgatccgaggcaacaagcctgacgctatgatgaagaaaatgagtgaaaagggggccgcaactgtcgcccagttggtgagcgtttaccagttaaaagagggaaatccaggccgtgatacgattaccctgtccagagtgtctgctgcatttgtcccgtggacagtgcaagccctaaaggtactctcggagtcactgcccgttactggtaccacaatggacaccgtggctggggtcacttatcctagggccatgatgcaccccagcttcgcgggaatcatagatcttgaactgccaggccgggcaggcgaggccatcgctgacgcccatgggttgtttatgctcgagttcagtaaaacaattaacccttccctgcgcaccaagcagccaaatgaaatcgcagctacgtttgagaagcccaacatggccgcgatgactggaagattctttaccagggaagataaaaagaaactgctcattgccgtgggtatcataaatgacgatttactgcttacaccttctattgcaaagtgcgctgagaaataccgggccaaggtgggcaaatga

SEQ ID NO: 6233 - RNA, 762 nt, synthetic construct
  misc_feature 1..762: note = derived and/or modified CDS sequence (opt3) from Zerdali virus(37)__KP966618.1__N
  source 1..762: mol_type = other RNA
atgagcgaggaagactacagagccatcgctctgtccttctctgatgaggcagccgacgtgggcaccattacagcgtgggtcaacgaatttgcttatcaggggttcgatcccaagaggatagttcaactcgtgcgggagcgcggaatcgccaaaggtcgagactggaagaaagatgtaaagatgatgattgtgcttaatctgatccgtggcaacaaacctgacgcaatgatgaagaagatgtcagaaaaaggggccgctactgtcgcacagttggtgagtgtttaccagttaaaggagggaaatccaggcagagatacgattaccccgagcagggtgtccgccgcttttgtcccctggacagtgcaggccctgaaagtactatctgagtcgctccctgttactggtaccacaatggacaccatcgcgggggtgtcatatccacgggcaatgatgcaccccagcttcgccggaataatcgatctggaacttcctcgcagagctggcgaggtcattgccgacgcacatggcctgtttatgttggagttcagtaagactatcaacccatccctcaggacaaaacaacccaatgaaattgctgccacctttgagaagcctaacatggcggccatgacggggcggttctttactcgcgaagataagaaaaagctgctgatcgcagtgggaataattaatgacgatctcttactggctccatctgtggccaaatgcgctgagaagtaccgagccaaagtcggtaagtga

SEQ ID NO: 6234 - RNA, 762 nt, synthetic construct; identical to SEQ ID NO: 6217
  misc_feature 1..762: note = derived and/or modified CDS sequence (opt3) from TOSV(9028)__KU904263.1__N
  source 1..762: mol_type = other RNA

SEQ ID NO: 6235 - RNA, 762 nt, synthetic construct
  misc_feature 1..762: note = derived and/or modified CDS sequence (opt3) from TOSV(SI-121283)__JF330274.1__N
  source 1..762: mol_type = other RNA
atgagcgacgagaactacagagatatcgccctggctttcctcgacgaatccgcagattctggcaccattaatgcctgggtgaacgagtttgcgtatcaggggttcgaccccaagaggatagtccaacttgttaaagaacggggaacagctaagggtcgcgattggaaaaaggacgtgaaaatgatgatcgtactgaatttggtgcgaggcaacaagcctgaggccatgatgaagaaaatgtcagaaaagggggcaagtattgtcgccaatttaatcagcgtgtaccagctgaaagagggaaacccaggccgtgatactattacgctatccagagtttctgctgcatttgtgccgtggaccgtccaggccctcagggtgctgtcggagtcacttcccgtaagcggtacaactatggacgctatcgccggggttacctatcctcgggcgatgatgcacccaagtttcgcaggaataatcgatctggacttgcccaatggcgccggcgctacaattgccgatgcacatgggctctttatgatcgagttctccaagaccattaacccttctctgcgcactaaacaggctaatgaagtggccgcgacatttgaaaacccaaatatggccgcaatgagcggaagattctttaccagggaggacaagaagaaactgctcatcgctgtcggtataattgatgaggacttagtgctggcctccgctgtggtccggtcagccgaaaagtaccgcgcaaaagttggcaagtga

SEQ ID NO: 6236 - RNA, 762 nt, synthetic construct
  misc_feature 1..762: note = derived and/or modified CDS sequence (opt3) from TOSV(5963930705)__KU935733.1__N
  source 1..762: mol_type = other RNA
atgagcgacgagaactacagagatatcgccctggctttcctcgacgaatccgcagattctggcaccattaatgcctgggtgaacgagtttgcgtatcaggggttcgaccccaagaggatagtccaacttgttaaagaacggggaacagctaagggtcgcgattggaaaaaggacgtgaaaatgatgatcgtactgaatttggtgcgaggcaacaagcctgaggccatgatgaagaaaatgtcagaaaagggggcaagtattgtcgccaatttaatcagcgtgtaccagctgaaagagggaaacccaggccgtgatactattacgctatccagagtttctgctgcatttgtgccgtggaccgtccaggccctcagggtgctgtcggagtcacttcccgtaagcggtacaactatggacgctatcgccggggttacctatcctcgggcgatgatgcacccaagtttcgcaggaataatcgatctggacttgcccaatggcgccggcgctacaattgccgatgcacatgggctctttatggtggagttctccaagaccatcaacccttctctgcgcactaaacaggctaatgaagtcgccgcgacatttgaaaagccaaacatggccgcaatgagcggaagattctttaccagggaggacaagaaaaagctgctcattgctgtgggtatcatagatgaggacttagtgctggcctccgctgtcgttcggtcagccgaaaaataccgcgcaaaggtgggcaaatga

SEQ ID NO: 6237 - RNA, 762 nt, synthetic construct
  misc_feature 1..762: note = derived and/or modified CDS sequence (opt3) from TOSV(MRS2010-4319501)__KC776214.1__N
  source 1..762: mol_type = other RNA
atgagcgacgagaactacagagatatcgccctggctttcctcgacgaatccgcagattctggcaccattaatgcctgggtgaacgagtttgcgtatcaggggttcgaccccaagaggatagtccaacttgttaaagaacggggaacagctaagggtcgcgattggaaaaaggacgtgaaaatgatgatcgtactgaatttggtgcgaggcaacaagcctgaggccatgatgaagaaaatgtcagaaaagggggcaagtattgtcgccaatttaatcagcgtgtaccagctgaaagagggaaacccaggccgtgatactattacgctatccagagtttctgctgcatttgtgccgtggaccgtccaggccctcagggtgctgtcggagtcacttcccgtaagcggtacaactatggacgctatcgccggggttacctatcctcgggcgatgatgcacccaagtttcgcaggaataatcgatctgcatttgcccaatggcgccggcgctacaattgccgacgcacacgggctctttatgatcgagttctccaagaccattaacccttctctgcgcactaaacaggctaatgaagtggccgcgacatttgaaaagccaaacatggccgcaatgagcggaagattctttaccagggaggataagaaaaagctgctcatcgctgtcggtataattgacgaggatttagtgctggcctccgctgtggtccggtcagccgaaaaataccgcgcaaaggttggcaaatga

SEQ ID NO: 6238 - RNA, 762 nt, synthetic construct
  misc_feature 1..762: note = derived and/or modified CDS sequence (opt3) from TOSV(TOSV/Firenze.ITA/1983/2)__KM275765.1__N
  source 1..762: mol_type = other RNA
atgagcgacgagaactacagagatatcgccctggctttcctcgacgaatgcgcagattccggcaccattaatgcctgggtgaacgagtttgcgtatcaggggttcgaccccaagaggatagtccaacttgttaaagaacggggaacagctaagggtcgcgattggaaaaaggacgtgaaaatgatgatcgtactgaatttggtgcgaggcaacaagcctgaggccatgatgaagaaaatgtctgaaaagggggcatcaattgtcgccaatttaatcagtgtgtaccagctgaaagagggaaacccaggccgtgatactattacgctaagcagagtttccgctgcatttgtgccgtggaccgtccaggccctcagggtgctgtctgagtcgcttcccgtatcaggtacaactatggacgctatcgccggggttacctatcctcgggcgatgatgcaccccagcttcgcaggaataatcgatctggacttgccaaatggcgccggcgctacaattgccgatgcacatgggctctttatgatcgagttcagtaagaccattaacccttccctgcgcactaaacaggctaatgaagtggccgcgacatttgaaaagccaaacatggccgcaatgtctggaagattctttaccagggaggacaagaaaaagctgctcatcgctgtcggtataattgatgaggacttagtgctggccagcgctgtggtccggtccgccgaaaaataccgcgcaaaggttggcaaatga

SEQ ID NO: 6239 - RNA, 738 nt, synthetic construct
  misc_feature 1..738: note = derived and/or modified CDS sequence (opt3) from SFTSV(HB29)__NC_018137.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacagccggagtctcagaggctaccactaaaacattaatggaagcctacagcctgtggcaggatgcatttaccaagacgataaatgtgaagatgaggggcgctagtaaaactgaggtatataactccttccgggaccctcttcacgccgcggttaattctgtgtttttcccaaacgatgtccgcgtgaagtggttgaaagccaagggcatcctggggcccgacggagtgcctagcagagcagctgaagtcgccgctgccgcatacaggaatctatga

SEQ ID NO: 6240 - RNA, 738 nt, synthetic construct
  misc_feature 1..738: note = derived and/or modified CDS sequence (opt3) from SFTSV(111S)__KP339904.1__N
  source 1..738: mol_type = other RNA
atgagcgagtggtccagaatcgccgtggagttcggcgaacagcaactgaacctcaccgaacttgaggactttgctagggaactggcatacgaggggttggatcgggccttaattataaagaaactgaaggagacaggaggtgacgattgggtcaaagacactaagttcatcattgtttttgcgctaacgcgcggcaataaaatcgtgaaggcttctgggaagatgtcaaacagtggaagcaaacgactcatggccctgcaggaaaagtatggccttgtagagcgtgcagaaaccagactgtccattacacccgtgagggtcgcccagtctttgcctacttggacctgcgctgcagccgctgccctcaaagagtacctgccagtgggtccggcggttatgaatctgaaggtggagaactatccccctgaaatgatgtgtatggcattcgggtcgctcatcccaacagccggagtctcagaggctaccactaaaacattaatggaagcctacagcctgtggcaggatgcatttaccaagacgataaatgtgaagatgcggggcgctagtaaaactgaggtatataactccttccgcgacccccttcacgccgcggttaattctgtgtttttccctaacgatgtcagagtgaagtggttgaaagccaagggcatcctggggccagacggagtgcccagcagggcagctgaagtcgccgctgccgcataccggaatctatga

SEQ ID NO: 6241 - RNA, 738 nt, synthetic construct
  misc_feature 1..738: note = derived and/or modified CDS sequence (opt3) from SFTSV(116S)__KP339905.1__N
  source 1..738: mol_type = other RNA
atgagcgagtggtccagaatcgccgtggaatttggcgagcagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacagccggagtctcagaggctaccactaaaacattaatggaagcctacagcctgtggcaggatgcatttaccaagacgataaatgtgaagatgaggggcgctagtaaaactgagatctataactccttccgggaccctcttcacgccgcggtaaattctgttttcttcccaaacgatgtgcgcgtcaagtggttgaaagccaagggcattctggggcccgacggagtgcctagcagagcagctgaagtggccgctgccgcatacaggaatctatga

SEQ ID NO: 6242 - RNA, 738 nt, synthetic construct
  misc_feature 1..738: note = derived and/or modified CDS sequence (opt3) from SFTSV(132S)__KP339912.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatctctgtttttgcgctaacgcggggcaataaaattgtgaaggcttcagggaagatgagtaacagcggatccaaacgcctcatggccctgcaggaaaagtatggccttgtagagcgagcagaaacccgtctgtctatcacacctgtgagagtcgcccagtcgttgccaacttggacctgcgctgcagccgctgccctcaaagagtacctgccggtgggtcccgcggttatgaatctgaaggtggagaactatcctccagaaatgatgtgtatggcattcgggtcactcattcccacagccggagtcagcgaggctaccactaaaacattaatggaagcctacagtctgtggcaggatgcatttaccaagacgatcaatgtgaagatgaggggcgcttccaaaactgaggtatataactctttccgggaccctcttcacgccgcggttaatagcgtgtttttcccaaacgatgtccgcgtgaagtggttgaaagccaagggcatactggggcccgacggagtgccttccagagcagctgaagtcgccgctgccgcatacaggaatctatga

SEQ ID NO: 6243 - RNA, 738 nt, synthetic construct
  misc_feature 1..738: note = derived and/or modified CDS sequence (opt3) from SFTSV(2014045S)__KR075923.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacagccggagtctcagaggctaccactaaaacattaatggaagcctacagcctgtggcaggatgcatttaccaagacgataaatgtgaagatgaggggcgctagtaaaactgaggtatataactccttccgggaccctcttcacgccgcggttaattctgtgtttttcccaaacgatgtccgcgtgaagtggttgaaagccaagggcatcctggggcccgacggagcacctagcagagctgccgaagtggctgccgcagcctacaggaatctatga

SEQ ID NO: 6244 - RNA, 738 nt, synthetic construct
  misc_feature 1..738: note = derived and/or modified CDS sequence (opt3) from SFTSV(2014193S)__KR075916.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccgtgacacctgtcagagtggcccagtctttgccaacttggacctgcgctgcagccgctgccctcaaagagtacctgccggttggtcccgcggtgatgaatctgaaggtcgagaactatcctccagaaatgatgtgtatggcattcgggtcgctcattcccacagccggagtgtcagaggctaccactaaaacattaatggaagcctacagcctgtggcaggatgcatttaccaagacgatcaatgtaaagatgaggggcgctagtaaaactgaggtttataactccttccgggaccctcttcacgccgcggtcaattctgtgtttttcccaaacgatgtgcgcgtgaagtggttgaaagccaagggcatactggggcccgacggagtccctagcagagcagctgaagttgccgctgccgcatacaggaatctatga

SEQ ID NO: 6245 - RNA, 738 nt, synthetic construct
  misc_feature 1..738: note = derived and/or modified CDS sequence (opt3) from SFTSV(2015SH232S)__KT736097.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacagccggagtctcagaggctaccactaaaacattaatggaagcctacagcctgtggcaggatgcatttaccaagacgataaatgtgaagatgaggggcgctagtaaaactgaggtatataactccttccgggaccctcttcacgccgcggttaattctgtgtttttcccaaacgatgtccgcgtgagatggttgaaggccaaaggcatcctggggcccgacggagtgcctagcagggcagctgaagtcgccgctgccgcataccggaatctatga

SEQ ID NO: 6246 - RNA, 738 nt, synthetic construct
  misc_feature 1..738: note = derived and/or modified CDS sequence (opt3) from SFTSV(2015SYSH33)__KT380653.1__N
  source 1..738: mol_type = other RNA
atgagcgagtggtccagaatcgccgtggagttcggcgaacagcaactcaaccttaccgaactggaggactttgctagggaattggcatacgaggggttagatcccgccctgattataaagaaactaaaggagacaggaggtgacgattgggtcaaagacactaagttcatcattgtttttgcgctcacgcggggcaataaaatcgtgaaggcttctgggaagatgtcaaacagtggaagcaaacgcctgatggcccttcaggaaaagtatggcctggtagagcgagcagaaacccgtttgtccattacacctgtgagagtcgcccagtctctcccaacttggacctgcgctgcagccgctgccctgaaagagtacctgccggtgggtcccgcggttatgaatctcaaggtggagaactatcctccagaaatgatgtgtatggcattcgggtcgttaatccccacagccggagtctcagaggctaccactaaaacactgatggaagcctacagcctttggcaggatgcatttaccaagacgataaatgtgaagatgaggggcgctagtaaaactgaggtatataactccttccgggaccctttgcacgccgcggttaattctgtgtttttcccaaacgatgtccgcgtgaagtggctgaaagccaagggcatcctagggcccgacggagtgcctagcagagcagctgaagtcgccgctgccgcatacaggaatctctga

SEQ ID NO: 6247 - RNA, 738 nt, synthetic construct
  misc_feature 1..738: note = derived and/or modified CDS sequence (opt3) from SFTSV(2015SYSH86)__KT380657.1__N
  source 1..738: mol_type = other RNA
atgagcgagtggtccagaatcgccgtggaatttggcgagcagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcattaaggcttctgggaagatgtcaaacagtggaagcaaacgcctcatggccctgcaggaaaagtatggccttgtggagcgagcagaaacccgtctgtccatcacacctgtaagagtggcccagtctttgccaacttggacctgcgctgcagccgctgccctcaaagagtacctgccggtcggtcccgcggtgatgaatctgaaggttgagaactatcctccagaaatgatgtgtatggcattcgggtcgctcatacccacagccggagtgtcagaggctaccactaaaacattaatggaagcctacagcctgtggcaggatgcatttaccaagacgatcaatgtcaagatgaggggcgctagtaaaactgaggtgtataactccttccgggaccctcttcacgccgcggtaaattctgttttcttcccaaacgatgtgcgcgtcaagtggttgaaagccaagggcattctggggcccgacggagtgcctagcagagcagctgaagtggccgctgccgcatacaggaatctatga

SEQ ID NO: 6248 - RNA, 738 nt, synthetic construct
  misc_feature 1..738: note = derived and/or modified CDS sequence (opt3) from SFTSV(67S)__KP339890.1__N
  source 1..738: mol_type = other RNA
atgagcgagtggtccagaatcgccgtggagttcgctgaacagcaactgaacctcaccgaacttgaggactttgcaagggaactggcctacgagggcttggatcccgcgttaattataaagaaactgaaggagacagggggagacgattgggtcaaagacactaagttcatcattgtttttgctctaacgcggggtaataaaatcgtgaaggcctctggcaagatgtcaaacagtgggagcaaacgcctcatggcactgcaggaaaagtatggacttgtagagcgagccgaaacccgtctgtccattacacctgtgagagtcgctcagtctttgccaacttggacctgcgcagccgctgccgcgctcaaagagtacctgccggtgggccccgcagttatgaatctgaaggtggagaactatcctccagaaatgatgtgtatggccttcggttcgctcatccccacagctggggtctcagaggccaccactaaaacattaatggaagcatacagcctgtggcaggatgcttttaccaagacgataaatgtgaagatgaggggagccagtaaaactgaggtatataactccttccgggaccctcttcacgcggccgttaattctgtgtttttcccaaacgatgtccgcgtgaagtggttgaaagcaaagggcatcctgggccccgacggggtgcctagcagagctgccgaagtcgctgccgcagcctacaggaatctatga

SEQ ID NO: 6249 - RNA, 738 nt, synthetic construct
  misc_feature 1..738: note = derived and/or modified CDS sequence (opt3) from SFTSV(6S)__KP339927.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtttctccattacacctgtgagagtcgcccagtctctgccaacttggacctgcgctgcagccgctgccttgaaagagtacctcccggtgggtcccgcggttatgaatctgaaggtggagaactatcctccagaaatgatgtgtatggcatttgggtcgctgatccccacagccggagtctcagaggctaccactaaaacactcatggaagcctacagcttatggcaggatgcattcaccaagacgataaatgtgaagatgaggggcgctagtaaaactgaggtatataactcctttcgggaccctctgcacgccgcggttaattctgtgttctttccaaacgatgtccgcgtgaagtggcttaaagccaagggcatcttggggcccgacggagtgcctagcagagcagctgaagtcgccgctgccgcatacaggaatctgtga

SEQ ID NO: 6250 - RNA, 738 nt, synthetic construct
  misc_feature 1..738: note = derived and/or modified CDS sequence (opt3) from SFTSV(72S)__KP339891.1__N
  source 1..738: mol_type = other RNA
atgagcgagtggtccagaatcgccgtggagttcggcgaacagcaactgaccctcacagaacttgaggactttgctagggaactggcatacgaggggttggatcccgccttaattataaagaaactgaaggagactggaggtgacgattgggtcaaagacacgaagttcatcattgtttttgcgctaacccggggcaacaaaatcgtgaaggcttctgggaagatgtcaaatagtggaagcaaacgcctcatggccctgcaggaaaagtatggccttgtagagcgagcagaaacacgtctgtccattactcctgtgagagtcgcccagtctttgccaacctggacatgcgctgcagccgctgccctcaaagagtacctgccggtgggtcccgcggttatgaacctgaaggtggagaattatcctccagaaatgatgtgtatggcattcgggtcgctcatccccaccgccggagtctcagaggctactacaaaaaccttaatggaagcctacagcctgtggcaggatgcatttacgaagactataaacgtgaagatgaggggcgctagtaaaaccgaggtatataattccttccgggaccctcttcacgccgcggttaactctgtgtttttcccaaatgatgtccgcgtgagatggttgaaggccaaaggcatcctggggcccgacggagtgcctagcagggcagctgaagtcgccgctgccgcataccggaacctatga

SEQ ID NO: 6251 - RNA, 738 nt, synthetic construct
  misc_feature 1..738: note = derived and/or modified CDS sequence (opt3) from SFTSV(AP01-Korea-13)__KR612072.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtccgggacactaaattcatcattgtttttgcgctaacgcgcggcaataagatcgtgaaggcttctgggaaaatgtcaaacagtggaagcaagcgactcatggccctgcaggaaaaatatggccttgtagagcgtgcagaaaccagactgtccattacacctgtgagggtcgcccagtctttgccaacttggacctgcgctgcagccgctgccctcaaggagtacctgccggtgggtcccgcggttatgaatctgaaagtggagaactatcctccagaaatgatgtgtatggcattcgggtcgctcatccccacagccggagtctcagaggctaccactaagacattaatggaagcctacagcctgtggcaggatgcatttaccaaaacgataaatgtgaagatgcggggcgctagtaagactgaggtatataactccttccgcgaccctcttcacgccgcggttaattctgtgtttttcccaaacgatgtcagagtgaaatggttgaaggccaaaggcatcctggggcccgacggagtgcctagcagggcagctgaagtcgccgctgccgcataccggaatctatga

SEQ ID NO: 6252 - RNA, 738 nt, synthetic construct
  misc_feature 1..738: note = derived and/or modified CDS sequence (opt3) from SFTSV(JP03-Korea-13)__KR612079.1__N
  source 1..738: mol_type = other RNA
atgagcgagtggtccagaatcgccgtggagttcggagaacagcaactgaacctcaccgaacttgaggactttgctagggaactggcatacgaggggttggatcccgccttaattataaagaaactgaaggagacaggaggtgacgattgggtccgggacactaaattcatcattgtttttgcgctaacgcgcggcaataagatcgtgaaggcttctgggaaaatgtcaaacagtggaagcaagcgactcatggccctgcaggaaaaatatggccttgtagagcgtgcagaaaccagactgtccattacacctgtgagggtcgcccagtctttgccaacttggacctgcgctgcagccgctgccctcaaggagtacctgccggtgggtcccgcggttatgaatctgaaagtggagaactatcctccagaaatgatgtgtatggcattcgggtcgctcatccccacagccggagtctcagaggctaccactaagacattaatggaagcctacagcctgtggcaggatgcatttaccaaaacgataaatgtgaagatgcggggcgctagtaagactgaggtatataactccttccgcgaccctcttcacgccgcggttaattctgtgtttttcccaaacgatgtcagagtgaaatggttgaaggccaaaggcatcctggggcccgacggcattcctagcagggcagctgaagtggccgctgccgcataccggaatctatga

SEQ ID NO: 6253 - RNA, 738 nt, synthetic construct
  misc_feature 1..738: note = derived and/or modified CDS sequence (opt3) from SFTSV(JP07-Korea-13)__KR612088.1__N
  source 1..738: mol_type = other RNA
atgagcgagtggtccagaatcgccgtggagttcggcgaacaccagctgaacctcaccgaacttgaggactttgctagggaactggcatacgaggggttggatcccgccttaattataaagaaactgaaggagacaggaggtgacgattgggtccgggacactaaattcatcattgtttttgcgctaacgcgcggcaataagatcgtgaaggcttctgggaaaatgtcaaacagtggaagcaagcgactcatggccctgcaagaaaaatatggccttgtagagcgtgcagaaaccagactgtccattacacctgtgagggtcgcccagtctttgccaacttggacctgcgctgcagccgctgccctcaaggagtacctgccggtgggtcccgcggttatgaatctgaaagtggagaactatcctccagaaatgatgtgtatggcattcgggtcgctcatccccacagccggagtctcagaggctaccactaagacattaatggaagcctacagcctgtggcaggatgcatttaccaaaacgataaatgtgaagatgcggggcgctagtaagactgaggtatataactccttccgcgaccctcttcatgccgcggttaattctgtgtttttcccaaacgatgtcagagtgaaatggttgaaggccaaaggcatcctggggcccgacggagtgcctagcagggcagctgaagtcgccgctgccgcataccggaatctatga

SEQ ID NO: 6254 - RNA, 738 nt, synthetic construct
  misc_feature 1..738: note = derived and/or modified CDS sequence (opt3) from SFTSV(JS2011-13-2)__KR230790.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaagtagcggatccaaacgcctcatggccctgcaggaaaagtatggccttgtagagcgagcagaaacccgtctgtctattacacctgtgagagtcgcccagtcgttgccaacttggacctgcgctgcagccgctgccctcaaagagtacctgccggtgggtcccgcggttatgaacctgaaggtggagaattatcctccagaaatgatgtgtatggcattcgggtcactcatccccacagccggagtcagcgaggctaccactaaaacattaatggaagcctacagtctgtggcaggatgcatttaccaagacgataaacgtgaagatgaggggcgcttccaaaactgaggtatataattctttccgggaccctcttcacgccgcggttaacagcgtgtttttcccaaatgatgtccgcgtgaagtggttgaaagccaagggcatcctggggcccgacggagtgccttccagagcagctgaagtcgccgctgccgcatacaggaacctatga

SEQ ID NO: 6255 - RNA, 738 nt, synthetic construct
  misc_feature 1..738: note = derived and/or modified CDS sequence (opt3) from SFTSV(JS2014-15)__KR230799.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccattacacctgtgagagtcgcccagtctttgccaacttggacctgcgctgcagccgctgccctcaaagagtacctgctggtgggtccggcggttatgaatctcaaggtggagaactatccccctgaaatgatgtgtatggcattcgggtcgttaatcccaacagccggagtctcagaggctaccactaaaacactgatggaagcctacagcctttggcaggatgcatttaccaagacgataaatgtgaagatgaggggcgctagtaaaactgaggtatataactccttccgggaccccttgcacgccgcggttaattctgtgtttttccctaacgatgtccgcgtgaagtggctgaaagccaagggcatcctagggccagacggagtgcccagcagagcagctgaagtcgccgctgccgcatacaggaatctctga

SEQ ID NO: 6256 - RNA, 738 nt, synthetic construct
  misc_feature 1..738: note = derived and/or modified CDS sequence (opt3) from SFTSV(KASJH)__KP663733.1__N
  source 1..738: mol_type = other RNA
atgagcgagtggtccagaatcgccgtggagttcggcgaacagcaactgaacctctctgaacttgaggactttgctagggaactggcatacgaggggttggatcccgccttaattataaagaaactgaaggagaccggaggtgacgattgggtcaaagacacaaagttcatcattgtttttgcgctaactcggggcaataaaatcgtgaaggcttcagggaagatgagtaacagcggatccaaacgcctcatggccctgcaggaaaagtatggccttgtagagcgagcagaaacgcgtctgtctattacccctgtgagagtcgcccagtcgttgccaacatggacttgcgctgcagccgctgccctcaaagagtacctgccggtgggtcccgcggttatgaatctgaaggtggagaactatcctccagaaatgatgtgtatggcattcgggtcactcatccccaccgccggagtcagcgaggctacaaccaaaactttaatggaagcctacagtctgtggcaggatgcatttacaaagaccataaatgtgaagatgaggggcgcttccaaaacggaggtatataactctttccgggaccctcttcacgccgcggttaatagcgtgtttttcccaaacgatgtccgcgtgaagtggttgaaagccaagggcatcctggggcccgacggagtgccttccagagcagctgaagtcgccgctgccgcatacaggaatctatga

SEQ ID NO: 6257 - RNA, 738 nt, synthetic construct
  misc_feature 1..738: note = derived and/or modified CDS sequence (opt3) from SFTSV(YSH116)__KT721303.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacagccggagtctcagaggctaccactaaaacattaatggaagcctacagcctgtggcaggatgtgtttaccaagacgataaatgtaaagatgaggggcgcaagtaaaactgaggtttataactccttccgggaccctcttcacgctgccgtcaattctgtgtttttcccaaacgatgtgcgcgtgaagtggttgaaagcgaagggcatcctggggcccgacggagtccctagcagagccgcagaagttgctgccgctgcctacaggaatctatga

SEQ ID NO: 6258 - RNA, 738 nt, synthetic construct
  misc_feature 1..738: note = derived and/or modified CDS sequence (opt3) from SFTSV(AH-YTY/China/05/2012)__KR017811.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacaaccggagtctcagaggccactacaaaaaccttaatggaggcttacagcctgtggcaggatgcctttacgaagactataaatgtgaagatgaggggcgcaagtaaaaccgaagtatataactccttccgggaccctcttcacgctgccgttaattctgtgtttttcccaaacgatgtccgcgtgaagtggttgaaagcgaagggcatcctggggcccgacggagtgcctagcagagccgcagaagtcgctgccgctgcctacaggaatctatga

SEQ ID NO: 6259 - RNA, 738 nt, synthetic construct
  misc_feature 1..738: note = derived and/or modified CDS sequence (opt3) from SFTSV(DS02/CHN/2013)__KR698319.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtccgggacactaaattcatcattgtttttgcgctaacgcgcggcaataagatcgtgaaggcttctgggaaaatgtcaaacagtggaagcaagcgactcatggccctgcaggaaaaatatggccttgtagagaaggcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacagccggagtctcagaggctaccactaaaacattaatggaagcctacagcctgtggcaggatgcatttaccaagacgataaatgtgaagatgaggggcgctagtaaaactgaggtatataactccttccgggaccctcttcacgccgcggttaattctgtgtttttcccaaacgatgtccgcgtgaagtggttgaaagccaagggcatcctggggcccgacggagtgcctagcagagcagctgaagtcgccgctgccgcatacaggaatctatga

SEQ ID NO: 6260 - RNA, 738 nt, synthetic construct
  misc_feature 1..738: note = derived and/or modified CDS sequence (opt3) from SFTSV(HB2014-13)__KU738908.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacaaccggagtctcagaggccactacaaaaaccttaatggaggcttacagcctgtggcaggatgcctttacgaagactataaatgtgaagatgaggggcgcaagtaaaaccgaagtatataactccttccgggaccctcttcacgctgccgttaattctgtgtttttcccaaacgatgtccgcgtgagatggttgaaggcgaaaggcatcctggggcccgacggagtgcctagcagggccgcagaagtcgctgccgctgcctaccggaatctatga

SEQ ID NO: 6261 - RNA, 738 nt, synthetic construct
  misc_feature 1..738: note = derived and/or modified CDS sequence (opt3) from SFTSV(HB2014-20)__KU738910.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatgaccctgcaggaaaagtatggccttgtagagcgagccgaaacacgtctgtccattactcctgtgagagtcgcacagtctttgccaacctggacatgcgccgctgcagccgctctcaaagagtacctgccggtgggtcccgccgttatgaatctgaaggtggagaactatcctccagaaatgatgtgtatggcgttcgggtcgctcatccccaccgcaggagtctcagaggccactacaaaaaccttaatggaggcttacagcctgtggcaggatgcctttacgaagactataaatgtgaagatgaggggcgcaagtaaaaccgaagtatataactccttccgggaccctcttcacgctgccgttaattctgtgtttttcccaaacgatgtccgcgtgaagtggttgaaagcgaagggcatcctggggcccgacggagtgcctagcagagccgcagaagtcgctgccgctgcctacaggaatctatga

SEQ ID NO: 6262 - RNA, 738 nt, synthetic construct
  misc_feature 1..738: note = derived and/or modified CDS sequence (opt3) from SFTSV(LN2012-14)__KF887431.1__N
  source 1..738: mol_type = other RNA
atgagcgagagatccaggatcgccgtggagttcggcgaacagcaactgaacctcaccgggcttgaagactttgctcgggagctggcatacgaaggattggatcccgccttaattataaagaaactgaaggagacaggtggcgacgattgggtcaaagacactaagttcatcattgtttttgcgctaacgcgcgggaataaaatcgtgaaggcttctggaaagatgtcaaacagtggcagcaaacgactcatggccctgcaggagaagtatggtcttgtagaacgtgcagagaccagactgtccattacacctgtgagggtcgcccagtctttgccaacttggacctgcgctgcagccgctgccctcaaagaatacctgccggtggggcccgcggttatgaatctgaaggtggagaactatcctccagagatgatgtgtatggcattcggatcgctcatccccacagccggcgtctcagaagctaccactcggacattaatggaggcctacagcctgtggcaggatgcatttaccaaaacgataaatgtgaagatgcgcggcgctagtaagactgaagtatataactccttcagagaccctcttcacgccgcggttaattctgtgtttttcccaaacgatgtcagggtgaaatggttgaaggccaaagggatcctgggacccgacggtgtgcctagccgggcagctgaggtcgccgctgccgcataccgcaatctatga

SEQ ID NO: 6263 - RNA, 738 nt, synthetic construct
  misc_feature 1..738: note = derived and/or modified CDS sequence (opt3) from SFTSV(NB31/CHN/2013)__KR698325.1__N
  source 1..738: mol_type = other RNA
atgagcgagtggtccagaatcgccgtggagttcggcgaacagcaactgaacctcattgaacttgaggactttgctagggaactggcatacgaggggttggatcccgccttaataatcaagaaactgaaggagaccggaggtgacgattgggtccgggacacaaaattcattatcgtttttgcgctaactcgcggcaataagattgtgaaggcttctgggaaaatgtcaaacagtggaagcaagcgactcatggccctgcaggaaaaatatggccttgtagagaaggcagaaacgcgtctgtccatcacccctgtgagagtcgcccagtctttgccaacatggacttgcgctgcagccgctgccctcaaagagtacctgccggtgggtcccgcggttatgaatctgaaggtggagaactatcctccagaaatgatgtgtatggcattcgggtcgctcatacccaccgccggagtctcaaaacctacaaccaagactttaatggaggcttacagcctgtggcaggatgcctttacaaagaccatcaatgtgaaaatgaggggcgcaagtaagacggaagtatataactccttccgggacccacttcacgctgccgttaattctgtgtttttccccaacgatgtccgcgtgaaatggttgaaggcgaaaggcattctggggcctgacggagtgccaagcagagccgcagaggtcgctgccgctgcctacaggaatctatga

SEQ ID NO: 6264 - RNA, 738 nt, synthetic construct
  misc_feature 1..738: note = derived and/or modified CDS sequence (opt3) from SFTSV(QD7)__KR706565.1__N
  source 1..738: mol_type = other RNA
atgagcgagtggtccagaatcgccgtggagttcggcgtccagcaactgaacctcaccgaacttgaagactttgctagggagctggcatacgaagggttggatcccgccttaattataaagaaactgaaggagacaggaggtgacgattgggttaaagacactaagttcatcattgtgtttgcgctaacgcggggcaataaaatcgtaaaggcttctgggaagatgtcaaacagtggaagcaaacgcctcatggccctgcaggagaagtatggccttgtggaacgagcagagacccgtctgtccattacacctgtcagagtggcccagtctttgccaacttggacctgcgctgcagccgctgccctcaaagaatacctgccggttggtcccgcggtgatgaatctgaaggtcgagaactatcctccagagatgatgtgtatggcattcgggtcgctcatccccacagccggagtgtcagaagctaccactaaaacattaatggaggcctacagcctgtggcaggatgcatttaccaagacgataaatgtaaagatgaggggcgctagtaaaactgaagtttataactccttccgggaccctcttcacgccgcggtcaattctgtgtttttcccaaacgatgtgcgcgtgaagtggttgaaagccaagggcatcctggggcccgacggagtccctagcagagcagctgaggttgccgctgccgcatacaggaatctatga

SEQ ID NO: 6265 - RNA, 738 nt, synthetic construct
  misc_feature 1..738: note = derived and/or modified CDS sequence (opt3) from SFTSV(SDLZP06/2011)__JQ693009.1__N
  source 1..738: mol_type = other RNA
atgagcgagtggtccagaaccgccgtggagttcggcgaacagcaactgaacctcacagaacttgaggactttgctagggaactggcatacgaggggttggatcccgccttaatcattaagaaactgaaggagactggaggtgacgattgggtcaaagacacgaagttcataatcgtttttgcgctaacccggggcaataaaattgtgaaggcttctgggaagatgtcaaacagtggaagcaaacgcctcatggccctgcaggaaaagtatggccttgtagagcgagcagaaacacgtctgtccatcactcctgtgagagtcgcccagtctttgccaacctggacatgcgctgcagccgctgccctcaaagagtacctgccggtgggtcccgcggttatgaatctgaaggtggagaactatcctccagaaatgatgtgtatggcattcgggtcgctcattcccaccgccggagtctcagaggctactacaaaaaccttaatggaagcctacagcctgtggcaggatgcatttacgaagactatcaatgtgaagatgaggggcgctagtaaaaccgaggtatataactccttccgggaccctcttcacgccgcggttaattctgtgtttttcccaaacgatgtccgcgtgaagtggttgaaagccaagggcatactggggcccgacggagtgcctagcagagcagctgaagtcgccgctgccgcatacaggaatctatga

SEQ ID NO: 6266 - RNA, 738 nt, synthetic construct
  misc_feature 1..738: note = derived and/or modified CDS sequence (opt3) from SFTSV(ZJZHSH-FDE/China/06/2012)__KR017821.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtccgggacactaaattcatcattgtttttgcgctaacgcgcggcaataagatcgtgaaggcttctgggaaaatgtcaaacagtggaagcaagcgactcatggccctgcaggaaaaatatggccttgtagagaaggcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacagccggagtctcagaggctaccactaaaacattaatggaagcctacagcctgtggcaggatgcatttaccaagacgataaatgtgaagatgaggggcgctagtaaaactgaggtatataactccttccgggaccctcttcacgccgcggttaattctgtgttgtttccaaacgatgtccgcgtgaagtggctgaaagccaagggcatcctagggcccgacggagtgcctagcagagcagctgaagtcgccgctgccgcatacaggaatctctga

SEQ ID NO: 6267 - RNA, 738 nt, synthetic construct
  misc_feature 1..738: note = derived and/or modified CDS sequence (opt3) from SFTSV(ZJZHSH-FZHR/China/07/2013)__KR017824.1__N
  source 1..738: mol_type = other RNA
atgagcgagtggtccagaatcgccgtggaatttggcgagcagcaactgaacctcaccgaacttgaggactttgctagggaactggcatacgaggggttggatcccgccttaattataaagaaactgaaggagacaggaggtgacgattggatgaaagacactaagttcatcattgtctttgcgctaacgcggggcaataaaatcgttaaggcttctgggaagatgtcaaacagtggaagcaaacgcctcatggccctgcaggaaaagtatggccttgtggagcgagcagaaacccgtctgtccattacacctgtaagagtggcccagtctttgccaacttggacctgcgctgcagccgctgccctcaaagagtacctgccggtcggtcccgcggtgatgaatctgaaggttgagaactatcctccagaaatgatgtgtatggcattcgggtcgctcatccccacagccggagtgtcagaggctaccactaaaacattaatggaagcctacagcctgtggcaggatgcatttaccaagacgataaatgtcaagatgaggggcgctagtaaaactgaggtgtataactccttccgggaccctcttcacgccgcggtaaattctgttttcttcccaaacgatgtgcgcgtcaagtggttgaaagccaagggcatcctggggcccgacggagtgcctagcagagcagctgaagtggccgctgccgcatacaggaatctatga

SEQ ID NO: 6268 - RNA, 738 nt, synthetic construct
  misc_feature 1..738: note = derived and/or modified CDS sequence (opt3) from SFTSV(ZJZHSH-HYC/China/05/2012)__KR017809.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtccgggacactaaattcatcattgtttttgcgctaacgcgcggcaataagatcgtgaaggcttctgggaaaatgtcaaacagtggaagcaagcgactcatggccctgcaggaaaaatatggccttgtagagaaggcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacagtcggagtgtcagaggccaccactaaaacattaatggaggcttacagcctgtggcaggatgcctttaccaagacgataaatgtaaagatgaggggcgcaagtaaaactgaagtttataactccttccgggaccctcttcacgctgccgtcaattctgtgtttttcccaaacgatgtgcgcgtgaagtggttgaaagcgaagggcatcctggggcccgacggagtccctagcagagccgcagaagttgctgccgctgcctacaggaatctatga

SEQ ID NO: 6269 - RNA, 738 nt, synthetic construct
  misc_feature 1..738: note = derived and/or modified CDS sequence (opt3) from SFTSV(SPL003A)__AB817996.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtccgggacactaaattcatcattgtttttgcgctaacgcgcggcaataagatcgtgaaggcttctgggaaaatgtcaaacagtggaagcaagcgactcatggccctgcaggaaaaatatggccttgtagagcgtgcagaaaccagactgtccattacacctgtgagggtcgcccagtctttgccaacttggacctgcgctgcagccgctgccctcaaggagtacctgccggtgggtcccgcggttatgaatctgaaagtggagaactatcctccagaaatgatgtgtatggcattcgggtcgctcatccccacagccggagtctcagaggctaccactaagacattaatggaagcctacagcctgtggcaggatgcatttaccaaaacgataaatgtgaagatgcggggcgctagtaagactgaggtatataactccttccgcgaccctcttcacgccgcggttaattctgtgtttttcccaaacgatgtcagagtgaaatggttgaaggccaaaggcatcctggggcccgacggagcacctagcagggctgccgaagtggctgccgcagcctaccggaatctatga

SEQ ID NO: 6270 - RNA, 738 nt, synthetic construct
  misc_feature 1..738: note = derived and/or modified CDS sequence (opt3) from SFTSV(SPL077A)__AB985536.1__N
  source 1..738: mol_type = other RNA
atgagcgagtggcccagaatcgccgtggagttcggcgaacagcaactgaacctcaccgaacttgaggactttgctagggaactggcatacgaggggttggatcctgccttaattataaagaaactgaaggagacaggaggtgacgattgggtccgggacactaaattcatcattgtttttgcgctaacgcgcggcaataagatcgtgaaggcttccgggaaaatgtctaactcaggaagtaagcgactcatggccctgcaggaaaaatatggccttgtagagcgtgcagaaaccagactgagcattacaccagtgagggtcgcccagtccttgccgacttggacctgcgctgcagccgctgccctcaaggagtacctgcccgtgggtcctgcggttatgaatctgaaagtggagaactatccacccgaaatgatgtgtatggcattcgggtctctcatccctacagccggagtctcggaggctaccactaagacattaatggaagcctactcactgtggcaggatgcatttaccaaaacgataaatgtgaagatgcggggcgctagcaagactgaggtatataacagtttccgcgacccacttcacgccgcggttaattccgtgtttttccccaacgatgtcagagtgaaatggttgaaggccaaaggcatcctggggcctgacggagtgccatctagggcagctgaagtcgccgctgccgcataccggaatctatga

SEQ ID NO: 6271 - RNA, 738 nt, synthetic construct
  misc_feature 1..738: note = derived and/or modified CDS sequence (opt3) from SFTSV(SPL106A)__AB985548.1__N
  source 1..738: mol_type = other RNA
atgagcgactggtccagaatcgccgtggagttcggcgaacagcaactgaacctcaccgagcttgaagattttgctagggagctggcatacgaagggttggaccccgccttaattataaagaaactgaaggagacaggaggtgatgactgggtccgggatactaaattcatcattgtttttgcgctaacgcgcggcaataagatcgtgaaggcttctgggaaaatgtcaaacagtggaagcaagcgactcatggccctgcaggagaaatatggccttgtagaacgtgcagagaccagactgtccattacacctgtgagggtcgcccagtctttgccaacttggacctgcgctgcagccgctgccctcaaggaatacctgccggtgggtcccgcggttatgaatctgaaagtggagaactatcctccagagatgatgtgtatggcattcgggtcgctcatccccacagccggagtctcagaagctaccactaagacattaatggaggcctacagcctgtggcaggacgcatttaccaaaacgataaatgtgaagatgcggggcgctagtaagactgaagtatataactccttccgcgatcctcttcacgccgcggttaattctgtgtttttcccaaacgacgtcagagtgaaatggttgaaggccaaaggcatcctggggcccgatggagtgcctagcagggcagctgaggtcgccgctgccgcataccggaatctatga

SEQ ID NO: 6272 - RNA, 738 nt, synthetic construct
  misc_feature 1..738: note = derived and/or modified CDS sequence (opt3) from SFTSV(SPL114A)__AB985552.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtccgggacactaaattcatcattgtttttgcgctaacgcgcggcaataagatcgtgaaagctcctgggaagatgtctaactcaggaagtaagcgactcatggccctgcaggaaaaatatggccttgtagagcgtgcagaaaccagactgagcattacaccagtgagggtcgcccagtccttgccgacttggacctgcgctgcagccgctgccctcaaggagtacctgcccgtgggtcctgcggttatgaatctgaaagtggagaactatccacccgaaatgatgtgtatggcattcgggtctctcatccctacagccggagtctcggaggctaccactaagacattaatggaagcctactcactgtggcaggatgcatttaccaaaacgataaatgtgaagatgcggggcgctagcaagactgaggtatataacagtttccgcgacccacttcacgccgcggttaattccgtgtttttccccaacgatgtcagagtgaaatggttgaaggccaaaggcatcctggggcctgacggagtgccatctagggcagctgaagtcgccgctgccgcataccggaatctatga

SEQ ID NO: 6273 - RNA, 738 nt, synthetic construct
  misc_feature 1..738: note = derived and/or modified CDS sequence (opt3) from SFTSV(SPL125A)__AB985557.1__N
  source 1..738: mol_type = other RNA
atgagcgagtggtccggcgtggccgtcgagttcggggaacagcaactgaacctcaccgaacttgaggactttgctagagaactggcatacgagggattggatcccgccttaatcattaagaaactgaaggagacaggtggcgacgattgggttagggacactaaattcataatcgtgtttgcgctaacgcgggggaataagattgtaaaggcttctggaaaaatgtcaaacagtggcagcaagcgcctcatggccctgcaggaaaaatatggtcttgtggagcgagcagaaacccgtctgtccatcacacctgtcagagtggcccagtctttgccaacttggacctgcgctgcagccgctgccctcaaggagtacctgccggttgggcccgcggtgatgaatctgaaagtcgagaactatcctccagaaatgatgtgtatggcattcggatcgctcattcccacagccggcgtgtcagaggctaccactaagacattaatggaagcctacagcctgtggcaggatgcatttaccaaaacgatcaatgtaaagatgaggggcgctagtaagactgaggtttataactccttccgggaccctcttcacgccgcggtcaattctgtgtttttcccaaacgatgtgcgcgtgaaatggttgaaggccaaagggatactgggacccgacggtgtccctagcagagcagctgaagttgccgctgccgcatacaggaatctatga

SEQ ID NO: 6274 - RNA, 738 nt, synthetic construct
  misc_feature 1..738: note = derived and/or modified CDS sequence (opt3) from SFTSV(SPL160A)__AB985571.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataacaaagctgaaagagactggaggtgacgattgggtccgggacacgaagttcatcattgtttttgcgctaacccgcggcaataaaatcgtgaaggcttctgggaaaatgtcaaacagtggaagcaagcgactcatggccctgcaggaaaagtatggccttgtagagcgtgcagaaacaagactgtccattactcctgtgagggtcgcccagtctttgccaacctggacatgcgctgcagccgctgccctcaaagagtacctgccggtgggtcccgcggttatgaatctgaaggtggagaactatcctccagaaatgatgtgtatggcattcgggtcgctcatccccaccgccggagtctcagaggctactacaaaaaccttaatggaagcctacagcctgtggcaggatgcatttacgaagactataaatgtgaaaatgcggggcgctagtaagaccgaggtatataactccttccgcgaccctcttcacgccgcggttaattctgtgtttttcccaaacgatgtcagagtgaagtggttgaaagccaagggcatcctggggcccgacggagtgcctagcagggcagctgaagtcgccgctgccgcataccggaatctatga

SEQ ID NO: 6275 - RNA, 738 nt, synthetic construct
  misc_feature 1..738: note = derived and/or modified CDS sequence (opt3) from SFTSV(SPL163A)__AB985573.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtccgggacactaaattcatcattgtttttcctctaacgcgcggcaataagatcgtgaaagcgtctgggaagatgtcaaacagtggaagcaagcgactcatggctctgcaggaaaaatatggccttgtagagcgtgccgaaaccagactgtccattacaccagtgagggtcgcacagtctttgccgacttggacctgcgccgctgcagccgctctcaaggagtacctgcccgtgggtcctgccgttatgaatctgaaagtggagaactatccacccgaaatgatgtgtatggcgttcgggtcgctcatccctacagcaggagtctcagaggccaccactaagacattaatggaggcttacagcctgtggcaggatgcctttaccaaaacgataaatgtgaagatgcggggcgcaagtaagactgaagtatataactccttccgcgacccacttcacgctgccgttaattctgtgtttttccccaacgatgtcagagtgaaatggttgaaggcgaaaggcatcctggggcctgacggagtgccaagcagggccgcagaagtcgctgccgctgcctaccggaatctatga

SEQ ID NO: 6276 - RNA, 738 nt, synthetic construct
  misc_feature 1..738: note = derived and/or modified CDS sequence (opt3) from SFTSV/FTLSV(2011YPQ12)__KF711915.1__N
  source 1..738: mol_type = other RNA
atgagcaagtggtccagaatcgccgtggagttcggcgaacagcaactgaacctcaccgagcttgaagactttgctagggagctggcatacgaagggttggatcccgccttaattatcaaaaagctgaaagagacaggaggtgacgattgggtcaaggacactaaattcataattgtttttgcgctaacgcggggcaataagatcgtgaaggcttctgggaaaatgtcaaacagtggaagcaagcgcctcatggccctgcaggagaaatatggccttgtagaacgagcaaagacccgtctgtccattacacctgtgagagtcgcccagtctttgccaacttggacctgcgctgcagccgctgccctcaaagagtacctgccggtgggtcccgcggttatgaatctgaaggtggaaaactatcctccagagatgatgtgtatggcattcgggtcgctcatccccacagccggagtctcagaggctaccactaagacattaatggaagcctacagcctgtggcaggatgcatttaccaaaacgataaatgtgaagatgaggggcgctagtaaaactgaggtatataactccttccgggaccctcttcacgccgcggttaattctgtgtttttcccaaacgatgtccgcgtgaagtggttgaaagccaagggcatcctggggcccgacggagtgcctagcaaagcagctgaagtcgccgctgccgcatacagaaatctatga

SEQ ID NO: 6277 - RNA, 738 nt, synthetic construct
  misc_feature 1..738: note = derived and/or modified CDS sequence (opt3) from SFTSV/FTLSV(2011YXX9)__KF711898.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacagccggagtctcagaggctaccactaaaacattagtggaagcctacagcctgtggcaggatgcatttaccaagacgataaatgtaaagatgaggggcgctagtaaaactgaggtttataactccttccgggaccctcttcacgccgcggtcaattctgtgtttttcccaaacgatgtgcgcgtgaagtggttgaaagccaagggcatcctggggcccgacggagtccctagcagagcagctgaagttgccgctgccgcatacaggaatctatga

SEQ ID NO: 6278 - RNA, 738 nt, synthetic construct
  misc_feature 1..738: note = derived and/or modified CDS sequence (opt3) from SFTSV/FTLSV(YPQ2)__KF356519.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacagccggagtctcagaggctaccactaaaacattaatggaagcctacagcctgtggcaggatgcatttaccaagacgataaatgtgaagatgaggggcgctagtaaaactgaggtatataactccttccgggaccctcttcacgccgcggttaattctgtgtttttcccaaacgatgtccgcgtgaagtggttgaaagccaagggcatcctggggcccaatggagtgcctagcagagcagctgaagtcgccgctgccgcatacaggaacctatga

SEQ ID NO: 6279 - RNA, 738 nt, synthetic construct
  misc_feature 1..738: note = derived and/or modified CDS sequence (opt3) from SFTSV/Guertu virus(DXM)__KT328591.1__N
  source 1..738: mol_type = other RNA
atgagcgagtggtccaagatcgccgtggagttcggcgaacagcaactgaacgtcattgaactcgaggaatttgctagagagcttgcatacgaggggctggaccccgccttgataatcaaaaagttaaaagaagttggaggtgatgactggatgagggataccaagttcattatcgtgtttgcgctgacacggggcaataaaattctaaaggctgccgggaagatgtctaactcaggaagtaaacgcatcatggcactccaggagaagtatggcctggtagaacgagccgagactcgtcttagcataacgcctgtgagagtcgctcagtccctgccaacctggacatgctctgcagccgctgccttgcaggagtacctcccggtgggtcccgcggttatgtcgctgaaagtgtcaaatttccctccagaaatgatgtgtatggcatttgggagcctgatccccgccactggagtccctgagagtaccacaaagattctcatggaggcttattccttatggcaagacgccttcaccaaaactatcaacgtgaagatgaggggcgcatctaaggctgaagtatacaatagctttcgggatccactgcacgccgcggttaactccgtgttctttcccaatgacgtccgccttagatggttgaaatcaaagggcattctggggcctgatggactaccaagtaaagccgtggaaacagcagctgccgcttataggaacctctga

SEQ ID NO: 6280 - RNA, 738 nt, synthetic construct
  misc_feature 1..738: note = derived and/or modified CDS sequence (opt3) from SFTSV/Huaiyangshan virus(2010-FQM)__HQ419240.1__N
  source 1..738: mol_type = other RNA
atgagcgagtggtccagaatcgccgtgaagttcggcgaacagcaactgaacctcaccgagcttgaagactttgctagggagctggcatacgaagggttggatcccgccttaattatcaaaaagctgaaagagacaggaggtgacgattgggtcaaggacactaaattcataattgtttttgcgctaacgcggggcaataagatcgtgaaggcttctgggaaaatgtcaaacagtggaagcaagcgcctcatggccctgcaggagaaatatggccttgtagaacgagcagagacccgtctgtccattacacctgtgagagtcgcccagtctttgccaacttggacctgcgctgcagccgctgccctcaaggaatacctgccggtgggtcccgcggttatgaatctgaaagtggagaactatcctccagagatgatgtgtatggcattcgggtcgctcatccccacagccggagtctcagaagctaccactaagacattaatggaggcctacagcctgtggcaggatgcatttaccaagacgataaatgtgaaaatgaggggcgctagtaagactgaagtatataactccttccgggaccctcttcacgccgcggttaattctgtgtttttgccaaacgatgtccgcgtgaaatggctgaaggccaaaggcatcctagggcccgacggagtgcctagcagagcagctgaggtcgccgctgccgcatacaggaatctctga

SEQ ID NO: 6281 - RNA, 738 nt, synthetic construct
  misc_feature 1..738: note = derived and/or modified CDS sequence (opt3) from SFTSV/Huaiyangshan virus(2010-ZGQ)__HQ419241.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatgtccctgcaggaaaagtatggccttgtagagcgagccgaaacccgtctgtctattacacctgtgagagtcgcacagtcgttgccaacttggacctgcgccgctgcagccgctctcaaagagtacctgccggtgggtcccgccgttatgaatctgaaggtggagaactatcctccagaaatgatgtgtatggcgttcgggtcactcatccccacagcaggagtcagcgaggccaccactaggacattaatggaggcttacagtctgtggcaggatgcctttaccaaaacgataaatgtgaagatgcggggcgcatccaagactgaagtatataactctttccgcgaccctcttcacgctgccgttaatagcgtgtttttcccaaacgatgtcagagtgaaatggttgaaggcgaaaggcatcctggggcccgacggagtgccttccagggccgcagaagtcgctgccgctgcctaccggaatctatga

SEQ ID NO: 6282 - RNA, 738 nt, synthetic construct
  misc_feature 1..738: note = derived and/or modified CDS sequence (opt3) from SFTSV/Huaiyangshan virus(S-HGX)__HQ171192.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccattacacctgtgagagtcgcccagtctttgccaacttggacctgcacagctgcagccgctctcaaagagtacctgccggtgggtcccgccgttatgaatctgaaggtggagaactatcctccagaaatgatgtgtatggcgttcgagtcgctcatccccaccgcaggggtctcagaagccactacaaaaaccttaatggaggcttacagcctgtggcaggatgcctttacgaagactataaatgtggaaatgaggggagcaagtaagaccgaggtatataactccttccgggaccctcttcacgctgccgttaattctgtgtttttcccaaacgatgtccgcgtgaaatggttgaaggcgaaaggcatcctgggccccgacggggtgcctagcagagccgcagaggtcgctgccgctgcctacaggaatctatga

SEQ ID NO: 6283 - RNA, 738 nt, synthetic construct
  misc_feature 1..738: note = derived and/or modified CDS sequence (opt3) from SFTSV/Huaiyangshan virus(S-HZM)__HQ171193.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactgagttcatcattgtttttgcgctaacgcggggcaataagatcgtgaaggcttctgggaaaatgtcaaacagtggaagcaagcgcctcatggccctgcaggaaaaatatggccttgtagaacgagcagagacccgtctgtccattacacctgtgagagtcgcccagtctttgccaacttggacctgcgctgcagccgctgccctcaaggagtacctgccggtgggtcccgcggttatgaatctgaaagtggaaaactatcctccagagatgatgtgtatggcattcgggtcgctcatccccacaaccggagtctcagaagccactacaaagaccttaatggaggcttacagcctgtggcaggatgcctttacgaaaactataaatgtgaagatgaggggcgcaagtaagaccgaagtatataactccttccgggaccctcttcacgctgccgttaattctgtgtttttcccaaacgatttgcgcgtcaaatggctgaaggcgaaaggcatcctagggcccgacggagtgcctagcagagccgcagaggtggctgccgctgcctacaggaatctctga

SEQ ID NO: 6284 - RNA, 738 nt, synthetic construct
  misc_feature 1..738: note = derived and/or modified CDS sequence (opt3) from SFTSV/Huaiyangshan virus(S-WJ)__HQ171191.1__N
  source 1..738: mol_type = other RNA
atgagcgagtggtccagaatcgccgtggagttcggcgaacagcaactgaacctcaccgaacttgaggactttgctagggaactggcatacgaggggttgggacccgccttaattataaagaaactgaaggagacaggtggcgatgactgggtcaaagatactaagttcatcattgtttttgcgctaacgcgggggaataaaatcgtgaaggcttctggaaagatgtcaaacagtggcagcaaacgcctcatggccctgcaggaaaagtatggtcttgtagagcgagcagaaacccgtctgtccattacacctgtgagagtcgcccagtctttgccaacttggacctgcgctgcagccgctgccctcaaagagtacctgccggtggggcccgcggttatgaatctgaaggtggagaactatcctccagaaatgatgtgtatggcattcggatcgctcatccccacagccggcgtctcagaggctaccactaaaacattaatggaagcctacagcctgtggcaggacgcatttaccaagacgataaatgtgaagatgaggggcgctagtaaaactgaggtatataactccttccgggatcctcttcacgccgcggttaattctgtgtttttcccaaacgacgtccgcgtgaagtggttgaaagccaaggggatcctgggacccgatggtgtgcctagcagagcagctgaagtcgccgctgccgcatacaggaatctatga

SEQ ID NO: 6285 - RNA, 738 nt, synthetic construct
  misc_feature 1..738: note = derived and/or modified CDS sequence (opt3) from SFTSV/Phlebovirus(JS2010-019)__JQ317180.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacagccggagtctcagaggctaccactaaaacattaatggaagcctacagcctgtggcaggatgcatttaccaagacgataaatgtgaagatgaggggcgctagtaaaactgaggtatataactccttccgggaccctcttcacgccgcggttaattctgtgtttttcccaaacgatgtccgcgtgaagtggttgaaagccaagggcatcctggggcccgacggagtgcctagcagagcagctgaagccgctgccgcagcctacaggaatctatga

SEQ ID NO: 6286 - RNA, 738 nt, synthetic construct
  misc_feature 1..738: note = derived and/or modified CDS sequence (opt3) from SFTSV/Phlebovirus(SD24/China/2010 strain SD24)__HM802205.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacagccggagtcaccgaggctactacaaaaaccttaatggaagcctactcactgtggcaggatgcatttacgaagactataaatgtgaagatgaggggcgctagcaaaaccgaggtatataacagtttccgggaccctcttcacgccgcggttaattccgtgtttttcccaaacgatgtccgcgtgaagtggttgaaagccaagggcatcctggggcccgacggagtgccttctagagcagctgaagtcgccgctgccgcatacaggaatctatga

SEQ ID NO: 6287 - RNA, 738 nt, synthetic construct
  misc_feature 1..738: note = derived and/or modified CDS sequence (opt3) from SFTSV/Phlebovirus(ZJ1/China/2011)__HE663216.1__N
  source 1..738: mol_type = other RNA
atgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtccgggacactaaattcatcattgtttttgcgctaacgcgcggcaataagatcgtgaaggcttctgggaaaatgtcaaacagtggaagcaagcgactcatggccctgcaggaaaaatatggccttgtagagaaggcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacagccggagtctcagaggctaccactaaagccttaatggaagcatacagcctgtggcaggatgcttttacaaagaccataaatgtgaagatgaggggcgccagtaaaacggaggtatattcctctttccgggaccctcttcacgcggccgttaacagcgtgtttttcccaaatgatgtccgcgtgaagtggttgaaagcaaagggcatcctggggcccgacggagtgccttccagagctgccgaagtcgctgccgcagcctacaggaacctatga

SEQ ID NO: 6288 - RNA, 1287 nt, synthetic construct
  misc_feature 1..1287: note = derived and/or modified CDS sequence (opt1) from ANDV(Chile-9717869)__AF291702.1__N
  source 1..1287: mol_type = other RNA
atgagcaccctgcaggagctccaggagaacatcaccgcccacgagcagcagctggtgacggcccgccagaagctgaaggacgcggagaaggccgtcgaggtggaccccgacgacgtgaacaagtccaccctccagagccggcgcgccgccgtctccaccctggagaccaagctgggcgagctcaagcggcagctggccgacctggtggcggcccagaagctcgccacgaagccggtggaccccaccgggctggagcccgacgaccacctgaaggagaagtccagcctccgctacggcaacgtcctggacgtgaacagcatcgacctggaggagccctccgggcagaccgccgactggaaggcgatcggcgcctacatcctcgggttcgccatcccgatcatcctgaaggccctgtacatgctcagcacccggggccgccagacggtgaaggacaacaagggcacccggatccgcttcaaggacgactccagcttcgaggaggtcaacgggatccggaagcccaagcacctgtacgtgtccatgcccaccgcccagagcaccatgaaggcggaggagatcacgcccggccgcttccggaccatcgcctgcgggctgttcccggcccaggtgaaggcccgcaacatcatctcccccgtcatgggcgtgatcgggttcggcttcttcgtgaaggactggatggaccggatcgaggagttcctcgccgcggagtgccccttcctgcccaagccgaaggtcgccagcgaggccttcatgtccaccaacaagatgtacttcctgaaccgccagcgccaggtgaacgagagcaaggtgcaggacatcatcgacctcatcgaccacgccgagaccgagtccgccacgctgttcaccgagatcgcgacgccccacagcgtctgggtgttcgcctgcgcccccgaccggtgcccgcccaccgccctgtacgtggccggcgtccccgagctcggggcgttcttctccatcctgcaggacatgcggaacaccatcatggccagcaagagcgtgggcaccgccgaggagaagctgaagaagaagtccgccttctaccagagctacctccgccggacccagtccatggggatccagctggaccagaagatcatcatcctgtacatgctcagctggggcaaggaggcggtgaaccacttccacctgggcgacgacatggaccccgagctgcgccagctcgcccagtccctgatcgacaccaaggtcaaggagatcagcaaccaggagcccctgaagctctga

SEQ ID NO: 6289 - RNA, 1287 nt, synthetic construct
  misc_feature 1..1287: note = derived and/or modified CDS sequence (opt1) from ANDV(Nort)__AF325966.1__N
  source 1..1287: mol_type = other RNA
atgagcaccctgcaggagctccaggagaacatcaccgcccacgagcagcagctggtgacggcccgccagaagctgaaggacgcggagaagaccgtcgaggtggaccccgacgaggtgaacaagtccaccctccagagccggcgcgccgccgtctccaccctggagacgaagctgggcgagctcaagcggcagctggccgacctggtggccgcgcagaagctcgccaccaagccggtggaccccaccgggctggagcccgacgaccacctgaaggagaagtccagcctccgctacggcaacgtcctggacgtgaacagcatcgacctggaggagccctccgggcagaccgccgactggaaggccatcggcgcgtacatcctcgggttcgccatcccgatcatcctgaaggccctgtacatgctcagcacgcggggccgccagaccgtgaaggacaacaagggcacccggatccgcttcaaggacgactccagcttcgaggaggtcaacgggatccggaagcccaagcacctgtacgtgtccatgcccaccgcccagagcacgatgaaggccgaggagatcacccccggccgcttccggaccatcgcgtgcgggctgttcccggcccaggtgaaggcccgcaacatcatctcccccgtcatgggcgtgatcgggttcagcttcttcgtgaaggactggatggagcggatcgaggacttcctcgccgccgagtgccccttcctgcccaagccgaaggcgctgtccgaggccttcatggccaccaacaaggcctacttcctcaaccgccagcggcaggtcaacgacagcaaggtgcaggacatcgtggacctgatcgaccacgccgagatcgagtccgcgacgctgttcaccgacatcgccacgccccacagcgtctgggtgttcgcctgcgcccccgaccgctgcccgcccaccgccctctacgtggcgggcgtccccgagctgggcgccttcttcgccatcctgcaggacatgcggaacaccatcatggcctccaagagcgtggggaccgcggaggagaagctcaagaagaagtccgccttctaccagagctacctgcgccggacccagtacatgggcatccagctggaccagaagatcatcatcctctacatgctgagctgggggaaggaggccgtgaaccacttccacctgggcgacgacatggaccccgagctccgccagctggcccagtccctgatcgacaccaaggtcaaggagatcagcaaccaggagcccctcaagctgtga

SEQ ID NO: 6290 - RNA, 1287 nt, synthetic construct
  misc_feature 1..1287: note = derived and/or modified CDS sequence (opt1) from ANDV(CHI-7913)__AY228237.1__N
  source 1..1287: mol_type = other RNA
atgagcaccctgcaggagctccaggagaacatcaccgcccacgagcagcagctggtgacggcccgccagaagctgaaggacgcggagaaggccgtcgaggtggaccccgacgacgtgaacaagtccaccctccagaaccggcgcgccgccgtcagcaccctggagaccaagctgggcgagctcaagcggcagctggccgacctggtggcggcccagaagctcgccacgaagccggtggaccccaccgggctggagcccgacgaccacctgaaggagaagtccagcctccgctacggcaacgtcctggacgtgaactccatcgacctggaggagcccagcgggcagaccgccgactggaaggcgatcggcgcctacatcctcgggttcgccatcccgatcatcctgaaggccctgtacatgctctccacccggggccgccaggccgtgaaggacaacaagggcacgcggatccgcttcaaggacgacagctccttcgaggaggtcaacgggatccggaagcccaagcacctgtacgtgagcatgcccaccgcgcagtccaccatgaaggccgaggagatcacccccggccgcttccggacgatcgcctgcgggctgttcccggcccaggtgaaggcccgcaacatcatcagccccgtcatgggcgtgatcgggttcggcttcttcgtgaaggactggatggaccggatcgaggagttcctcgcggccgagtgccccttcctgcccaagccgaaggtcgcctccgaggccttcatgagcaccaacaagatgtacttcctgaaccgccagcgccaggtgaacgagtccaaggtgcaggacatcatcgacctcatcgaccacgccgagaccgagagcgcgaccctgttcacggagatcgccacgccccactccgtctgggtgttcgcctgcgcccccgaccggtgcccgcccaccgccctgtacgtggcgggcgtccccgagctcggggccttcttcagcatcctgcaggacatgcggaacaccatcatggcctccaagagcgtgggcaccgccgaggagaagctgaagaagaagtccgcgttctaccagagctacctccgccggacccagagcatggggatccagctggaccagaagatcatcatcctgtacatgctctcctggggcaaggaggccgtgaaccacttccacctgggcgacgacatggaccccgagctgcgccagctcgcccagagcctgatcgacaccaaggtcaaggagatctccaaccaggagcccctgaagctctga

SEQ ID NO: 6291 - RNA, 1287 nt, synthetic construct
  misc_feature 1..1287: note = derived and/or modified CDS sequence (opt1) from ANDV(9718133)__AF482712.1__N
  source 1..1287: mol_type = other RNA
atgagcaccctgcaggagctccaggagaacatcaccgcccacgagcagcagctggtgacggcccgccagaagctgaaggacgcggagaaggccgtcgaggtggaccccgacgacgtgaacaagtccaccctccagaaccggcgcgccgccgtcagcaccctggagaccaagctgggcgagctcaagcggcagctggccgacctggtggcggcccagaagctcgccacgaagccggtggaccccaccgggctggagcccgacgaccacctgaaggagaagtccagcctccgctacggcaacgtcctggacgtgaactccatcgacctggaggagcccagcgggcagaccgccgactggaaggcgatcggcgcctacatcctcgggttcgccatcccgatcatcctgaaggccctgtacatgctctccacccggggccgccagacggtgaaggacaacaagggcacccggatccgcttcaaggacgacagctccttcgaggaggtcaacgggatccggaagcccaagcacctgtacgtgagcatgcccaccgcccagtccaccatgaaggcggaggagatcacgcccggccgcttccggaccatcgcctgcgggctgttcccggcccaggtgaaggcccgcaacatcatcagccccgtcatgggcgtgatcgggttcggcttcttcgtgaaggactggatggaccggatcgaggagttcctcgccgcggagtgccccttcctgcccaagccgaaggtcgcctccgaggccttcatgagcaccaacaagatgtacttcctgaaccgccagcgccaggtgaacgagtccaaggtgcaggacatcatcgacctcatcgaccacgccgagaccgagagcgccacgctgttcaccgagatcgcgacgccccactccgtctgggtgttcgcctgcgcccccgaccggtgcccgcccaccgccctgtacgtggccggcgtccccgagctcggggcgttcttcagcatcctgcaggacatgcggaacaccatcatggcctccaagagcgtgggcaccgccgaggagaagctgaagaagaagtccgccttctaccagagctacctccgccggacccagagcatggggatccagctggaccagaagatcatcatcctgtacatgctctcctggggcaaggaggcggtgaaccacttccacctgggcgacgacatggaccccgagctgcgccagctcgcccagagcctgatcgacaccaaggtcaaggagatctccaaccaggagcccctgaagctctga

SEQ ID NO: 6292 - RNA, 1278 nt, synthetic construct
  misc_feature 1..1278: note = derived and/or modified CDS sequence (opt1) from Araraquara virus(9480)__KP202360.1__N
  source 1..1278: mol_type = other RNA
atgagcaacctgcaggagctccaggagaacatcaccgcccacgagcagcagctggtgaccgcccgccagaagctgaaggacgcggagaaggccgtcgacgtggaccccgacgaggtgaacaagtccacgctccagggccggcgcgccgccgtcagcaccctggagaccaagctgggggagctcaagcggcagctggccgacctggtggcggcccagcgcctcgcctccaagccggtggaccccaccggcatcgagcccgacgaccacctgaaggagaagtccagcctgcggtacgggaacgtcctcgacgtgaacagcatcgacctggaggagccctccggccagacggccgactggaaggcgatcggggcctacatcctgggcttcgccatcccgatcatcctcaaggccctgtacatgctgagcacccgcggccggcagaccgtgaaggacaacaaggggacccgcatccggttcaaggacgactccagcttcgaggaggtcaacggcatccgcaagcccaagcacctctacatctccatgcccacggcccagagcaccatgaaggcggaggagatcacccccgggcggttccgcaccatcgcctgcggcctgttcccggcccaggtgaaggcccggaacatcatctcccccgtgatgggggtcatcggcttcgccttcttcgtgaaggactggatggagcgcatcgaggacttcctggcgagcgagtgccccttcctccccaagccgaagaacccctccgaggccttcatggccacgaacaaggcctacttcctgaaccggcagaagcaggtcgacgagagccaggtgcccgacatcgtggacctgatcgaccacgccgaggcggagtccgccaccctcttcaaggagatcgccagcccccactccgtgtgggtcttcgcctgcgccccggaccgctgcccgcccaccgcgctgtacgtggccggcatgcccgagctgggggccttcttcgccatcctccaggacatgcggaacaccatcatggcgagcaagagcgtgggcacggccgaggagaagctgaagaagaagtccgccttctaccagagctacctgcgccggacccagtccatggggatccagctcgaccagaagatcatcatcctgtacatgctgagctggggcaaggaggccgtcaaccacttccacctcggcgacgacatggaccccgagctgcgccagctggcccagtccctcatcgacaccaaggtgaaggagagccagaccaagtccctgtga

SEQ ID NO: 6293 - RNA, 1287 nt, synthetic construct
  misc_feature 1..1287: note = derived and/or modified CDS sequence (opt1) from Araraquara-like virus(P5/Cajuru)__EF571895.1__N
  source 1..1287: mol_type = other RNA
atgagcaacctgcaggagctccaggagaacatcaccgcccacgagcagcagctggtgaccgcccgccagaagctgaaggacgcggagaaggccgtcgacgtggaccccgacgaggtgaacaagtccacgctccagggccggcgcgccgccgtcagcaccctggagaccaagctgggggagctcaagcggcagctggccgacctggtggcggcccagcgcctcgcctccaagccggtggaccccaccggcatcgagcccgacgaccacctgaaggagaagtccagcctgcggtacgggaacgtcctcgacgtgaaccccatcgacctggaggagccgagcggccagacggccgactggaaggcgatcggggcctacatcctgggcttcgccatccccatcatcctcaaggccctgtacatgctgtccacccgcggccggcagaccgtgaaggacaacaaggggacccgcatccggttcaaggacgacagctccttcgaggaggtcaacggcatccgcaagcccaagcacctctacatcagcatgcccacggcccagtccaccatgaaggcggaggagatcaccccggggcggttccgcaccatcgcctgcggcctgttccccgcccaggtgaaggcccggaacatcatcagccccgtgatgggggtcatcggcttcggcttcttcgtgaaggactggatggagcgcatcgaggacttcctggcctccgagtgccccttcctcccgaagcccaagaaccccagcgaggcgttcatggccacgaacaaggcctacttcctgaaccggcagaagcaggtcgacgagtcccaggtgcccgacatcgtggacctgatcgaccacgccgaggccgagagcgcgaccctcttcaaggagatcgcctccccgcacagcgtgtgggtcttcgcctgcgcccccgaccgctgcccgcccaccgccctgtacgtggcggggctgcccgagctcggcgccttcttcgccatcctgcaggacatgcggaacaccatcatggcctccaagagcgtggggacggcggaggagaagctgaagaagaagtccgccttctaccagagctacctccgccggacccagagcatgggcatccagctggaccagaagatcatcatcctgtacatgctctcctggggcaaggaggccgtcaaccacttccacctgggggacgacatggaccccgagctgcgccagctcgcccagagcctgatcgacaccaaggtgaaggagatctccaaccagggccccctgaagctctga

SEQ ID NO: 6294 - RNA, 1287 nt, synthetic construct
  misc_feature 1..1287: note = derived and/or modified CDS sequence (opt1) from BMJV(Oc22531)__AF482713.1__N
  source 1..1287: mol_type = other RNA
atgagcaccctgcaggagctccaggagaacatcaccgcccacgagcagcagctggtgacggcccgccagaagctgaaggacgcggagaagaccgtcgaggtggaccccgacgaggtgaacaagtccaccctccagagccggcgcgccgccgtctccaccctggagacgaagctgggcgagctcaagcggcagctggccgacctggtggccgcgcagaagctcgccaccaagccggtggaccccaccgggctggagcccgacgaccacctgaaggagaagtccagcctccgctacggcaacgtcctggacgtgaacagcatcgacctggaggagccctccgggcagaccgccgactggcggagcatcggcgcctacatcctcgggttcgcgatcccgatcatcctgaaggccctgtacatgctctccacgcgcggccggcagaccgtgaaggacaacaagggcacccgcatccggttcaaggacgacagctccttcgaggaggtcaacgggatccgcaagcccaagcacctgtacgtgagcatgcccaccgcccagtccacgatgaaggccgaggagatcacccccggccggttccgcaccatcgcctgcgggctgttcccggcccaggtgaaggcgcggaacatcatcagccccgtcatgggcgtgatcgggttctccttcttcgtgaaggactggatggagcgcatcgaggacttcctcgccgccgagtgccccttcctgcccaagccgaaggcccccagcgaggcgttcatggccaccaacaaggcctacttcctgaaccggcagcgccaggtcaacgagtccaaggtgcaggacatcgtggacctcatcgaccacgccgagacggagagcgccaccctgttcaccgacatcgcgacgccccactccgtctgggtgttcgcctgcgcccccgaccggtgcccgcccaccgccctgtacgtggccggcgtccccgagctcggcgcgttcttcgccatcctgcaggacatgcgcaacaccatcatggccagcaagagcgtggggaccgccgaggagaagctgaagaagaagtccgcgttctaccagagctacctccggcgcacccagtccatgggcatccagctggaccagaagatcatcatcctgtacatgctcagctgggggaaggaggccgtgaaccacttccacctgggcgacgacatggaccccgagctgcggcagctcgcccagtccctgatcgacacgaaggtcaaggagatcagcaaccaggagccgctgaagctctga

SEQ ID NO: 6295 - RNA, 1287 nt, synthetic construct
  misc_feature 1..1287: note = derived and/or modified CDS sequence (opt1) from LECV(22819)__AF482714.1__N
  source 1..1287: mol_type = other RNA
atgagcaccctgcaggagctccaggagaacatcaccgcccacgagcagcagctggtgacggcccgccagaagctgaaggacgcggagaagaccgtcgaggtggaccccgacgaggtgaacaagtccaccctccagagccggcgcgccgccgtctccaccctggagacgaagctgggcgagctcaagcggcagctggccgacctggtggccgcgcagaagctcgccaccaagccggtggaccccaccgggctggagcccgacgaccacctgaaggagaagtccagcctccgctacggcaacgtcctggacgtgaacagcatcgacctggaggagccctccgggcagaccgccgactggcggagcatcggcgcctacatcctcgggttcgcgatcccgatcatcctgaaggccctgtacatgctctccacgcgcggccggcagaccgtgaaggacaacaagggcacccgcatccggttcaaggacgacagctccttcgaggaggtcaacgggatccgcaagcccaagcacctgtacgtgagcatgcccaccgcccagtccacgatgaaggccgaggagatcacccccggccggttccgcaccatcgcctgcgggctgttcccggcccaggtgaaggcgcggaacatcatcagccccgtcatgggcgtgatcgggttctccttcttcgtgaaggactggatggagcgcatcgaggacttcctcgccgccgagtgccccttcctgcccaagccgaaggcccccagcgaggcgttcatggccaccaacaaggcctacttcctgaaccggcagcgccaggtcaacgagtccaaggtgcaggagatcgtggacctcatcgaccacgccgagacggagagcgccaccctgttcaccgacatcgcgacgccccactccgtctgggtgttcgcctgcgcccccgaccggtgcccgcccaccgccctgtacgtggccggcgtccccgagctcggcgcgttcttcgccatcctgcaggacatgcgcaacaccatcatggccagcaagagcgtggggaccgccgaggagaagctgaagaagaagtccgcgttctaccagagctacctccggcgcacccagtccatgggcatccagctggaccagaagatcatcatcctgtacatgctcagctgggggaaggaggccgtgaaccacttccacctgggcgacgacatggaccccgagctgcggcagctcgcccagtccctgatcgacacgaaggtcaaggagatcagcaaccaggagccgctgaagctctga

SEQ ID NO: 6296 - RNA, 1287 nt, synthetic construct
  misc_feature 1..1287: note = derived and/or modified CDS sequence (opt1) from MCLV(13796)__AF482716.1__N
  source 1..1287: mol_type = other RNA
atgagcaacctgcaggagctccaggagaacatcaccgcccacgagcagcagctggtgaccgcccgccagaagctgaaggacgcggagaaggccgtcgacgtggaccccgacgaggtgaacaagtccacgctccagggccggcgcgccgccgtcagcaccctggagaccaagctgggggagctcaagcggcagctggccgacctggtggcggcccagaagctcgccaccaagccggtggaccccacgggcatcgagcccgacgaccacctgaaggagaagtccagcctgcgctacgggaacgtcctcgacgtgaactccatcgacctggaggagcccagcggccagaccgccgactggaaggcgatcggggcctacatcctgggcttcgccatcccgatcatcctcaaggccctgtacatgctgtccacccggggccgccagaccgtgaaggacaacaaggggacgcggatccgcttcaaggacgacagctccttcgaggaggtcaacggcatccggaagcccaagcacctctacatcagcatgcccaccgcccagtccaccatgaaggcggaggagatcacccccgggcgcttccggacgatcgtgtgcggcctgttcccggcccaggtgaaggcccgcaacatcatcagccccgtcatgggggtgatcggcttctccttcttcgtgaaggactggatggagcggatcgagggcttcctggccgccgagtgccccttcctccccaagccgaagaccgcggccgagaccttcatggccaccaacaaggcctacttcttcaaccgccagcggcaggtcgacgagagccaggtgcccgacatcgtggagctgatcgaccaggccgagtccgagagcgcgacgctgttcaccgagatcgccagcccccacagcgtctgggtgttcgcctgcgcccccgaccgctgcccgcccaccgccctctacgtggcgggggtccccgagctgggcgccttcttcgccatcctgcaggacatgcggaacaccatcatggcctccaagagcgtggggacggcggaggagaagctcaagaagaagtccgccttctaccagtcctacctgcgccggacccagagcatgggcatccagctggaccagaagatcatcatcctctacatgctgtcctggggcaaggaggccgtgaaccacttccacctgggggacgacatggaccccgagctccgccagctggcccaggccctgatcgacaccaaggtcaaggagatcagcaaccaggagccgctcaagctgtga

SEQ ID NO: 6297 - RNA, 1287 nt, synthetic construct
  misc_feature 1..1287: note = derived and/or modified CDS sequence (opt1) from Neembucu(Neembucu)__DQ345763.1__N
  source 1..1287: mol_type = other RNA
atgagcaccctgcaggagctccaggagaacatcaccgcccacgagcagcagctggtgacggcccgccagaagctgaaggacgcggagaagaccgtcgaggtggaccccgacgaggtgaacaagtccaccctccagagccggcgcgccgccgtctccaccctggagacgaagctgggcgagctcaagcggcagctggccgacctggtggccgcgcagaagctcgccacccgcccggtggaccccaccgggctggagcccgacgaccacctgaaggagaagtccagcctccggtacggcaacgtcctggacgtgaacagcatcgacctggaggagccctccgggcagaccgccgactggcgcagcatcggcgcctacatcctcgggttcgcgatcccgatcatcctgaaggccctgtacatgctctccacgcggggccgccagaccgtgaaggacaacaagggcacccggatccgcttcaaggacgacagctccttcgaggaggtcaacgggatccggaagcccaagcacctgtacgtgagcatgcccaccgcccagtccacgatgaaggccgaggagatcacccccggccgcctgcggaccatcgcctgcggcctcttcccggcccaggtgaaggcgcgcagcatcatctcccccgtcatgggggtgatcgggttcagcttcttcgtgaaggactggatggagcggatcgaggacttcctggccgccgagtgccccttcctgcccaagccgaaggccccctccgaggcgttcatggccaccaacaaggcctacttcctcaaccgccagcggcaggtcaacgagagcaaggtgcaggacatcgtggacctgatcgaccacgccgagacggagtccgccaccctgttcaccgacatcgcgacgccccacagcgtctgggtgttcgcctgcgcccccgaccgctgcccgcccaccgccctctacgtggccggcgtccccgagctgggcgcgttcttcgccatcctgcaggacatgcggaacaccatcatggccagcaagtccgtggggaccgccgaggagaagctcaagaagaagtccgcgttctaccagagctacctgcgccggacccagagcatgggcatccagctggaccagaagatcatcatcctctacatgctgtcctgggggaaggaggccgtgaaccacttccacctgggcgacgacatggaccccgagctccgccagctggcccagagcctgatcgacacgaaggtcaaggagatctccaaccaggagccgctcaagctgtga

SEQ ID NO: 6298 - RNA, 1287 nt, synthetic construct
  misc_feature 1..1287: note = derived and/or modified CDS sequence (opt1) from ORNV(22996)__AF482715.1__N
  source 1..1287: mol_type = other RNA
atgagcaccctgcaggagctccaggagaacatcaccgcccacgagcagcagctggtgacggcccgccagaagctgaaggacgcggagaagaccgtcgaggtggaccccgacgaggtgaacaagtccaccctccagagccggcgcgccgccgtctccaccctggagacgaagctgggcgagctcaagcggcagctggccgacctggtggccgcgcagaagctcgccaccaagccggtggaccccaccgggctggagcccgacgaccacctgaaggagaagtccagcctccgctacggcaacgtcctggacgtgaacagcatcgacctggaggagccctccgggcagaccgccgactggaaggccatcggcgcgtacatcctcgggttcgccatcccgatcatcctgaaggccctgtacatgctcagcacgcggggccgccagaccgtgaaggacaacaagggcacccggatccgcttcaaggacgactccagcttcgaggaggtcaacgggatccggaagcccaagcacctgtacgtgtccatgcccaccgcccagagcacgatgaaggccgaggagatcacccccggccgcttccggaccatcgcgtgcgggctgttcccggcccaggtgaaggcccgcaacatcatctcccccgtcatgggcgtgatcgggttcagcttcttcgtgaaggactggatggagcggatcgaggacttcctcgccgccgagtgccccttcctgcccaagccgaaggcgctgtccgaggccttcatggccaccaacaaggcctacttcctcaaccgccagcggcaggtcaacgacagcaaggtgcaggacatcgtggacctgatcgaccacgccgagatcgagtccgcgacgctgttcaccgacatcgccacgccccacagcgtctgggtgttcgcctgcgcccccgaccgctgcccgcccaccgccctctacgtggcgggcgtccccgagctgggcgccttcttcgccatcctgcaggacatgcggaacaccatcatggcctccaagagcgtggggaccgcggaggagaagctcaagaagaagtccgccttctaccagagctacctgcgccggacccagagcatgggcatccagctggaccagaagatcatcatcctctacatgctgtcctgggggaaggaggccgtgaaccacttccacctgggcgacgacatggaccccgagctccgccagctggcccagagcctgatcgacaccaaggtcaaggagatctccaaccaggagcccctcaagctgtga

SEQ ID NO: 6299 - RNA, 1287 nt, synthetic construct
  misc_feature 1..1287: note = derived and/or modified CDS sequence (opt1) from PRGV(14403)__AF482717.1__N
  source 1..1287: mol_type = other RNA
atgagcaccctgcaggagctccaggagaacatcaccgcccacgagcagcacctggtgacggcccgccagaagctgaaggacgcggagaagaccgtcgaggtggaccccgacgaggtgaacaagtccaccctccagagccggcgcgccgccgtctccaccctggagacgaagctgggcgagctcaagcggcagctggccgacctggtggccgcgcagaagctcgccgccaagccggtggaccccaccgggctggagcccgacgaccacctgaaggagaagtccagcctccgctacggcaacgtcctggacgtgaacagcatcgacctggaggagccctccgggcagaccgccgactggaaggcgatcggcgcctacatcctcgggttcgccatcccgatcatcctgaaggccctgtacatgctcagcacccggggccgccagacggtgaaggacaacaagggcacccggatccgcttcaaggacgactccagcttcgaggaggtcaacgggatccggaagcccaagcacctgtacgtgtccatgcccaccgcccagagcaccatgaaggcggaggagatcacgcccggccgcttccggaccatcgcctgcgggctgttcccggcccaggtgaaggcccgcaacatcatctcccccgtcatgggcgtgatcgggttcagcttcttcgtgaaggactggatggagcggatcgaggacttcctcgccgcggagtgccccttcctgcccaagccgaagaccacctccgaggccttcatgagcacgaacaaggcctacttcctgaaccgccagcggcaggtcgacgagtcccaggtgcccgacatcgccgagctcatcgagcaggccgagagcgagtccgcgaccctgttcaccgagatcgccagcccccacagcgtgtgggtcttcgcctgcgcccccgaccgctgcccgcccaccgccctgtacgtggcgggcgtgcccgagctcggcgccttcttcgccatcctgcaggacatgcggaacacgatcatggcctccaagagcgtcgggaccgcggaggagaagctgaagaagaagtccgccttctaccagagctacctccgccggacccagtccatgggcatccagctggaccagaagatcatcatcctgtacatgctcagctgggggaaggaggccgtgaaccacttccacctgggcgacgacatggaccccgagctgcgccagctcgcccaggccctgatcgacaccaaggtgaaggagatctccaaccaggagccgctgaagctctga

SEQ ID NO: 6300 - RNA, 1287 nt, synthetic construct
  misc_feature 1..1287: note = derived and/or modified CDS sequence (opt1) from TUNV(FVB554)__JF750419.1__N
  source 1..1287: mol_type = other RNA
atgagcaacctgcaggagctccaggagaacatcaccgcccacgagcagcagctggtgaccgcccgccagaagctgaaggacgcggagaaggccgtcgagatggaccccgacgacgtgaacaagtccacgctccagagccggcgcgccgccgtgtccaccctggagaccaagctgggcgagctcaagcggcagctggccgacatggtcgcggcccagaagctggccaccaagccggtggaccccacggggctcgagcccgacgaccacctgaaggagaagtccagcctgcgctacggcaacgtgctcgacgtcaacagcatcgacctggaggagccctccgggcagaccgccgactggaagtccatcggcgcgtacatcctggggttcgccatcccgatcatcctcaaggccctgtacatgctgagcacccggggccgccagaccgtgaaggacaacaagggcacgcggatccgcttcaaggacgacagctccttcgaggaggtgaacgggatccggaagcccaagcacctctacgtcagcatgcccaccgcccagtccaccatgaaggccgaggagatcacccccggccgcttccggacgatcgcgtgcgggctgttcccggcccaggtgaaggcccgcaacatcatcagccccgtgatgggcgtcatcgggttctccttcttcgtgaaggactggatggagcggatcgaggacttcctggccgacgagtgccccttcctccccaagcccaagagcccctccgaggccttcatggcgaccaacaaggcctacttcctgaaccgccagcgccaggtgaacgacagcaaggtccaggacatcgtggacctgatcgaccacgccgagaccgagtccgccaccctcttcacggacatcgccaccccgcacagcgtgtgggtcttcgcgtgcgcccccgaccggtgcccgcccaccgccctgtacgtggccggcgtgcccgagctgggcgccttcttcgcgatcctccaggacatgcggaacaccatcatggccagcaagtccgtcgggacggccgaggagaagctgaagaagaagtccgccttctaccagagctacctgcgccggacccagagcatgggcatccagctcgaccagaagatcatcatcctgtacatgctgtcctgggggaaggaggcggtgaaccacttccacctcggcgacgacatggaccccgagctgcgccagctggcccaggccctcatcgacaccaaggtgaaggagatcagcaaccaggagccgctgaagctgtga

SEQ ID NO: 6301 - RNA, 1287 nt, synthetic construct
  misc_feature 1..1287: note = derived and/or modified CDS sequence (opt1) from BCCV(BCCV)__AB689163.1__N
  source 1..1287: mol_type = other RNA
atgagcaacctgaaggaggtgcaggacaacatcaccacccacgagcagcagctcgtcgccgcccgccagaagctgaaggacgcggagcggacggtgggcgtggaccccgacgacgtcaacaagtccaccctgcagaaccgccgggccgccgtgagcgccctcgaggccaagatcggggagctgaagcgccagctggcggacctcgtggccgcccagaagctggccaccaagtccgtcgacccgaccggcatcgagcccgacgaccacctgaaggagaagtccagcctccggtacgggaacgtgctggacgtgaacagcatcgacctggaggagccctccggccagacggcggactggaaggccatcgggacctacatcctcagcttcgtcctgcccatcgtgctgaaggccctctacatgctgtccacccgcggccggcagaccgtgaaggagaacaagggcacgcgcatccggttcaaggacgacagctcctacgaggacgtcaacgggatccgcaagccgaagcacctgtacgtgagcctccccaccgcccagtccaccatgaaggccgacgagatcacccccggccggttccgcacgatcgtgtgcgggctgttccccgcgcagatcaaggcccggaacatcatcagcccggtcatgggcgtgatcgggttctccttcttcgtgaaggactgggtcgacaagatcgaggacttcctgcgcgccgagtgccccttcctccccaagccccgggcccaggccgagagcttcctgtccaccaacggcgcgtacttcatgaaccgccagacccaggtggaggagagcaaggtgcaggacatcctggacctcatcgacaccgccgagtccggcggggccacgctgttcgacaacatcgccagcccgcagagcgcctggatcttcgcgtgcgcccccgaccggtgcccgcccaccgccctgtacgtcgccggcgtgcccgagctcggggccttcttctccatcctgcaggacatgcgcaacaccatcatggcgagcaagtccgtgggcaccgccgaggagaagctgaagaagaagtccgccttctaccagagctacctccggcgcacgcagagcatgggcatccagctggaccagaagatcatcatcctgtacatgatcaactgggggaaggaggccgtcaaccacttccacctcggcgacgacatggaccccgagctgcggcagctggcgcaggccctcgtggacaccaaggtcaaggagatctccaaccaggagcccctgaagatctga

SEQ ID NO: 6302 - RNA, 1287 nt, synthetic construct
  misc_feature 1..1287: note = derived and/or modified CDS sequence (opt1) from BCCV(BCCV)__L39949.1__N
  source 1..1287: mol_type = other RNA
atgagcaacctgaaggaggtgcaggacaacatcaccacccacgagcagcagctcgtcgccgcccgccagaagctgaaggacgcggagcggacggtggaggtggaccccgacgacgtcaacaagtccaccctgcagaaccgccgggccgccgtgagcgccctcgaggccaagatcggcgagctgaagcgccagctggcggacctcgtggccgcccagaagctggccaccaagtccgtcgacccgaccgggatcgagcccgacgaccacctgaaggagaagtccagcctccggtacggcaacgtgctggacgtgaacagcatcgacctggaggagccctccgggcagacggcggactggaaggccatcggcacctacatcctcagcttcgtcctgcccatcgtgctgaaggccctctacatgctgtccacccgcgggcggcagaccgtgaaggagaacaagggcacgcgcatccggttcaaggacgacagctcctacgaggacgtcaacggcatccgcaagccgaagcacctgtacgtgagcctccccaccgcccagtccaccatgaaggccgacgagatcacccccgggcggttccgcacgatcgtgtgcggcctgttccccgcgcagatcaaggcccggaacatcatcagcccggtcatgggggtgatcggcttctccttcttcgtgaaggactgggtcgacaagatcgaggacttcctgcgcgccgagtgccccttcctccccaagccccgggcccaggccgagagcttcctgtccaccaacggggcgtacttcatgaaccgccagacccaggtggaggagagcaaggtgcaggacatcctggacctcatcgacaccgccgagtccggcggcgccacgctgttcgacaacatcgccagcccgcagagcgcctggatcttcgcgtgcgcccccgaccggtgcccgcccaccgccctgtacgtcgccggggtgcccgagctcggcgccttcttctccatcctgcaggacatgcgcaacaccatcatggcgagcaagtccgtggggaccgccgaggagaagctgaagaagaagtccgccttctaccagagctacctccggcgcacgcagagcatgggcatccagctggaccagaagatcatcatcctgtacatgatcaactggggcaaggaggccgtcaaccacttccacctcggggacgacatggaccccgagctgcggcagctggcgcaggccctcgtggacaccaaggtcaaggagatctccaaccaggagcccctgaagatctga

SEQ ID NO: 6303 - RNA, 1290 nt, synthetic construct
  misc_feature 1..1290: note = derived and/or modified CDS sequence (opt1) from DOBV(DOBV/Ano-Poroia/Afl9/1999)__NC_005233.1__N
  source 1..1290: mol_type = other RNA
atggccaccctggaggagctccagaaggagatcaacaaccacgagggccagctggtgatcgcccgccagaaggtcaaggacgcggagaagcagtacgagaaggaccccgacgacctgaacaagcgggccctcagcgaccgcgagtccatcgcccagagcatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtgatcgacctcaaccacctggacatcgacgagcccacgggccagaccgccgactggctgtccatcgtcgtgtacctcaccagcttcgtggtccccatcctgctgaaggccctctacatgctgaccacgcgggggcgccagaccaccaaggacaacaagggcatgcggatccgcttcaaggacgactccagcttcgaggacgtgaacgggatccggaagccgaagcacctgttcctctccatgcccaacgcccagagctccatgaaggcggacgagatcacccccggccgcttccggacggccatctgcgggctgtaccccgcccaggtgaaggcccgcaacctgatcagcccggtcatgtccgtgatcggcttcctcgccctggcgaagaactggaccgagcgggtggaggagtggctggacctcccctgcaagctgctgagcgagccctcccccaccagcctcaccaagggcccgtccacgaaccgcgactacctgaaccagcggcagggggccctggccaagatggagaccaaggaggcccaggccgtccgcaagcacgcgatcgacgccggctgcaacctcatcgaccacatcgacagcccctccagcatctgggtgttcgccggggcccccgaccggtgcccgccgacctgcctgttcatcgccggcatggcggagctgggcgccttcttcgccgtgctccaggacatgcgcaacaccatcatggccagcaagacgatcgggacctccgaggagaagctgaagaagaagtccagcttctaccagagctacctgcggcgcacccagtccatgggcatccagctcgaccagcgcatcatcgtcctgttcatggtggactgggggaaggaggccgtggacagcttccacctgggcgacgacatggaccccgagctccgggggctggcgcaggccctgatcgaccagaaggtcaaggagatctccaaccaggagcccctcaagctgtga

SEQ ID NO: 6304 - RNA, 1290 nt, synthetic construct
  misc_feature 1..1290: note = derived and/or modified CDS sequence (opt1) from DOBV(DOB/Saaremaa/160V)__AJ009773.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcatcgcccagtccatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtgatcgacctcaaccacctggacatcgacgagcccacgggccagaccgccgactggctgagcatcgtcatctacctcacctccttcgtggtgcccatcctgctgaaggccctctacatgctgaccacgcgggggcgccagaccaccaaggacaacaagggcatgcggatccgcttcaaggacgacagctccttcgaggacgtcaacgggatccggaagccgaagcacctgttcctcagcatgcccaacgcccagtccagcatgaaggcggacgagatcacccccggccgcttccggacggccgtgtgcgggctgtaccccgcccaggtgaaggcccgcaacctgatctccccggtcatgagcgtgatcggcttcctcaccctggccaagaactggaccgagcgggtggaggagtggctggacctcccctgcaagctgctgtccgagcccagccccacctccctcacgaagggcccgagcaccaaccgcgactacctgtcccagcggcagggggcgctggccaagatggagaccaaggaggcccaggtcgtgcgcaagcacgccatcgacgccggctgcaacatcatcgaccacatcgacagccccagctccatctgggtgttcgcgggggcccccgaccggtgcccgccgacctgcctcttcatcgccggcatggccgagctgggcgccttcttcgcggtcctgcaggacatgcgcaacacgatcatggccagcaagaccatcgggacctccgaggagaagctccggaagaagtccagcttctaccagagctacctgcgccgcacccagtccatgggcatccagctggaccagcggatcatcgtcctcttcatgatcgagtgggggaaggaggccgtggacagcttccacctgggcgacgacatggaccccgagatccgctccctggcccaggccctcatcgaccagaaggtgaaggagatcagcaaccaggagcccctgaagctgtga

SEQ ID NO: 6305 - RNA, 1290 nt, synthetic construct
  misc_feature 1..1290: note = derived and/or modified CDS sequence (opt1) from DOBV(Slovakia/400Af/98)__AY168576.1__N
  source 1..1290: mol_type = other RNA
atggccaccctggaggagctccagaaggagatcaacaaccacgagggccagctggtgatcgcccgccagaaggtcaaggacgcggagaagcagtacgagaaggaccccgacgacctgaacaagcgggccctcagcgaccgcgagtccatcgcccagagcatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtgatcgacctcaaccacctggacatcgacgagcccacgggccagaccgccgactggctgtccatcgtcgtgtacctcaccagcttcgtggtccccatcctgctgaaggccctctacatgctgaccacgcgggggcgccagaccaccaaggacaacaagggcatgcggatccgcttcaaggacgactccagcttcgaggacgtgaacgggatccggaagccgaagcacctgttcctctccatgcccaacgcccagagctccatgaaggcggacgagatcacccccggccgcttccggacggccatctgcgggctgtaccccgcccaggtgaaggcccgcaacctgatcagcccggtcatgtccgtgatcggcttcctcgccctggcgaagaactggaccgagcgggtggaggagtggctggacctcccctgcaagctgctgagcgagccctcccccaccagcctcaccaagggcccgtccacgaaccgcgactacctgaaccagcggcagggggccctggccaagatggagaccaaggaggcccaggccgtccgcaagcacgcgatcgacgccggctgcaacctcatcgaccacatcgacagcccctccagcatctgggtgttcgccggggcccccgaccggtgcccgccgacctgcctgttcatcgccggcatggcggagctgggcgccttcttcgccgtgctccaggacatgcgcaacaccatcatggccagcaagacgatcgggacctccgaggagaagctgaagaagaagtccagcttctaccagagcctgctccggcgcacccagtccatgggcatccagctggaccagcgcatcatcgtcctgttcatggtggactgggggaaggaggccgtggacagcttccacctcggcgacgacatggaccccgagctgcgggggctggcgcaggccctcatcgaccagaaggtcaaggagatctccaaccaggagcccctgaagctgtga

SEQ ID NO: 6306 - RNA, 1290 nt, synthetic construct
  misc_feature 1..1290: note = derived and/or modified CDS sequence (opt1) from DOBV(Slovakia-856-Aa)__AJ269549.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcgtggcccagtccatccagagcaagatcgacgagctgcggcgccagctggccgaccgggtggccgcggggaagaacatcggcaaggagcgcgaccccaccgggctcgaccccggcgaccacctgaaggagaagtccatgctgagctacgggaacgtcatcgacctcaaccacctggacatcgacgagcccacgggccagaccgccgactggctgtccatcgtggtgtacctcaccagcttcgtcgtgcccatcctgctgaaggccctctacatgctgaccacgcggggccgccagaccaccaaggacaacaaggggatgcggatccgcttcaaggacgactccagcttcgaggacgtgaacggcatccggaagccgaagcacctgttcctctccatgcccaacgcccagagctccatgaaggcggacgagatcacccccgggcgcttccggacggccatctgcggcctgtaccccgcccaggtcaaggcccgcaacctggtgagcccggtgatgtccgtcatcgggttcatggccctcgcgaagaactggaccgagcgggtggaggagtggctggacctgccctgcaagctcctgagcgagccctcccccaccagcctgaccaagggcccgtccacgaaccgcgactacctcaaccagcggcagggcgccctggccaagatggagaccaaggaggcccaggccgtgcgcaagcacgcgatcgacgccgggtgcaacatcatcgaccacatcgacagccccagctccatctgggtcttcgcccccgcccccgaccggtgcccgccgacctgcctgttcatcgccggcatggcggagctcggggccttcttcagcgtgctgcaggacatgcgcaacaccatcatggcctccaagacgatcggcaccagcgaggagaagctgcggaagaagtccagcttctaccagtcctacctccgccgcacccagagcatgggcatccagctggaccagcggatcatcgtgctgttcatggtcgactgggggaaggaggccgtggactccttccacctcggcgacgacatggaccccgagctgcgcgggctggcccaggcgctcatcgaccagaaggtgaaggagatcagcaaccaggagcccctgaagctgtga

SEQ ID NO: 6307 - RNA, 1290 nt, synthetic construct
  misc_feature 1..1290: note = derived and/or modified CDS sequence (opt1) from DOBV(Slovakia-862-Aa)__AJ269550.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcgtggcccagtccatccagagcaagatcgacgagctgcggcgccagctggccgaccgggtggccgcggggaagaacatcggcaaggagcgcgaccccaccgggctcgaccccggcgaccacctgaaggagaagtccatgctgagctacgggaacgtcatcgacctcaaccacctggacatcgacgagcccacgggccagaccgccgactggctgtccatcgtggtgtacctcaccagcttcgtcgtgcccatcctgctgaaggccctctacatgctgaccacgcggggccgccagaccaccaaggacaacaaggggatgcggatccgcttcaaggacgactccagcttcgaggacgtgaacggcatccggaagccgaagcacctgttcctctccatgcccaacgcccagagctccatgaaggcggacgagatcacccccgggcgcttccggacggccatctgcggcctgtaccccgcccaggtcaaggcccgcaacctggtgagcccggtgatgtccgtcatcgggttcatggccctcgcgaagaactggaccgagcgggtggaggagtggctggacctgccctgcaagctcctgagcgagccctcccccaccagcctgaccaagggcccgtccacgaaccgcgactacctcaaccagcggcagggcgccctggccaagatggagaccaaggaggcccaggccgtgcgcaagcacgcgatcgacgccgggtgcaacatcatcgaccacatcgacagccccagctccatctgggtcttcgccggccggcccgaccgctgcccgccgacctgcctgttcatcgccgggatggccgagctcggcgcgttcttcagcgtgctgcaggacatgcggaacaccatcatggcctccaagacgatcggcaccagcgaggagaagctgcgcaagaagtccagcttctaccagtcctacctccgccggacccagagcatggggatccagctggaccagcgcatcatcgtgctgttcatggtcgactggggcaaggaggccgtggactccttccacctcggggacgacatggaccccgagctgcggggcctggcccaggccctcatcgaccagaaggtgaaggagatcagcaaccaggagcccctgaagctgtga

SEQ ID NO: 6308 - RNA, 1290 nt, synthetic construct
  misc_feature 1..1290: note = derived and/or modified CDS sequence (opt1) from DOBV(Esl/29Aa/01)__AY533118.2__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcgtggcccagtccatccagagcaagatcgacgagctgcggcgccagctggccgaccgggtggccgcggggaagaacatcggcaaggagcgcgaccccaccgggctcgaccccggcgaccacctgaaggagaagtccatgctgagctacgggaacgtcatcgacctcaaccacctggacatcgacgagcccacgggccagaccgccgactggctgtccatcgtggtgtacctcaccagcttcgtcgtgcccatcctgctgaaggccctctacatgctgaccacgcggggccgccagaccaccaaggacaacaaggggatgcggatccgcttcaaggacgactccagcttcgaggacgtgaacggcatccggaagccgaagcacctgttcctctccatgcccaacgcccagagctccatgaaggcggacgagatcacccccgggcgcttccggacggccatctgcggcctgtaccccgcccaggtcaaggcccgcaacctggtgagcccggtgatgtccgtcatcgggttcctcgccctggcgaagaactggaccgagcgggtggaggagtggctggacctcccctgcaagctgctgagcgagccctcccccaccagcctcaccaagggcccgtccacgaaccgcgactacctgaaccagcggcagggcgccctggccaagatggagaccaaggaggcccaggccgtgcgcaagcacgcgatcgacgccgggtgcaacatcatcgaccacatcgacagccccagctccatctgggtcttcgccggcgcccccgaccggtgcccgccgacctgcctcttcatcgccgggatggcggagctgggcgccttcttcagcgtgctgcaggacatgcgcaacaccatcatggcctccaagacgatcggcaccagcgaggagaagctccggaagaagtccagcttctaccagtcctacctgcgccgcacccagagcatggggatccagctggaccagcggatcatcgtcctcttcatggtggactggggcaaggaggccgtggactccttccacctgggggacgacatggaccccgagctgcgcggcctcgcccaggcgctgatcgaccagaaggtgaaggagatcagcaaccaggagcccctgaagctctga

SEQ ID NO: 6309 - RNA, 1290 nt, synthetic construct
  misc_feature 1..1290: note = derived and/or modified CDS sequence (opt1) from DOBV(Kurkino/44Aa/98)__AJ131672.1__N
  source 1..1290: mol_type = other RNA
atggccaccctggaggagctccagaaggagatcaacagccacgagggccagctggtgatcgcccgccagaaggtcaaggacgcggagaagcagcacgagaaggaccccgacgacctgaacaagcgggccctctccgaccgcgagagcgtggcccagtccatccagagcaagatcgacgagctgcggcgccagctggccgaccgggtggccgcggggaagaacatcggcaaggagcgcgaccccaccgggctcgaccccggcgaccacctgaaggagaagtccatgctgagctacgggaacgtcatcgacctcaaccacctggacatcgacgagcccacgggccagaccgccgactggctgtccatcgtggtgtacctcaccagcttcgtcgtgcccatcctgctgaaggccctctacatgctgaccacgcggggccgccagaccaccaaggacaacaaggggatgcggatccgcttcaaggacgactccagcttcgaggacgtgaacggcatccggaagccgaagcacctgttcctctccatgcccaacgcccagagctccatgaaggcggacgagatcacccccgggcgcttccggacggccatctgcggcctgtaccccgcccaggtcaaggcccgcaacctggtgagcccggtgatgtccgtcatcgggttcctcgccctggcgaagaactggaccgagcgggtggaggagtggctggacctcccctgcaagctgctgagcgagccctcccccaccagcctcaccaagggcccgtccacgaaccgcgactacctgaaccagcggcaggccgccctggccaagatggagaccaaggaggcccaggcggtgcgcaagcacgccatcgacgccggctgcaccatcatcgactacatcgacagccccagctccatctgggtcttcgccggggcccccgaccggtgcccgccgacctgcctcttcatcgcgggcatggccgagctgggggccttcttcagcgtgctgcaggacatgcgcaacacgatcatggcctccaagaccgtgggcaccagcgaggagaagctccggaagaagtccagcttctaccagtcctacctgcgccgcacccagagcatgggcatccagctggaccagcggatcatcgtcctcttcatggtggactgggggaaggaggccgtggactccttccacctgggcgacgacatggaccccgagctgcgcgggctcgcgcaggccctgatcgaccagaaggtcaaggagatcagcaaccgggagcccctgaagctctga

SEQ ID NO: 6310 - RNA, 1290 nt, synthetic construct
  misc_feature 1..1290: note = derived and/or modified CDS sequence (opt1) from DOBV(Kurkino/53Aa/98)__AJ131673.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcgtggcccagtccatccagagcaagatcgacgagctgcggcgccagctggccgaccgggtggccgcggggaagaacatcggcaaggagcgcgaccccaccgggctcgaccccggcgaccacctgaaggagaagtccatgctgagctacgggaacgtcatcgacctcaaccacctggacatcgacgagcccacgggccagaccgccgactggctgtccatcgtggtgtacctcaccagcttcgtcgtgcccatcctgctgaaggccctctacatgctgaccacgcggggccgccagaccaccaaggacaacaaggggatgcggatccgcttcaaggacgactccagcttcgaggacgtgaacggcatccggaagccgaagcacctgttcctctccatgcccaacgcccagagctccatgaaggcggacgagatcacccccgggcgcttccggacggccatctgcggcctgtaccccgcccaggtcaaggcccgcaacctggtgagcccggtgatgtccgtcatcgggttcctcgccctggcgaagaactggaccgagcgggtggaggagtggctggacctcccctgcaagctgctgagcgagccctcccccaccagcctcaccaagggcccgtccacgaaccgcgactacctgaaccagcggcaggccgccctggccaagatggagaccaaggaggcccaggcggtgcgcaagcacgccatcgacgccggctgcaccatcatcgaccacatcgacagccccagctccatctgggtcttcgccggggcccccgaccggtgcccgccgacctgcctcttcatcgcgggcatggccgagctgggggccttcttcagcgtgctgcaggacatgcgcaacacgatcatggcctccaagaccgtgggcaccagcgaggagaagctccggaagaagtccagcttctaccagtcctacctgcgccgcacccagagcatgggcatccagctggaccagcggatcatcgtcctcttcatggtggactgggggaaggaggccgtggactccttccacctgggcgacgacatggaccccgagctgcgcgggctcgcgcaggccctgatcgaccagaaggtcaaggagatcagcaaccgggagcccctgaagctctga

SEQ ID NO: 6311 - RNA, 1290 nt, synthetic construct
  misc_feature 1..1290: note = derived and/or modified CDS sequence (opt1) from DOBV(Saar/90Aa/97)__AJ009775.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcatcgcccagtccatccaggggaagatcgacgagctgcggcgccagctggccgaccgggtggccgcgggcaagaacatcgggcgcgagcgggaccccaccggcctcgaccccggggaccacctgaaggagaagtccatgctgagctacggcaacgtgatcgacctcaaccacctggacatcgacgagcccacgggccagaccgccgactggctgagcatcgtcatctacctcacctccttcgtggtgcccatcctgctgaaggccctctacatgctgaccacgcgcgggcggcagaccaccaaggacaacaagggcatgcgcatccggttcaaggacgacagctccttcgaggacgtcaacgggatccgcaagccgaagcacctgttcctcagcatgcccaacgcccagtccagcatgaaggcggacgagatcacccccggccggttccgcacggccgtgtgcgggctgtaccccgcccaggtgaaggcccggaacctgatctccccggtcatgagcgtgatcggcttcctcaccctggccaagaactggaccgagcgcgtggaggagtggctggacctcccctgcaagctgctgtccgagcccagccccacctccctcacgaagggcccgagcaccaaccgggactacctgtcccagcgccagggggcgctggccaagatggagaccaaggaggcccaggccgtccggaagcacgccatcgacgcgggctgcaacatcatcgaccacatcgacagccccagctccatctgggtgttcgccggggcccccgaccgctgcccgccgacctgcctcttcatcgccggcatggccgagctgggcgcgttcttcgccgtgctgcaggacatgcggaacacgatcatggccagcaagaccatcgggacctccgaggagaagctccgcaagaagtccagcttctaccagagctacctgcgccggacccagtccatgggcatccagctggaccagcgcatcatcgtcctcttcatgatcgagtgggggaaggaggccgtggacagcttccacctgggcgacgacatggaccccgagatccggtccctggcccaggcgctcatcgaccagaaggtgaaggagatcagcaaccaggagcccctgaagctgtga

SEQ ID NO: 6312 - RNA, 1290 nt, synthetic construct
  misc_feature 1..1290: note = derived and/or modified CDS sequence (opt1) from DOBV(SK/Aa)__AY961615.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcggaccctctccgaccgcgagagcgtggcccagtccatccagagcaagatcgacgagctgcggcgccagctggccgaccgggtggccgccgggaagaacatcggcaaggagcgcgaccccacggggctcgaccccggcgaccacctgaaggagaagtccatgctgagctacgggaacgtcatcgacctcaaccacctggacatcgacgagcccaccggccagaccgcggactggctgtccatcgtggtgtacctcaccagcttcgtcgtgcccatcctgctgaaggccctctacatgctgacgacccggggccgccagaccaccaaggacaacaaggggatgcggatccgcttcaaggacgactccagcttcgaggacgtgaacggcatccggaagccgaagcacctgttcctctccatgcccaacgcccagagctccatgaaggccgacgagatcacgcccgggcgcttccggaccgcgatctgcggcctgtaccccgcccaggtcaaggcccgcaacctggtgagcccggtgatgtccgtcatcgggttcctcgccctggccaagaactggaccgagcgggtggaggagtggctggacctcccctgcaagctgctgagcgagccctcccccaccagcctcacgaagggcccgtccaccaaccgcgactacctgaaccagcggcagggcgcgctggccaagatggagaccaaggaggcccaggccgtgcgcaagcacgccatcgacgcggggtgcaacatcatcgaccacatcgacagccccagctccatctgggtcttcgccggcgcccccgaccggtgcccgccgacctgcctcttcatcgccgggatggccgagctgggcgcgttcttcagcgtgctgcaggacatgcgcaacacgatcatggcctccaagaccatcggcaccagcgaggagaagctccggaagaagtccagcttctaccagtcctacctgcgccgcacccagagcatggggatccagctggaccagcggatcatcgtcctcttcatggtggactggggcaaggaggccgtggactccttccacctgggggacgacatggaccccgagctgcgcggcctcgcccaggccctgatcgaccagaaggtgaaggagatcagcaaccaggagcccctgaagctctga

SEQ ID NO: 6313 - RNA, 1290 nt, synthetic construct
  misc_feature 1..1290: note = derived and/or modified CDS sequence (opt1) from DOBV(A35)__GU904030.1__N
  source 1..1290: mol_type = other RNA
atggccaccctggaggagctccagaaggagatcaacaaccacgagggccagctggtgatcgcccgccagaaggtcaaggacgcggagaagcagtacgagaaggaccccgacgacctgaacaagcgggccctcagcgaccgcgagtccatcgcccagagcatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtgatcgacctcaaccacctggacatcgacgagcccacgggccagaccgccgactggctgtccatcgtcatctacctcaccagcttcgtggtgcccatcctgctgaaggccctctacatgctgaccacgcgggggcgccagaccaccaaggacaacaagggcatgcggatccgcttcaaggacgactccagcttcgaggacgtcaacgggatccggaagccgaagcacctgttcctctccatgcccaacgcccagagctccatgaaggcggacgagatcacccccggccgcttccggacggccatctgcgggctgtaccccgcccaggtgaaggcccgcaacctgatcagcccggtgatgtccgtcatcggcttcgtggccctcgcgaagaactggaccgagcgggtggaggagtggctggacctgccctgcaagctcctgagcgagccctcccccaccagcctgaccaagggcccgtccacgaaccgcgactacctcaaccagcggcagggggccctggccaagatggagaccaaggaggcccaggccgtccgcaagcacgcgatcgacgccggctgcaacctgatcgaccacatcgacagcccctccagcatctgggtgttcgccggggcccccgaccggtgcccgccgacctgcctcttcatcgccggcatggcggagctgggcgccttcttcgccgtgctgcaggacatgcgcaacaccatcatggccagcaagacgatcgggacctccgaggagaagctcaagaagaagtccagcttctaccagagctacctgcggcgcacccagtccatgggcatccagctggaccagcgcatcatcgtcctcttcatggtggactgggggaaggaggccgtggacagcttccacctgggcgacgacatggaccccgagctgcgggggctcgcgcaggccctgatcgaccagaaggtcaaggagatctccaaccaggagcccctgaagctctga

SEQ ID NO: 6314 - RNA, 1290 nt, synthetic construct
  misc_feature 1..1290: note = derived and/or modified CDS sequence (opt1) from DOBV(3970/87)__L41916.1__N
  source 1..1290: mol_type = other RNA
atggccaccctggaggagctccagaaggagatcaacaaccacgagggccagctggtgatcgcccgccagaaggtcaaggacgcggagaagcagtacgagaaggaccccgacgacctgaacaagcgggccctcagcgaccgcgagtccatcgcccagagcatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtgatcgacctcaaccacctggacatcgacgagcccacgggccagaccgccgactggctgtccatcgtcatctacctcaccagcttcgtggtgcccatcctgctgaaggccctctacatgctgaccacgcgggggcgccagaccaccaaggacaacaagggcatgcggatccgcttcaaggacgactccagcttcgaggacgtcaacgggatccggaagccgaagcacctgttcctctccatgcccaacgcccagagctccatgaaggcggacgagatcacccccggccgcttccggacggccatctgcgggctgtaccccgcccaggtgaaggcccgcaacctgatcagcccggtgatgtccgtcatcggcttcgtggccctcgcgaagaactggaccgagcgggtggaggagtggctggacctgccctgcaagctcctgagcgagccctcccccaccagcctgaccaagggcccgtccacgaaccgcgactacctcaaccagcggcagggggccctggccaagatggagaccaaggaggcccaggccgtccgcaagcacgcgatcgacgccggctgcaacctgatcgaccacatcgacagcccctccagcatctgggtgttcgccggggcccccgaccggtgcccgccgacctgcctcttcatcgccggcatggcggagctgggcgccttcttcgcctgcctgcaggacatgcgcaacaccatcatggccagcaagacgatcgggacctccgaggagaagctcaagaagaagtccagcttctaccagagctacctgcggcgcacccagtccatgggcatccagctggaccagcgcatcatcgtcctcttcatggtggactgggggaaggaggccgtggacagcttccacctgggcgacgacatggaccccgagctgcgggggctcgcgcaggccctgatcgaccagaaggtgaaggagatctccaaccaggagcccctgaagctctga

SEQ ID NO: 6315 - RNA, 1290 nt, synthetic construct
  misc_feature 1..1290: note = derived and/or modified CDS sequence (opt1) from DOBV(Klyuch-2000)__AF442622.1__N
  source 1..1290: mol_type = other RNA
atggccaccctggaggagctccagaaggagatcaacagccacgagggccagctggtgatcgcccgccggaaggtcaaggacgcggagaagcagtacgagaaggaccccgacgacctgaacaagcgcgccctctccgaccgggagagcgtggcccagtccatccaggggaagatcgacgagctgcgccggcagctggccgaccgcgtggccgcgggcaagaacatcgggaaggagcgggaccccaccggcctcgaccccggggaccacctgaaggagaagtccatgctgagctacggcaacgtcatcgacctcaaccacctggacatcgacgagcccacgggccagaccgccgactggctgagcatcgtggtgtacctcacctccttcgtcgtgcccatcctgctgaaggccctctacatgctgaccacgcgcgggcggcagaccaccaaggacaacaagggcatgcgcatccggttcaaggacgacagctccttcgaggacgtgaacgggatccgcaagccgaagcacctgttcctcagcatgcccaacgcccagtccagcatgaaggcggacgagatcacccccggccggttccgcacggccgtctgcgggctgtaccccgcccaggtgaaggcccggaacctggtgtccccggtcatgagcgtgatcggcttcgtgtccctcgccaagaactggaccgagcgcgtcgaggagtggctggacctgccctgcaagctcctgagcgagccctcccccaccagcctgaccaagggcccgtccacgaaccgggactacctcaaccagcgccagggggcgctggccaagatggagaccaaggaggcccaggccgtgcggaagcacgccatcaacgcgggctgcaacctggtggaccacatcgacagccccagctccatctgggtcttcgccggggcccccgaccgctgcccgccgacctgcctcttcgtggccggcatggccgagctgggcgcgttcttcgccgtgctgcaggacatgcggaacaccatcatggccagcaagacgatcgggacctccgaggagaagctccgcaagaagtccagcttctaccagagctacctgcgccggacccagtccatgggcatccagctggaccagcgcatcatcgtcctcttcatggtggactgggggaaggaggccgtggacagcttccacctgggcgacgacatggaccccgagctgcgggggctcgcccaggcgctgatcgagcagaaggtcaaggagatctccaaccaggagcccctgaagctctga

SEQ ID NO: 6316 - RNA, 1290 nt, synthetic construct
  misc_feature 1..1290: note = derived and/or modified CDS sequence (opt1) from DOBV(10636/Ap)__KP878311.1__N
  source 1..1290: mol_type = other RNA
atggccaccctggaggagctccagaaggagatcaacaaccacgagggccagctggtgatcgcccgccagaaggtcaaggacgcggagaagcagtacgagaaggaccccgacgacctgaacaagcgggccctcagcgaccgcgagtccgtggcccagagcatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtcatcgacctcaaccacctggacatcgacgagcccacgggccagaccgccgactggctgtccatcgtggtgtacctcaccagcttcgtcgtgcccatcctgctgaaggccctctacatgctgaccacgcgggggcgccagaccaccaaggacaacaagggcatgcggatccgcttcaaggacgactccagcttcgaggacgtgaacgggatccggaagccgaagcacctgttcctctccatgcccaacgcccagagctccatgaaggcggacgagatcacccccggccgcttccggacggccgtctgcgggctgtaccccgcccaggtgaaggcccgcaacctggtgagcccggtcatgtccgtgatcggcttcgtgagcctcgccaagaactggaccgagcgggtcgaggagtggctggacctgccctgcaagctcctgtccgagcccagccccacctccctgaccaagggcccgagcacgaaccgcgactacctcaaccagcggcagggggcgctggccaagatggagaccaaggaggcccaggccgtgcgcaagcacgccatcgacgcgggctgcaacctggtggaccacatcgactcccccagcagcatctgggtcttcgccggggcccccgaccggtgcccgccgacctgcctcttcgtggccggcatggccgagctgggcgcgttcttcgccgtgctgcaggacatgcgcaacaccatcatggcctccaagacgatcgggaccagcgaggagaagctccggaagaagtccagcttctaccagtcctacctgcgccgcacccagagcatgggcatccagctggaccagcggatcatcgtcctcttcatggtggactgggggaaggaggccgtggactccttccacctgggcgacgacatggaccccgagctgcgcagcctcgcccaggcgctgatcgaccagaaggtcaaggagatctccaaccaggagcccctgaagctctga

SEQ ID NO: 6317 - RNA, 1290 nt, synthetic construct
  misc_feature 1..1290: note = derived and/or modified CDS sequence (opt1) from DOBV(10645/Ap)__KP878312.1__N
  source 1..1290: mol_type = other RNA
atggccaccctggaggagctccagaaggagatcaacaaccacgagggccagctggtgatcgcccgccagaaggtcaaggacgcggagaagcagtacgagaaggaccccgacgacctgaacaagcgggccctcagcgaccgcgagtccgtggcccagagcatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtcatcgacctcaaccacctggacatcgacgagcccacgggccagaccgccgactggctgtccatcgtggtgtacctcaccagcttcgtcgtgcccatcctgctgaaggccctctacatgctgaccacgcgggggcgccagaccaccaaggacaacaagggcatgcggatccgcttcaaggacgactccagcttcgaggacgtgaacgggatccggaagccgaagcacctgttcctctccatgcccaacgcccagagctccatgaaggcggacgagatcacccccggccgcttccggacggccgtctgcgggctgtaccccgcccaggtgaaggcccgcaacctggtgagcccggtcatgtccgtgatcggcttcgtgagcctcgccaagaactggaccgagcgggtcgaggagtggctggacctgccctgcaagctcctgtccgagcccagccccacctccctgaccaagggcccgagcacgaaccgcgactacctcaaccagcggcagggggcgctggccaagatggagaccaaggaggcccaggccgtgcgcaagcacgccatcgacgcgggctgcaacctggtggaccacatcgactcccccagcagcatctgggtcttcgccggggcccccgaccggtgcccgccgacctgcctcttcgtggccggcatggccgagctgggcgcgttcttcgccgtgctgcaggacatgcgcaacaccatcatggcctccaagacgatcgggaccagcgaggagaagctccggaagaagtccagcttctaccagtcctacctgcgccgcacccagagcatgggcatccagctggaccagcggatcatcgtcctcttcatggtggactgggggaaggaggccgtggactccttccacctgggcgacgacatggaccccgagctgcgcgggctcgcccaggcgctgatcgaccagaaggtcaaggagatcagcaaccaggagcccctgaagctctga

SEQ ID NO: 6318 - RNA, 1290 nt, synthetic construct
  misc_feature 1..1290: note = derived and/or modified CDS sequence (opt1) from DOBV(Aa1854/Lipetsk-02)__EU188452.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcgtggcccagtccatccagagcaagatcgacgagctgcggcgccagctggccgaccgggtggccgcggggaagaacatcggcaaggagcgcgaccccaccgggctcgaccccggcgaccacctgaaggagaagtccatgctgagctacgggaacgtcatcgacctcaaccacctggacatcgacgagcccacgggccagaccgccgactggctgtccatcgtggtgtacctcaccagcttcgtcgtgcccatcctgctgaaggccctctacatgctgaccacgcggggccgccagaccaccaaggacaacaaggggatgcggatccgcttcaaggacgactccagcttcgaggacgtgaacggcatccggaagccgaagcacctgttcctctccatgcccaacgcccagagctccatgaaggcggacgagatcacccccgggcgcttccggacggccatctgcggcctgtaccccgcccaggtcaaggcccgcaacctggtgagcccggtgatgtccgtcatcgggttcctcgccctggcgaagaactggaccgagcgggtggaggagtggctggacctcccctgcaagctgctgagcgagccctcccccaccagcctcaccaagggcccgtccacgaaccgcgactacctgaaccagcggcaggccgccctggccaagatggagaccaaggaggcccaggcggtgcgcaagcacgccatcgacgccggctgcaccatcatcgaccacatcgacagccccagctccatctgggtcttcgccggggcccccgaccggtgcccgccgacctgcctcttcatcgcgggcatggccgagctgggggccttcttcagcgtgctgcaggacatgcgcaacacgatcatggcctccaagcccgtgggcaccagcgaggagaagctccggaagaagtccagcttctaccagtcctacctgcgccgcacccagagcatgggcatccagctggaccagcggatcatcgtcctcttcatggtggactgggggaaggaggccgtggactccttccacctgggcgacgacatggaccccgagctgcgcgggctcgcgcaggccctgatcgaccagaaggtcaaggagatcagcaaccaggagcccctgaagctctga

SEQ ID NO: 6319 - RNA, 1290 nt, synthetic construct
  misc_feature 1..1290: note = derived and/or modified CDS sequence (opt1) from DOBV(Ap/Sochi/43)__JF920151.1__N
  source 1..1290: mol_type = other RNA
atggccaccctggaggagctccagaaggagatcaacaaccacgagggccagctggtgatcgcccgccagaaggtcaaggacgcggagaagcagtacgagaaggaccccgacgacctgaacaagcgggccctcagcgaccgcgagtccgtggcccagagcatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtcatcgacctcaaccacctggacatcgacgagcccacgggccagaccgccgactggctgtccatcgtggtgtacctcaccagcttcgtcgtgcccatcctgctgaaggccctctacatgctgaccacgcgggggcgccagaccaccaaggacaacaagggcatgcggatccgcttcaaggacgactccagcttcgaggacgtgaacgggatccggaagccgaagcacctgttcctctccatgcccaacgcccagagctccatgaaggcggacgagatcacccccggccgcttccggacggccgtctgcgggctgtaccccgcccaggtgaaggcccgcaacctggtgagcccggtcatgtccgtgatcggcttcgtgagcctcgccaagaactggaccgagcgggtcgaggagtggctggacctgccctgcaagctcctgtccgagcccagccccacctccctgaccaagggcccgagcacgaaccgcgactacctcaaccagcggcagggggcgctggccaagatggagaccaaggaggcccaggccgtgcgcaagcacgccatcgacgcgggctgcaacctggtggaccacatcgactcccccagcagcatctgggtcttcgccggggcccccgaccggtgcccgccgacctgcctcttcgtggccggcatggccgagctgggcgcgttcttcgccgtgctgcaggacatgcgcaacaccatcatggcctccaagacgatcgggaccagcgaggagaagctccggaagaagtccagcttctaccagtcctacctgcgccgcacccacagcatgggcatccagctggaccagcggatcatcgtcctcttcatggtggactgggggaaggaggccgtggactccttccacctgggcgacgacatggaccccgagctgcgcgggctcgcccaggcgctgatcgaccagaaggtcaaggagatcagcaaccaggagcccctgaagctctga

SEQ ID NO: 6320 - RNA, 1290 nt, synthetic construct
  misc_feature 1..1290: note = derived and/or modified CDS sequence (opt1) from DOBV(Ap/Sochi/hu)__JF920150.1__N
  source 1..1290: mol_type = other RNA
atggccaccctggaggagctccagaaggagatcaacaaccacgagggccagctggtgatcgcccgccagaaggtcaaggacgcggagaagcagtacgagaaggaccccgacgacctgaacaagcgggccctcagcgaccgcgagtccgtggcccagagcatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtcatcgacctcaaccacctggacatcgacgagcccacgggccagaccgccgactggctgtccatcgtggtgtacctcaccagcttcgtcgtgcccatcctgctgaaggccctctacatgctgaccacgcgggggcgccagaccaccaaggacaacaagggcatgcggatccgcttcaaggacgactccagcttcgaggacgtgaacgggatccggaagccgaagcacctgttcctctccatgcccaacgcccagagctccatgaaggcggacgagatcacccccggccgcttccggacggccgtctgcgggctgtaccccgcccaggtgaaggcccgcaacctggtgagcccggtcatgtccgtgatcggcttcctcagcctggccaagaactggaccgagcgggtggaggagtggctggacctcccctgcaagctgctgtccgagcccagccccacctccctcaccaagggcccgagcacgaaccgcgactacctgaaccagcggcagggggcgctggccaagatggagaccaaggaggcccaggccgtccgcaagcacgccatcgacgcgggctgcaacctcgtggaccacatcgactcccccagcagcatctgggtgttcgccggggcccccgaccggtgcccgccgacctgcctgttcgtcgccggcatggccgagctgggcgcgttcttcgccgtgctccaggacatgcgcaacaccatcatggcctccaagacgatcgggaccagcgaggagaagctgcggaagaagtccagcttctaccagtcctacctgcgccgcacccacagcatgggcatccagctcgaccagcggatcatcgtgctgttcatggtcgactgggggaaggaggccgtggactccttccacctgggcgacgacatggaccccgagctccgcgggctggcccaggcgctgatcgaccagaaggtgaaggagatcagcaaccaggagcccctcaagctgtga

SEQ ID NO: 6321 - RNA, 1290 nt, synthetic construct
  misc_feature 1..1290: note = derived and/or modified CDS sequence (opt1) from DOBV(Ap1584/Sochi-01)__EU188449.1__N
  source 1..1290: mol_type = other RNA
atggccaccctggaggagctcaagaaggagatcaacaaccacgagggccagctggtgatcgcccgccagaaggtcaaggacgcggagaagcagtacgagaaggaccccgacgacctgaacaagcgggccctcagcgaccgcgagtccgtggcccagagcatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtcatcgacctcaaccacctggacatcgacgagcccacgggccagaccgccgactggctgtccatcgtggtgtacctcaccagcttcgtcgtgcccatcctgctgaaggccctctacatgctgaccacgcgggggcgccagaccaccaaggacaacaagggcatgcggatccgcttcaaggacgactccagcttcgaggacgtgaacgggatccggaagccgaagcacctgttcctctccatgcccaacgcccagagctccatgaaggcggacgagatcacccccggccgcttccggacggccgtctgcgggctgtaccccgcccaggtgaaggcccgcaacctggtgagcccggtcatgtccgtgatcggcttcgtgagcctcgccaagaactggaccgagcgggtcgaggagtggctggacctgccctgcaagctcctgtccgagcccagccccacctccctgaccaagggcccgagcacgaaccgcgactacctcaaccagcggcagggggcgctggccaagatggagaccaaggaggcccaggccgtgcgcaagcacgccatcgacgcgggctgcaacctggtggaccacatcgactcccccagcagcatctgggtcttcgccggggcccccgaccggtgcccgccgacctgcctcttcgtggccggcatggccgagctgggcgcgttcttcgccgtgctgcaggacatgcgcaacaccatcatggcctccaagacgatcgggaccagcgaggagaagctccggaagaagtccagcttctaccagtcctacctgcgccgcacccagagcatgggcatccagctggaccagcggatcatcgtcctcttcatggtggactgggggaaggaggccgtggactccttccacctgggcgacgacatggaccccgagctgcgcgggctcgcccaggcgctgatcgaccagaaggtcaaggagatcagcaaccaggagcccctgaagctctga

SEQ ID NO: 6322 - RNA, 1290 nt, synthetic construct
  misc_feature 1..1290: note = derived and/or modified CDS sequence (opt1) from DOBV(DOB/Gola/235Af/07)__KC848495.1__N
  source 1..1290: mol_type = other RNA
atggccaccctggaggagctccagaaggagatcaacaaccacgagggccagctggtgatcgcccgccagaaggtcaaggacgcggagaagcagtacgagaaggaccccgacgacctgaacaagcgggccctcagcgaccgcgagtccatcgcccagagcatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtgatcgacctcaaccacctggacatcgacgagcccacgggccagaccgccgactggctgtccatcgtcgtgtacctcaccagcttcgtggtccccatcctgctgaaggccctctacatgctgaccacgcgggggcgccagaccaccaaggacaacaagggcatgcggatccgcttcaaggacgactccagcttcgaggacgtgaacgggatccggaagccgaagcacctgttcctctccatgcccaacgcccagagctcccgcaaggcggacgagatcacccccggccggttccgcacggccatctgcgggctgtaccccgcccaggtgaaggcccggaacctgatcagcccggtcatgtccgtgatcggcttcctcgccctggcgaagaactggaccgagcgcgtggaggagtggctggacctcccctgcaagctgctgagcgagccctcccccaccagcctcaccaagggcccgtccacgaaccgggactacctgaaccagcgccagggggccctggccaagatggagaccaaggaggcccaggccgtccggaagcacgcgatcgacgccggctgcaacctcatcgaccacatcgacagcccctccagcatctgggtgttcgccggggcccccgaccgctgcccgccgacctgcctgttcatcgccggcatggcggagctgggcgccttcttcgccgtgctccaggacatgcggaacaccatcatggccagcaagacgatcgggacctccgaggagaagctgaagaagaagtccagcttctaccagagctacctgcgccgcacccagtccatgggcatccagctcgaccagcggatcatcgtcctgttcatggtggactgggggaaggaggccgtggacagcttccacctgggcgacgacatggaccccgagctccgcgggctggcgcaggccctgatcgaccagaaggtcaaggagatctccaaccaggagcccctcaagctgtga

SEQ ID NO: 6323 - RNA, 1290 nt, synthetic construct
  misc_feature 1..1290: note = derived and/or modified CDS sequence (opt1) from DOBV(DOB/Gola/343Af/07)__KC848498.1__N
  source 1..1290: mol_type = other RNA
atggccaccctggaggagctccagaaggagatcaacaaccacgagggccagctggtgatcgcccgccagaaggtcaaggacgcggagaagcagtacgagaaggaccccgacgacctgaacaagcgggccctcagcgaccgcgagtccatcgcccagagcatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtgatcgacctcaaccacctggacatcgacgagcccacgggccagaccgccgactggctgtccatcgtcgtgtacctcaccagcttcgtggtccccatcctgctgaaggccctctacatgctgaccacgcgggggcgccagaccaccaaggacaacaagggcatgcggatccgcttcaaggacgactccagcttcgaggacgtgaacgggatccggaagccgaagcacctgttcctctccatgcccaacgcccagagctccatgaaggcggacgagatcacccccggccgcttccggacggccatctgcgggctgtaccccgcccaggtgaaggcccgcaacctgatcagcccggtcatgtccgtgatcggcttcctcgccctggcgaagaactggaccgagcgggtggaggagtggctggacctcccctgcaagctgctgagcgagccctcccccaccagcctcaccaagggcccgtccacgaaccgcgactacctgaaccagcggcagggggccctggccaagatggagaccaaggaggcccaggccgtccgcaagcacgcgaccgacgccggctgcaacctcatcgaccacatcgacagcccctccagcatctgggtgttcgccggggcccccgaccggtgcccgccgacctgcctgttcatcgccggcatggcggagctgggcgccttcttcgccgtgctccaggacatgcgcaacacgatcatggccagcaagaccatcgggacctccgaggagaagctgaagaagaagtccagcttctaccagagctacctgcggcgcacccagtccatgggcatccagctcgaccagcgcatcatcgtcctgttcatggtggactgggggaaggaggccgtggacagcttccacctgggcgacgacatggaccccgagctccgggggctggcgcaggccctgatcgaccagaaggtcaaggagatctccaaccaggagcccctcaagctgtga

SEQ ID NO: 6324 - RNA, 1290 nt, synthetic construct
  misc_feature 1..1290: note = derived and/or modified CDS sequence (opt1) from DOBV(DOB/Pecs/27Aa/06)__KC848499.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcgtggcccagtccatccagagcaagatcgacgagctgcggcgccagctggccgaccgggtggccgcggggaagaacatcggcaaggagcgcgaccccaccgggctcgaccccggcgaccacctgaaggagaagtccatgctgagctacgggaacgtcatcgacctcaaccacctggacatcgacgagcccacgggccagaccgccgactggctgtccatcgtggtgtacctcaccagcttcgtcgtgcccatcctgctgaaggccctctacatgctgaccacgcggggccgccagaccaccaaggacaacaaggggatgcgggtgcgcttcaaggacgactccagcttcgaggacgtcaacggcatccggaagccgaagcacctgttcctctccatgcccaacgcccagagctccatgaaggcggacgagatcacccccgggcgcttccggacggccgtgtgcggcctgtaccccgcccaggtgaaggcccgcaacctggtcagcccggtgatgtccgtgatcgggttcctcgccctggcgaagaactggaccgagcgggtcgaggagtggctggacctcccctgcaagctgctgagcgagccctcccccaccagcctcaccaagggcccgtccacgaaccgcgactacctgaaccagcggcagggcgccctggccaagatggagaccaaggaggcccaggccgtgcgcaagcacgcgatcgacgccgggtgcaacatcatcgaccacatcgacagccccagctccatctgggtgttcgccggcgcccccgaccggtgcccgccgacctgcctcttcatcgccgggatggcggagctgggcgccttcttcagcgtcctgcaggacatgcgcaacaccatcatggcctccaagacgatcggcaccagcgaggagaagctccggaagaagtccagcttctaccagtcctacctgcgccgcacccagagcatggggatccagctggaccagcggatcatcgtcctcttcatggtggactggggcaaggaggccgtggactccttccacctgggggacgacatggaccccgagctgcgcggcctcgcccaggcgctgatcgaccagaaggtgaaggagatcagcaaccaggagcccctgaagctctga

SEQ ID NO: 6325 - RNA, 1290 nt, synthetic construct
  misc_feature 1..1290: note = derived and/or modified CDS sequence (opt1) from DOBV(DOB/Pecs/31Aa/06)__KC848500.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcgtggcccagtccatccagagcaagatcgacgagctgcggcgccagctggccgaccgggtggccgcggggaagaacatcggcaaggagcgcgaccccaccgggctcgaccccggcgaccacctgaaggagaagtccatgctgagctacgggaacgtcatcgacctcaaccacctggacatcgacgagcccacgggccagaccgccgactggctgtccatcgtggtgtacctcaccagcttcgtcgtgcccatcctgctgaaggccctctacatgctgaccacgcggggccgccagaccaccaaggacaacaaggggatgcggatccgcttcaaggacgactccagcttcgaggacgtgaacggcatccggaagccgaagcacctgttcctctccatgcccaacgcccagagctccatgaaggcggacgagatcacccccgggcgcttccggacggccgtctgcggcctgtaccccgcccaggtgaaggcccgcaacctggtgagcccggtcatgtccgtgatcgggttcctcgccctggcgaagaactggaccgagcgggtggaggagtggctggacctcccctgcaagctgctgagcgagccctcccccaccagcctcaccaagggcccgtccacgaaccgcgactacctgaaccagcggcagggcgccctggccaagatggagaccaaggaggcccaggccgtccgcaagcacgcgatcgacgccgggtgcaacatcatcgaccacatcgacagccccagctccatctgggtgttcgccggcgcccccgaccggtgcccgccgacctgcctcttcatcgccgggatggcgcagctgggcgccttcttcagcgtgctgcaggacatgcgcaacaccatcatggcctccaagacgatcggcaccagcgaggagaagctccggaagaagtccagcttctaccagtcctacctgcgccgcacccagagcatggggatccagctggaccagcggatcatcgtcctcttcatggtggactggggcaaggaggccgtggactccttccacctgggggacgacatggaccccgagctgcgcggcctcgcccaggcgctgatcgaccagaagatgaaggagatcagcaaccaggagcccctgaagctctga

SEQ ID NO: 6326 - RNA, 1290 nt, synthetic construct
  misc_feature 1..1290: note = derived and/or modified CDS sequence (opt1) from DOBV(DOB/Sarmellek/77Aa/06)__KC848501.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcgtggcccagtccatccagagcaagatcgacgagctgcggcgccagctggccgaccgggtggcctccgggaagaacatcggcaaggagcgcgaccccaccgggctcgaccccggcgaccacctgacggagaagtccatgctgagctacgggaacgtcatcgacctcaaccacctggacatcgacgagcccaccggccagaccgcggactggctgagcatcgtggtgtacctcacctccttcgtcgtgcccatcctgctgaaggccctctacatgctgacgacccggggccgccagaccaccaaggacaacaaggggatgcggatccgcttcaaggacgacagctccttcgaggacgtgaacggcatccggaagccgaagcacctgttcctcagcatgcccaacgcccagtccagcatgaaggccgacgagatcacgcccgggcgcttccggaccgcgatctgcggcctgtaccccgcccaggtcaaggcccgcaacctggtgtccccggtgatgagcgtcatcgggttcctcgccctggccaagaactggaccgagcgggtggaggagtggctggacctcccctgcaagctgctgtccgagcccagccccacctccctcacgaagggcccgagcaccaaccgcgactacctgaaccagcggcagggcgcgctggccaagatggagaccaaggaggcccaggccgtgcgcaagcacgccatcgacgcggggtgcaacatcatcgaccacatcgacagcccctccagcatctgggtcttcgccggcgcccccgaccggtgcccgccgacctgcctcttcatcgccgggatggccgagctgggcgcgttcttctccgtgctgcaggacatgcgcaacacgatcatggccagcaagaccgtgggcacctccgaggagaagctccggaagaagtccagcttctaccagagctacctgcgccgcacccagtccatggggatccagctggaccagcggatcatcgtcctcttcatggtggactggggcaaggaggccgtggacagcttccacctgggggacgacatggaccccgagctgcgctccctcgcccaggccctgatcgaccagaaggtcaaggagatcagcaaccaggagcccctgaagctctga

SEQ ID NO: 6327 - RNA, 1290 nt, synthetic construct
  misc_feature 1..1290: note = derived and/or modified CDS sequence (opt1) from DOBV(GER/05/239/Aa)__GQ205405.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcgtggcccagtccatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtcatcgacctcaaccacctggacatcgacgagcccacgggccagaccgccgactggctgagcatcgtggtgtacctcacctccttcgtcgtgcccatcctgctgaaggccctctacatgctgaccacgcgggggcgccagaccaccaaggacaacaagggcatgcggatccgcttcaaggacgacagctccttcgaggacgtgaacgggatccggaagccgaagcacctgttcctcagcatgcccaacgcccagtccagcatgaaggcggacgagatcacccccggccgcttccggacggccatctgcgggctgtaccccgcccaggtcaaggcccgcaacctggtgtccccggtgatgagcgtcatcggcttcctcgccctggcgaagaactggaccgagcgggtggaggagtggctggacctcccctgcaagctgctgtccgagcccagccccacctccctcaccaagggcccgagcacgaaccgcgactacctgtcccagcggcagggggccctggccaagatggagaccaaggaggcccaggccgtgcgcaagcacgcgatcgacgccggctgcaacatcatcgaccacatcgacagccccagctccatctgggtcttcgccggggcccccgaccggtgcccgccgacctgcctcttcatcgccggcatggcggagctgggcgccttcttcgccgtgctgcaggacatgcgcaacaccatcatggccagcaagacgatcgggacctccgaggagaagctccggaagaagtccagcttctaccagagctacctgcgccgcacccagtccatgggcatccagctggaccagcggatcatcgtcctcttcatggtggactgggggaaggaggccgtggacagcttccacctgggcgacgacatggaccccgagctgcgctccctcgcgcaggccctgatcgaccagaaggtgaaggagatcagcaaccaggagcccctgaagctctga

SEQ ID NO: 6328 - RNA, 1290 nt, synthetic construct
  misc_feature 1..1290: note = derived and/or modified CDS sequence (opt1) from DOBV(GER/05/477/Af)__GQ205406.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcgtggcccagtccatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtcatcgacctcaaccacctggacatcgacgagcccacgggccagaccgccgactggctgagcatcgtggtgtacctcacctccttcgtcgtgcccatcctgctgaaggccctctacatgctgaccacgcgggggcgccagaccaccaaggacaacaagggcatgcggatccgcttcaaggacgacagctccttcgaggacgtgaacgggatccggaagccgaagcacctgttcctcagcatgcccaacgcccagtccagcatgaaggcggacgagatcacccccggccgcttccggacggccatctgcgggctgtaccccgcccaggtcaaggcccgcaacctggtgtccccggtgatgagcgtcatcggcttcctcgccctggcgaagaactggaccgagcgggtggaggagtggctggacctcccctgcaagctgatctccgagcccagccccacctccctgaccaagggcccgagcacgaaccgcgactacctctcccagcggcagggggccctggccaagatggagaccaaggaggcccaggccgtgcgcaagcacgcgatcgacgccggctgcaacatcatcgaccacatcgacagccccagctccatctgggtcttcgccggggcccccgaccggtgcccgccgacctgcctgttcatcgccggcatggcggagctcggcgccttcttcgccgtgctgcaggacatgcgcaacaccatcatggccagcaagacgatcgggacctccgaggagaagctgcggaagaagtccagcttctaccagagctacctccgccgcacccagtccatgggcatccagctggaccagcggatcatcgtgctgttcatggtcgactgggggaaggaggccgtggacagcttccacctcggcgacgacatggaccccgagctgcgctccctggcgcaggccctcatcgaccagaaggtgaaggagatcagcaaccaggagcccctgaagctgtga

SEQ ID NO: 6329 - RNA, 1290 nt, synthetic construct
  misc_feature 1..1290: note = derived and/or modified CDS sequence (opt1) from DOBV(GER/07/293/Aa)__GQ205401.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcgtggcccagtccatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtcatcgacctcaaccacctggacatcgacgagcccacgggccagaccgccgactggctgagcatcgtggtgtacctcacctccttcgtcgtgcccatcctgctgaaggccctctacatgctgaccacgcgggggcgccagaccaccaaggacaacaagggcatgcggatccgcttcaaggacgacagctccttcgaggacgtgaacgggatccggaagccgaagcacctgttcctcagcatgcccaacgcccagtccagcatgaaggcggacgagatcacccccggccgcttccggacggccatctgcgggctgtaccccgcccaggtcaaggcccgcaacctggtgtccccggtgatgagcgtcatcggcttcctcgccctggcgaagaactggaccgagcgggtggaggactggctggacctcccctgcaagctgctgtccgagcccagccccacctccctcaccaagggcccgagcacgaaccgcgactacctgaaccagcggcagggggccctggccaagatggagaccaaggaggcccaggccgtgcgcaagcacgcgatcgacgccggctgcaacatcatcgaccacatcgactcccccagcagcatctgggtcttcgccggggcccccgaccggtgcccgccgacctgcctcttcatcgccggcatggcggagctgggcgccttcttcgccgtgctgcaggacatgcgcaacaccatcatggcctccaagacgatcgggaccagcgaggagaagctccggaagaagtccagcttctaccagtcctacctgcgccgcacccagagcatgggcatccagctggaccagcggatcatcgtgctcctgatggtcgactgggggaaggaggccgtggactccttccacctgggcgacgacatggaccccgagctccgcgggctggcgcaggccctgatcgaccagaaggtgaaggagatcagcaaccaggagcccctcaagctgtga

SEQ ID NO: 6330 - RNA, 1290 nt, synthetic construct
  misc_feature 1..1290: note = derived and/or modified CDS sequence (opt1) from DOBV(GER/07/424/Aa)__GQ205403.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcgtggcccagtccatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtcatcgacctcaaccacctggacatcgacgagcccacgggccagaccgccgactggctgagcatcgtggtgtacctcacctccttcgtcgtgcccatcctgctgaaggccctctacatgctgaccacgcgggggcgccagaccaccaaggacaacaagggcatgcggatccgcttcaaggacgacagctccttcgaggacgtgaacgggatccggaagccgaagcacctgttcctcagcatgcccaacgcccagtccagcatgaaggcggacgagatcacccccggccgcttccggacggccatctgcgggctgtaccccgcccaggtcaaggcccgcaacctggtgtccccggtgatgagcgtcatcggcttcctcgccctggcgaagaactggaccgagcgggtggaggactggctggacctcccctgcaagctgctgtccgagcccagccccacctccctcaccaagggcccgagcacgaaccgcgactacctgaaccagcggcagggggccctggccaagatggagaccaaggaggcccaggccgtgcgcaagcacgcgatcgacgccggctgcaacatcatcgaccacatcgactcccccagcagcatctgggtcttcgccggggcccccgaccggtgcccgccgacctgcctcttcatcgccggcatggcggagctgggcgccttcttcgccgtgctgcaggacatgcgcaacaccatcatggcctccaagacgatcgggaccagcgaggagaagctccggaagaagtccagcttctaccagtcctacctgcgccgcacccagagcatgggcatccagctggaccagcggatcatcgtcctcttcatggtggactgggggaaggaggccgtggactccttccacctgggcgacgacatggaccccgagctgcgcgggctcgcgcaggccctgatcgaccagaaggtgaaggagatcagcaaccaggagcccctgaagctctga

SEQ ID NO: 6331 - RNA, 1290 nt, synthetic construct
  misc_feature 1..1290: note = derived and/or modified CDS sequence (opt1) from DOBV(GER/08/118/Aa)__GQ205407.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcgtggcccagtccatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtcatcgacctcaaccacctggacatcgacgagcccacgggccagaccgccgactggctgagcatcgtggtgtacctcacctccttcgtcgtgcccatcctgctgaaggccctctacatgctgaccacgcgggggcgccagaccaccaaggacaacaagggcatgcggatccgcttcaaggacgacagctccttcgaggacgtgaacgggatccggaagccgaagcacctgttcctcagcatgcccaacgcccagtccagcatgaaggcggacgagatcacccccggccgcttccggacggccatctgcgggctgtaccccgcccaggtcaaggcccgcaacctggtgtccccggtgatgagcgtcatcggcttcctcgccctggcgaagaactggaccgagcgggtggaggactggctggacctcccctgcaagctgctgtccgagcccagccccacctccctcaccaagggcccgagcacgaaccgcgactacctgaaccagcggcagggggccctggccaagatggagaccaaggaggcccaggccgtgcgcaagcacgcgatcgacgccggctgcaacatcatcgaccacatcgactcccccagcagcatctgggtcttcgccggggcccccgaccggtgcccgccgacctgcctcttcatcgccggcatggcggagctgggcgccttcttcgccgtgctgcaggacatgcgcaacaccatcatggcctccaagacggtggggaccagcgaggagaagatgcggaagaagtccagcttctaccagtcctacctccgccgcacccagagcatgggcatccagctggaccagcggatcatcgtcctgttcatggtggactgggggaaggaggccgtggactccttccacctcggcgacgacatggaccccgagctgcgcgggctggcgcaggccctcatcgaccagaaggtcaaggagatcagcaaccaggagcccctgaagctgtga

SEQ ID NO: 6332 - RNA, 1290 nt, synthetic construct
  misc_feature 1..1290: note = derived and/or modified CDS sequence (opt1) from DOBV(GER/08/131/Af)__GQ205408.1__N
  source 1..1290: mol_type = other RNA
atggccaccctggaggagctccagaaggagatcaacagccacgagggccagctggtgatcgcccgccagaaggtcaaggacgcggagaagcagtacgagaaggaccccgacgacctgaacaagcgggccctctccgaccgcgagagcgtggcccagtccatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtcatcgacctcaaccacctggacatcgacgagcccacgggccagaccgccgactggctgagcatcgtggtgtacctcacctccttcgtcgtgcccatcctgctgaaggccctctacatgctgaccacgcgggggcgccagaccaccaaggacaacaagggcatgcggatccgcttcaaggacgacagctccttcgaggacgtgaacgggatccggaagccgaagcacctgttcctcagcatgcccaacgcccagtccagcatgaaggcggacgagatcacccccggccgcttccggacggccgtctgcgggctgtaccccgcccaggtgaaggcccgcaacctggtgtccccggtcatgagcgtgatcggcttcctcgccctggcgaagaactggaccgagcgggtggaggactggctggacctcccctgcaagctgctgtccgagcccagccccacctccctcaccaagggcccgagcacgaaccgcgactacctgaaccagcggcagggggccctggccaagatggagaccaaggaggcccaggccgtccgcaagcacgcgatcgacgccggctgcaacatcatcgaccacatcgactcccccagcagcatctgggtgttcgccggggcccccgaccggtgcccgccgacctgcctcttcatcgccggcatggcggagctgggcgccttcttcgccgtgctgcaggacatgcgcaacaccatcatggcctccaagacgatcgggaccagcgaggagaagctccggaagaagtccagcttctaccagtcctacctgcgccgcacccagagcatgggcatccagctggaccagcggatcatcgtcctcttcatggtggactgggggaaggaggccgtggactccttccacctgggcgacgacatggaccccgagctgcgcgggctcgcgcaggccctgatcgaccagaaggtcaaggagatcagcaaccaggagcccctgaagctctga

SEQ ID NO: 6333 - RNA, 1290 nt, synthetic construct
  misc_feature 1..1290: note = derived and/or modified CDS sequence (opt1) from HTNV(76-118/POR)__KT885049.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccaaccgcgagggggtggccgtgagcatccaggccaagatcgacgagctcaagatgcagctggcggaccggatcgccacgggcaagaacctggggaaggagcaggaccccaccggcgtcgagcccggggaccacctcaaggagcgctccatgctgagctacggcaacgtgctggacctcaaccacctggacatcgacgagcccaccggccagaccgccgactggctgtccatcatcgtgtacctcacgagcttcgtcgtgcccatcctgctgaaggccctctacatgctgaccacccgggggcgccagaccacgaaggacaacaagggcacccggatccgcttcaaggacgactccagcttcgaggacgtgaacgggatccggaagccgaagcacctgtacgtctccctccccaacgcgcagagctccatgaaggccgaggagatcacccccggccgctaccggaccgccgtgtgcgggctgtaccccgcccagatcaaggcccgccagatgatcagcccggtgatgtccgtcatcggcttcctggcgctcgccaaggactggagcgaccggatcgagcagtggctgatcgagccctgcaagctgctccccgacacggccgccgtgtccctgctgggcgggcccgccaccaaccgcgactacctccggcagcgccaggtggcgctgggcaacatggagaccaaggagagcaaggccatccggcagcacgccgaggccgccgggtgctccatgatcgaggacatcgagagcccgtccagcatctgggtcttcgcgggcgcccccgaccgctgcccgccgacctgcctgttcatcgccggcatcgccgagctcggggccttcttctccatcctgcaggacatgcggaacacgatcatggcgagcaagaccgtgggcaccagcgaggagaagctgcgcaagaagtccagcttctaccagtcctacctccgccggacccagagcatggggatccagctggaccagcgcatcatcgtgctgttcatggtcgcctggggcaaggaggccgtggacaacttccacctcggggacgacatggaccccgagctgcggacgctggcccagtccctcatcgacgtgaaggtcaaggagatcagcaaccaggagcccctgaagctgtga

SEQ ID NO: 6334 - RNA, 1290 nt, synthetic construct
  misc_feature 1..1290: note = derived and/or modified CDS sequence (opt1) from HTNV(A16)__AF288646.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgaggggctcgccgccagcatccaggcgaagatcgacgagctgaagcggcagctggccgaccgcatcgccacgggcaagaacctcgggaaggagcaggaccccaccggcgtggagcccggggaccacctgaaggagcggtccatgctgagctacggcaacgtgctcgacctgaaccacctggacatcgacgagcccaccggccagaccgccgactggctctccatcgtcatctacctgacgagcttcgtggtgcccatcctgctcaaggcgctgtacatgctgaccacccgcgggcggcagaccacgaaggacaacaagggcacccgcatccggttcaaggacgactccagcttcgaggacgtcaacgggatccgcaagccgaagcacctctacgtgtccctgcccaacgcccagagctccatgaaggccgaggagatcacccccggccggtaccgcaccgccatctgcgggctgtaccccgcccagatcaaggcgcggcagatgatcagcccggtgatgtccgtcatcggcttcctcgccctggccaaggactggagcgaccgcatcgagcagtggctgtccgagccctgcaagctcctgcccgacacggccgccgtgagcctgcacggcgggcccgcgaccaaccgggactacctccgccagcgccaggtggccctgggcaacatggagaccaaggagtccaaggccatccggcagcacgccgagagcgccgggtgctccatggtcgaggacatcgagagcccgtccagcatctgggtgttcgcgggcgcccccaaccggtgcccgccgacctgcctgttcatcgccggcatcgccgagctcggggccttcttcagcatcctgcaggacatgcgcaacacgatcatggcgtccaagaccgtgggcaccagcgaggagaagctgcgcaagaagtccagcttctaccagtcctacctccggcgcacccagagcatggggatccagctggaccagcggatcatcgtcctgttcatggtggcctggggcaaggaggccgtggacaacttccacctcggggacgacatggaccccgtcctgcgcacgctggcccagtccctcatcgacgtgaaggtgaaggagatcagcaaccaggagcccctgaagctgtga

SEQ ID NO: 6335 - RNA, 1290 nt, synthetic construct
  misc_feature 1..1290: note = derived and/or modified CDS sequence (opt1) from HTNV(CA09082007)__HQ834499.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggaccccaccggcgtggagcccggggaccacctcaaggagcggtccatgctgagctacggcaacgtcctggacctcaaccacctggacatcgacgagcccaccggccagaccgccgactggctgtccatcgtgatctacctcacgagcttcgtggtccccatcctgctgaaggcgctctacatgctgaccacccgcgggcggcagaccacgaaggacaacaagggcacccgcatccggttcaaggacgactccagcttcgaggacgtgaacgggatccgcaagccgaagcacctgtacgtgtccctccccaacgcccagagctccatgaaggccgaggagatcacccccggccggtaccgcaccgccatctgcgggctgtaccccgcccagatcaaggcgcggcagatgatcagcccggtcatgtccgtgatcggcttcctggccctcgccaaggactggagcgaccgcatcgagcagtggctgtccgagccctgcaagctgctccccgacacggccgccgtgagcctgcacggcgggcccgcgaccaaccgggactacctgcgccagcggcaggtcgccctcggcaacatggagaccaaggagtccaaggccatccgccagcacgccgagagcgccgggtgctccatggtggaggacatcgagagcccgtccagcatctgggtgttcgcgggcgcccccgaccggtgcccgccgacctgcctgttcatcgccggcatcgccgagctgggggccttcttcagcatcctccaggacatgcgcaacacgatcatggcgtccaagaccgtcggcaccagcgaggagaagctgcgcaagaagtccagcttctaccagtcctacatccggcgcacccagagcatggggatccagctggaccagcggatcatcgtcctcttcatggtggcctggggcaaggaggccgtggacaacttccacctgggggacgacatggaccccgagctgcgcacgctcgcccagtccctgatcgacctgaaggtgaaggagatcagcaaccaggagcccctcaagctgtga

SEQ ID NO: 6336 - RNA, 1290 nt, synthetic construct
  misc_feature 1..1290: note = derived and/or modified CDS sequence (opt1) from HTNV(CA10081109)__HQ834500.1__N
  source 1..1290: mol_type = other RNA
atgcccaccagcggcgagctgcagcgcgagatcaacgcccacgaggggcagctcgtgatcgcccggcagaaggtccgcgacgcggagaagcagtacgagaaggaccccgacgagctgaacaagcgggccctgaccgaccgcgagggcgtggccgcctccatccaggccaagatcgacgagctcaagcggcagctggcggaccgcatcgccacggggaagaacctgggcaaggagcaggaccccaccggggtggagcccggcgaccacctcaaggagcggagcatgctgtcctacggcaacgtcctggacctcaaccacctggacatcgacgagcccaccgggcagaccgccgactggctgagcatcgtgatctacctcacgtccttcgtggtcccgatcctgctgaaggccctctacatgctgaccacccgcggccggcagaccacgaaggacaacaaggggacccgcatccggttcaaggacgacagctccttcgaggacgtgaacggcatccgcaagcccaagcacctgtacgtgagcctccccaacgcgcagtccagcatgaaggccgaggagatcacccccgggcggtaccgcaccgccatctgcgagctgtacccggcccagatcaaggcctccaagatgatcagccccgtcatgtccgtgatcggcttcctggcgctcgccaaggactggagcgaccggatcgagcagtggctgtccgagccctgcaagctgctccccgacacggccgccgtgagcctgcacggcgggccggccaccaaccgcgactacctgcggcagcgccaggtcgcgctcggcaacatggagaccaaggagtccaaggccatccggcagcacgccgagagcgccgggtgctccatggtggaggacatcgagagccccagctccatctgggtgttcgccggcgcgcccgaccgctgcccgccgacctgcctgttcatcgccggcatcgccgagctgggggccttcttcagcatcctccaggacatgcggaacacgatcatggcctccaagaccgtcggcaccagcgaggagaagctgcgcaagaagtccagcttctaccagtcctacctgcgccggacccagagcatggggatccagctcgaccagcgcatcatcgtgctgttcatggtggcgtggggcaaggaggccgtcgacaacccccacgccggggacgacgtggacccctccctgggcatgctcgcccagagcctgatcgacgtgaaggtcaaggagatctccaaccaggagcccctgaagctctga

SEQ ID NO: 6337 - RNA, 1290 nt, synthetic construct
  misc_feature 1..1290: note = derived and/or modified CDS sequence (opt1) from HTNV(CA10081113)__HQ834501.1__N
  source 1..1290: mol_type = other RNA
atggccaccagcggcgagctgcagcgcgagatcaacgcccacgaggggcagctcgtgatcgcgcggcagaaggtccgcgacgccgagaagcagtacgagaaggaccccgacgagctgaacaagcgggccctgaccgaccgcgagggcgtggccgcctccatccaggcgaagatcgacgagctcaagcggcagctggccgaccgcatcgccacggggaagaacctgggcaaggagcaggaccccaccggggtggagcccggcgaccacctcaaggagcggagcatgctgtcctacggcaacgtcctggacctcaaccacctggacatcgacgagcccaccgggcagaccgccgactggctgagcatcgtgatctacctcacgtccttcgtggtccccatcctgctgaaggcgctctacatgctgaccacccgcggccggcagaccacgaaggacaacaaggggacccgcatccggttcaaggacgacagctccttcgaggacgtgaacggcatccgcaagccgaagcacctgtacgtgagcctccccaacgcccagtccagcatgaaggccgaggagatcacccccgggcggtaccgcaccgccatcttcgagctgtaccccgcccagatcaaggcgcggcagatgatctccccggtcatgagcgtgatcggcttcctggccctcgccaaggactggtccgaccgcatcgagcagtggctgagcgagccctgcaagctgctccccgacacggccgccgtgtccctgcacggcgggcccgcgaccaaccgggactacctgcgccagcggcaggtcgccctcggcaacatggagaccaaggagagcaaggccatccgccagcacgccgagtccgccgggtgcagcatggtggaggacatcgagtccccgagcagcatctgggtgttcgcgggcgcccccgaccggtgcccgccgacctgcctgttcatcgccggcatcgccgagctgggggccttcttctccatcctccaggacatgcgcaacacgatcatggcgagcaagaccgtcggcacctccgaggagaagctgcgcaagaagtccagcttctaccagagctacctgcggcgcacccagtccatggggatccagctcgaccagcggatcatcgtgctgttcatggtggcctggggcaaggaggccgtcgacaaccgccacctgatgaacatcgtggaccccgagccccgggccctcgcgcagagcctgatcgacgtgaaggtcaaggagatctccaaccaggagcccctgaagctctga

SEQ ID NO: 6338 - RNA, 1290 nt, synthetic construct
  misc_feature 1..1290: note = derived and/or modified CDS sequence (opt1) from HTNV(CA10081203)__HQ834502.1__N
  source 1..1290: mol_type = other RNA
atggccaccaacggcgagctgcagcgcgagatcaacgcccacgaggggcagctcgtgatcgcgcggcagaaggtccgcgacgccgagaagcagtacgagaaggaccccgacgagctgaacaagcgggccctgaccgaccgcgagggcgtggccgccagcatccaggcgaagatcgacgagctcaagcggcagctggccgaccgcatcgccacggggaagaacctgggcaaggagcaggaccccaccggggtggagcccggcgaccacctcaaggagcggtccatgctgagctacggcaacgtcctggacctcaaccacctggacatcgacgagcccaccgggcagaccgccgactggctgtccatcgtgatctacctcacgagcttcgtggtccccatcctgctgaaggcgctctacatgctgaccacccgcggccggcagaccacgaaggacaacaaggggacccgcatccggttcaaggacgactccagcttcgaggacgtgaacggcatccgcaagccgaagcacctgtacgtgtccctccccaacgcccagagctccatgaaggccgaggagatcacccccgggcggtaccgcaccgccatcttcggcctgtaccccgcccagatcaaggcgcggcagatgatcagcccggtcatgtccgtgatcggcttcctggccctcgccaaggactggagcgaccgcatcgagcagtggctgtccgagccctgcaagctgctccccgacacggccgccgtgagcctgcacgggggccccgcgaccaaccgggactacctgcgccagcggcaggtcgccctcgggaacatggagaccaaggagtccaaggccatccgccagcacgccgagagcgccggctgctccatggtggaggacatcgagagcccgtccagcatctgggtgttcgcgggcgcccccgaccggtgcccgccgacctgcctgttcatcgccgggatcgccgagctgggcgccttcttcagcatcctccaggacatgcgcaacacgatcatggcgtccaagaccgtcgggaccagcgaggagaagctgcgcaagaagtccagcttctaccagtcctacctgcggcgcacccagagcatgggcatccagctcgaccagcggatcatcgtgctgttcatggtggcctgggggaaggaggccgtcgacgagctgcactccggcgacggcgagcaccacgccagccgcacgctcgcgcagtccctgatcgacgtgaaggtgaaggagatcagcaaccaggagcccctgaagctctga

SEQ ID NO: 6339 - RNA, 1290 nt, synthetic construct
  misc_feature 1..1290: note = derived and/or modified CDS sequence (opt1) from HTNV(CA10081206)__HQ834503.1__N
  source 1..1290: mol_type = other RNA
atggccaccatcgaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggaccccaccggcgtggagcccggggaccacctcaaggagcggtccatgctgagctacggcaacgtcctggacctcaaccacctggacatcgacgagcccaccggccagaccgccgactggctgtccatcgtgatctacctcacgagcttcgtggtccccatcctgctgaaggcgctctacatgctgaccacccgcgggcggcagaccacgaaggacaacaagggcacccgcatccggttcaaggacgactccagcttcgaggacgtgaacgggatccgcaagccgaagcacctgtacgtgtccctccccaacgcccagagctccatgaaggccgaggagatcacccccggccggtaccgcaccgccatctgcgggctgtaccccgcccagatcaaggcgcggcagatgatcagcccggtcatgtccgtgatcggcttcctggccctcgccaaggactggagcgaccgcatcgagcagtggctgtccgagccctgcaagctgctccccgacacggccgccgtgagcctgcacggcgggcccgcgaccaaccgggactacctgcgccagcggcaggtcgccctcggcaacatggagaccaaggagtccaaggccatccgccagcacgccgagagcgccgggtgctccatggtggaggacatcgagagcccgtccagcatctgggtgttcgcgggcgcccccgaccggtgcccgccgacctgcctgttcatcgccggcatcgccgagctgggggccttcttcagcatcctccaggacatgcgcaacacgatcatggcgtccaagaccgtcggcaccagcgaggagaagctgcgcaagaagtccagcttctaccagtcctacctgcggcgcacccagagcatggggatccagctcgaccagcggatcatcgtgctgttcatggtggcctggggcaaggaggccgtcgacaacttccacgcctgggacgggatggaccccgagctgcgcacgctcgcgcagtccctgatcgacgtgaaggtgaaggagatcagcaaccaggagcccctgaagctctga

SEQ ID NO: 6340 - RNA, 1290 nt, synthetic construct
  misc_feature 1..1290: note = derived and/or modified CDS sequence (opt1) from HTNV(CA10081708)__HQ834504.1__N
  source 1..1290: mol_type = other RNA
atgcccaccagcggcgagctgcagcgcgagatcaacgcccacgaggggcagctcgtgatcgcccggcagaaggtccgcgacgcggagaagcagtacgagaaggaccccgacgagctgaacaagcgggccctgaccgaccgcgagggcgtggccgcctccatccaggccaagatcgacgagctcaagcggcagctggcggaccgcatcgccacggggaagaacctgggcaaggagcaggaccccaccggggtggagcccggcgaccacctcaaggagcggagcatgctgtcctacggcaacgtcctggacctcaaccacctggacatcgacgagcccaccgggcagaccgccgactggctgagcatcgtgatctacctcacgtccttcgtggtcccgatcctgctgaaggccctctacatgctgaccacccgcggccggcagaccacgaaggacaacaaggggacccgcatccggttcaaggacgacagctccttcgaggacgtgaacggcatccgcaagcccaagcacctgtacgtgagcctccccaacgcgcagtccagcatgaaggccgaggagatcacccccgggcggtaccgcaccgccatcttcgagctgtacccggcccagatcaaggcccggaagatgatctcccccgtcatgagcgtgatcggcttcctggcgctcgccaaggactggtccgaccgcatcgagcagtggctgagcgagccctgcaagctgctccccgacacggccgccgtgtccctgcacggcgggccggccaccaaccgggactacctgcgccagcggcaggtcgcgctcggcaacatggagaccaaggagagcaaggccatccgccagcacgccgagtccgccgggtgcagcatggtggaggacatcgagtcccccagcagcatctgggtgttcgccggcgcgcccgaccggtgcccgccgacctgcctgttcatcgccggcatcgccgagctgggggccttcttctccatcctccaggacatgcgcaacacgatcatggccagcaagaccgtcggcacctccgaggagaagctgcgcaagaagtccagcttctaccagagctacctgcggcgcacccagtccatggggatccagctcgaccagcggatcatcgtgctgttcatggtggcgtggggcaaggaggccgtcgacaacccccacacgggggacgacgccgaccccgagctgcgcaccctcgcccagagcctgatcgacgtgaaggtgaaggagatctccaaccaggagcccctgaagctctga

SEQ ID NO: 6341 - RNA, 1290 nt, synthetic construct
  misc_feature 1..1290: note = derived and/or modified CDS sequence (opt1) from HTNV(CA10081905)__HQ834505.1__N
  source 1..1290: mol_type = other RNA
atggccaccagcggcgagctgcagcgcgagatcaacgcccacgaggggcagctcgtgatcgcgcggcagaaggtccgcgacgccgagaagcagtacgagaaggaccccgacgagctgaacaagcgggccctgaccgaccgcgagggcgtggccgcctccatccaggcgaagatcgacgagctcaagcggcagctggccgaccgcatcgccacggggaagaacctgggcaaggagcaggaccccaccggggtggagcccggcgaccacctcaaggagcggagcatgctgtcctacggcaacgtcctggacctcaaccacctggacatcgacgagcccaccgggcagaccgccgactggctgagcatcgtgatctacctcacgtccttcgtggtccccatcctgctgaaggcgctctacatgctgaccacccgcggccggcagaccacgaaggacaacaaggggacccgcatccggttcaaggacgacagctccttcgaggacgtgaacggcatccgcaagccgaagcacctgtacgtgagcctccccaacgcccagtccagcatgaaggccgaggagatcacccccgggcggtaccgcaccgccatcttcgagctgtaccccgcccagatcaaggcgcggaagatgatctccccggtcatgagcgtgatcggcttcctggccctcgccaaggactggtccgaccgcatcgagcagtggctgagcgagccctgcaagctgctccccgacacggccgccgtgtccctgcacggcgggcccgcgaccaaccgggactacctgcgccagcggcaggtcgccctcggcaacatggagaccaaggagagcaaggccatccgccagcacgccgagtccgccgggtgcagcatggtggaggacatcgagtccccgagcagcatctgggtgttcgcgggcgcccccgaccggtgcccgccgacctgcctgttcatcgccggcatcgccgagctgggggccttcttctccatcctccaggacatgcgcaacacgatcatggcgagcaagaccgtcggcacctccgaggagaagctgcgcaagaagtccagcttctaccagagctacctgcggcgcacccagtccatggggatccagctcgaccagcggatcatcgtgctgttcatggtggcctggggcaaggaggccgtcgacaaccaccacctgatcaacgccggggaccacgagctccgcacgctggcgcagagcctgatcgacgtgaaggtgaaggagatctccaaccaggagcccctcaagctgtga

SEQ ID NO: 6342 - RNA, 1290 nt, synthetic construct
  misc_feature 1..1290: note = derived and/or modified CDS sequence (opt1) from HTNV(E142)__AF288644.1__N
  source 1..1290: mol_type = other RNA
atggccaccatggaggagctgcagcgcgagatcaacgcccacgagggccagctcgtgatcgcgcggcagaaggtccgcgacgccgagaagcggtacgagaaggaccccgacgagctgaacaagcgcaccctgacggaccgggagggggtggccgccagcatccaggccaagatcgacgagctcaagcgccagctggcggaccggatcgccaccggcaagaacctggggaaggagcaggacccgaccggcgtggagcccggggaccacctcaaggagcgctccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgggggcgccagacgaccaaggacaacaagggcacccggatccgcttcaaggacgactccagctccgaggacgtgaacgggatccggaagccgaagcacctgtacgtgagcctccccaacgcgcagtccagcatgaaggccgaggagatcacccccggccgctaccggacggccatctgcgggctgtaccccgcccagatcaaggcccgccagatgatctccccggtcatgagcgtgatcggcttcctggcgctcgccaaggactggtccgaccggatcgagcagtggctgagcgagccctgcaagctgctccccgacaccgccgccgtgtccctgcacggcgggcccgccaccaaccgcgactacctgcggcagcgccaggtcgcgctcggcaacatggagaccaaggagagcaaggccatccggcagcacgccgagtccgccgggtgcagcatgatcgaggacatcgagtccccgagcagcatctgggtgttcgccggcgcgcccgaccgctgcccgcccacgtgcctgttcatcgccggcatcgccgagctgggggccttcttctccatcctccaggacatgcgcaacaccatcatggccagcaagaccgtgggcacctccgaggagaagctgcggaagaagtccagcttctaccagagctacctgcgccggacgcagtccatggggatccagctcgaccagcgcatcatcgtcctgttcatggtggcgtggggcaaggaggtggtcgacaacttccacctgggggacgacatggaccccgagctccggaccctggcccagagcctgatcgacgtgaaggtgaaggagatctccaaccaggagcccctcaagctgtga

SEQ ID NO: 6343 - RNA, 1290 nt, synthetic construct
  misc_feature 1..1290: note = derived and/or modified CDS sequence (opt1) from HTNV(H10150)__HQ834506.1__N
  source 1..1290: mol_type = other RNA
atggccaccatgggcgagctgcagcgcgagatcaacgcccacgaggggcagctcgtgatcgcgcggcagaaggtccgcgacgccgagaagcagtacgagaaggaccccgacgagctgaacaagcgggccctgaccgaccgcgagggcgtggccgccagcatccaggcgaagatcgacgagctcaagcggcagctggccgaccgcatcgccacggggaagaacctgggcaaggagcaggaccccaccggggtggagcccggcgaccacctcaaggagcggtccatgctgagctacggcaacgtcctggacctcaaccacctggacatcgacgagcccaccgggcagaccgccgactggctgtccatcgtgatctacctcacgagcttcgtggtccccatcctgctgaaggcgctctacatgctgaccacccgcggccggcagaccacgaaggacaacaaggggacccgcatccggttcaaggacgactccagcttcgaggacgtgaacggcatccgcaagccgaagcacctgtacgtgtccctccccaacgcccagagctccatgaaggccgaggagatcacccccgggcggtaccgcaccgccatcttcggcctgtaccccgcccagatcaaggcgcggcagatgatcagcccggtcatgtccgtgatcggcttcctggccctcgccaaggactggagcgaccgcatcgagcagtggctgtccgagccctgcaagctgctccccgacacggccgccgtgagcctgcacgggggccccgcgaccaaccgggactacctgcgccagcggcaggtcgccctcgggaacatggagaccaaggagtccaaggccatccgccagcacgccgagagcgccggctgctccatggtggaggacatcgagagcccgtccagcatctgggtgttcgcgggcgcccccgaccggtgcccgccgacctgcctgttcatcgccgggatcgccgagctgggcgccttcttcagcatcctccaggacatgcgcaacacgatcatggcgtccaagaccgtcgggaccagcgaggagaagctgcgcaagaagtccagcttctaccagtcctacctgcggcgcacccagagcatgggcatccagctcgaccagcggatcatcgtgctgttcatggtggcctgggggaaggaggccgtcgacaaccaccactgggccaacgcgatcggctccgagctgcgcacgctcgcccagagcctgatcgacgtgaaggtgaaggagatctccaaccaggagcccctgaagctctga

SEQ ID NO: 6344 - RNA, 1290 nt, synthetic construct
  misc_feature 1..1290: note = derived and/or modified CDS sequence (opt1) from HTNV(Aa03-161)__KT935024.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccgtgtgcgggctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacgccgccgccgtgagcctgctgggcgggcccgcgacgaaccgggactacctccgccagcggcaggtcgccctgggcaacatggagaccaaggagtccaaggccatccgccagcacgccgaggccgcggggtgcagcatgatcgaggacatcgagtccccgagctccatctgggtgttcgccggcgcccccgaccggtgcccgccgacctgcctgttcatcgccggcatcgccgagctcggggcgttcttcagcatcctgcaggacatgcgcaacaccatcatggccagcaagacggtgggcacctccgaggagaagctgcgcaagaagtccagcttctaccagagctacctccggcgcacccagtccatggggatccagctggaccagcggatcatcgtcctgttcatggtggcctggggcaaggaggccgtggacaacttccacctcggggacgacatggaccccgagctgcgcaccctggcgcagagcctcatcgacgtcaaggtgaaggagatctccaaccaggagcccctgaagctgtga

SEQ ID NO: 6345 - RNA, 1290 nt, synthetic construct
  misc_feature 1..1290: note = derived and/or modified CDS sequence (opt1) from HTNV(Aa04-722)__KU207190.1__N
  source 1..1290: mol_type = other RNA
atggccaccatggaggagctgcagcgcgagatcaacgcccacgagggccagctcgtgatcgcgcggcagaaggtccgcgacgccgagcggcagtacgagaaggaccccgacgagctgaacaagcgcgccctgaccgaccgggagggggtggccgtgagcatccaggccaagatcgacgagctcaagcgccagctggcggaccggatcgccacgggcaagaacctggggaaggagcaggaccccaccggcgtcgagcccggggaccacctcaaggagcgctccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgggggcgccagaccacgaaggacaacaagggcacccggatccgcttcaaggacgactccagcttcgaggacgtcaacgggatccggaagccgaagcacctgtacgtgtccctccccaacgcgcagagctccatgaaggccgaggagatcacccccggccgctaccggaccgccgtgtgcgggctgtaccccgcccagatcaaggcccgccagatgatcagcccggtcatgtccgtgatcggcttcctggcgctcgccaaggactggagcgaccggatcgagcagtggctgtccgagccctgcaagctgctccccgacacggccgccgtgagcctgctgggcgggcccgccaccaaccgcgactacctccggcagcgccaggtcgcgctgggcaacatggagaccaaggagtccaaggccatccggcagcacgccgaggccgccgggtgcagcatgatcgaggacatcgagtccccgagctccatctgggtgttcgcgggcgcccccgaccgctgcccgccgacctgcctgttcatcgccggcatcgccgagctcggggccttcttcagcatcctgcaggacatgcgcaacacgatcatggcgagcaagaccgtgggcacctccgaggagaagctgcggaagaagtccagcttctaccagagctacctccgccggacccagtccatggggatccagctggaccagcgcatcatcgtcctgttcatggtggcctggggcaaggaggccgtggacaacttccacctcggggacgacatggaccccgagctgcggacgctggcccagagcctcatcgacgtcaaggtgaaggagatctccaaccaggagcccctgaagctgtga

SEQ ID NO: 6346 - RNA, 1290 nt, synthetic construct
  misc_feature 1..1290: note = derived and/or modified CDS sequence (opt1) from HTNV(Aa05-190)__KT935027.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccgtgtgcgggctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacacggccgccgtgagcctgctgggcgggcccgccaccaaccgggactacctccgccagcggcaggtcgcgctgggcaacatggagaccaaggagtccaaggccatccgccagcacgccgaggccgccgggtgcagcatgatcgaggacatcgagtccccgagctccatctgggtgttcgcgggcgcccccgaccggtgcccgccgacctgcctgttcatcgccggcatcgccgagctcggggccttcttcagcatcctgcaggacatgcgcaacacgatcatggcgagcaagaccgtgggcacctccgaggagaagctgcgcaagaagtccagcttctaccagagctacctccggcgcacccagtccatggggatccagctggaccagcggatcatcgtcctgttcatggtggcctggggcaaggaggccgtggacaacttccacctcggggacgacatggaccccgagctgcgcacgctggcccagagcctcatcgacgtcaaggtgaaggagatctccaaccaggagcccctgaagctgtga

SEQ ID NO: 6347 - RNA, 1290 nt, synthetic construct
  misc_feature 1..1290: note = derived and/or modified CDS sequence (opt1) from HTNV(Aa10-123)__KT935036.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggacccgaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccgtgtgcgggctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacacgaccgccgtgagcctgctgggcgggcccgccaccaaccgggactacctccgccagcggcaggtcgccctgggcaacatggagaccaaggagtccaaggcgatccgccagcacgccgaggccgccgggtgcagcatgatcgaggacatcgagtccccgagctccatctgggtgttcgccggcgcgcccgaccggtgcccgcccacgtgcctgttcgtggccggcatcgccgagctcggggccttcttcagcatcctgcaggacatgcgcaacaccatcatggccagcaagaccgtcggcacctccgaggagaagctgcgcaagaagtccagcttctaccagagctacctccggcgcacgcagtccatggggatccagctggaccagcggatcatcgtgctgttcatggtggcgtggggcaaggaggccgtcgacaacttccacctcggggacgacatggaccccgagctgcgcaccctggcccagagcctcatcgacgtgaaggtgaaggagatctccaaccaggagcccctgaagctgtga

SEQ ID NO: 6348 - RNA, 1290 nt, synthetic construct
  misc_feature 1..1290: note = derived and/or modified CDS sequence (opt1) from HTNV(Aa10-265)__KU207194.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccgtgtgcgggctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacacggccgccgtgagcctgctgggcgggcccgccaccaaccgggactacctccgccagcggcaggtcgcgctgggcaacatggagaccaaggagtccaaggccatccgccagcacgccgaggccgccgggtgcagcatgatcgaggacatcgagtccccgagctccatctgggtgttcgcgggcgcccccgaccggtgcccgccgacctgcctgttcgtggccggcatcgccgagctcggggccttcttcagcatcctgcaggacatgcgcaacacgatcatggcgagcaagaccgtcggcacctccgaggagaagctgcgcaagaagtccagcttctaccagagctacctccggcgcacccagtccatggggatccagctggaccagcggatcatcgtgctgttcatggtggcctggggcaaggaggccgtcgacaacttccacctcggggacgacatggaccccgagctgcgcacgctggcccagagcctcatcgacgtgaaggtgaaggagatctccaaccaggagcccctgaagctgtga

SEQ ID NO: 6349 - RNA, 1290 nt, synthetic construct
  misc_feature 1..1290: note = derived and/or modified CDS sequence (opt1) from HTNV(AA1028)__AF427318.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccatctgcgggctgtaccccgcccagatcaaggcccggcagatgatcagcccggtgatgtccgtcatcggcttcctggcgctcgccaaggactggagcgaccgcatcgagcagtggctgtccgagccctgcaagctgctccccgacacggccgccgtgagcctgctgggcgggcccgccaccaaccgggactacctccgccagcgccaggtggcgctgggcaacatggagaccaaggagtccaaggccatccggcagcacgccgaggccgccgggtgcagcatgatcgaggacatcgagtccccgagctccatctgggtcttcgcgggcgcccccgaccggtgcccgccgacctgcctgttcatcgccggcatcgccgagctcggggccttcttcagcatcctgcaggacatgcgcaacacgatcatggcgagcaagaccgtgggcacctccgaggagaagctgcgcaagaagtccagcttctaccagagctacctccggcgcacccagtccatggggatccagctggaccagcggatcatcgtgctgttcatggtcgcctggggcaaggaggccgtggacaacttccacctcggggacgacatggaccccgagctgcgcacgctggcccagagcctcatcgacgtgaaggtcaaggagatctccaaccaggagcccctgaagctgtga

SEQ ID NO: 6350 - RNA, 1290 nt, synthetic construct
  misc_feature 1..1290: note = derived and/or modified CDS sequence (opt1) from HTNV(Aa10-434)__KT935038.1__N
  source 1..1290: mol_type = other RNA
atggccaccatggaggagctgcagcgcgagatcaacgcccacgagggccagctcgtgatcgcgcggcagaaggtccgcgacgccgagaagcagtacgggaaggaccccgacgagctgaacaagcgggccctgaccgaccgcgagggcgtggccgtgagcatccaggccaagatcgacgagctcaagcggcagctggcggaccgcatcgccacggggaagaacctgggcaaggagcaggaccccaccggggtcgagcccggcgaccacctcaaggagcggtccatgctgagctacggcaacgtgctggacctcaaccacctggacatcgacgagcccaccgggcagaccgccgactggctgtccatcgtggtctacctcacgagcttcgtggtgcccatcctgctgaaggccctctacatgctgaccacccgcggccggcagaccacgaaggacaacaaggggacccgcatccggttcaaggacgactccagcttcgaggacgtcaacggcatccgcaagccgaagcacctgtacgtgtccctccccaacgcgcagagctccatgaaggccgaggagatcacccccgggcggtaccgcaccgccgtgtgcggcctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacacggccgccgtgagcctgctcgggggccccgccaccaaccgggactacctgcgccagcggcaggtcgcgctggggaacatggagaccaaggagtccaaggccatccgccagcacgccgaggccgccggctgcagcatgatcgaggacatcgagtccccgagctccatctgggtgttcgcgggcgcccccgaccggtgcccgccgacctgcctgttcatcgccgggatcgccgagctcggcgccttcttcagcatcctgcaggacatgcgcaacacgatcatggcgagcaagaccgtggggacctccgaggagaagctgcgcaagaagtccagcttctaccagagctacctccggcgcacccagtccatgggcatccagctggaccagcggatcatcgtcctgttcatggtggcctgggggaaggaggccgtggacaacttccacctcggcgacgacatggaccccgagctgcgcacgctggcccagagcctcatcgacgtcaaggtgaaggagatctccaaccaggagcccctgaagctgtga

SEQ ID NO: 6351 - RNA, 1290 nt, synthetic construct
  misc_feature 1..1290: note = derived and/or modified CDS sequence (opt1) from HTNV(Aa14-362)__KT935049.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccgtgtgcgggctgtaccccgcccagatcaaggcccggcagatgatcagcccggtcatgtccgtgatcggcttcctggcgctcgccaaggactggagcgaccgcgtggagcagtggctgtccgagccctgcaagctgctccccgacacggccgccgtcagcctgctgggcgggcccgccaccaaccgggactacctccgccagcgccaggtggcgctgggcaacatggagaccaaggagtccaaggccatccggcagcacgccgaggccgccgggtgcagcatgatcgaggacatcgagtccccgagctccatctgggtgttcgcgggcgcccccgaccggtgcccgccgacctgcctgttcatcgccggcatcgccgagctcggggccttcttcagcatcctgcaggacatgcgcaacacgatcatggcgagcaagaccgtcggcacctccgaggagaagctgcgcaagaagtccagcttctaccagagctacctccggcgcacccagtccatggggatccagctggaccagcggatcatcgtgctgttcatggtggcctggggcaaggaggccgtcgacaacttccacctcggggacgacatggaccccgagctgcgcacgctggcccagagcctcatcgacgtgaaggtgaaggagatctccaaccaggagcccctgaagctgtga

SEQ ID NO: 6352 - RNA, 1290 nt, synthetic construct
  misc_feature 1..1290: note = derived and/or modified CDS sequence (opt1) from HTNV(Aa14-404)__KT935052.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccgtgtgcgggctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacacggccgccgtgagcctgctgggcgggcccgccaccaaccgggactacctccgccagcggcaggtcgcgctgggcaacatggagaccaaggagtccaaggccatccgccagcacgccgaggccgccgggtgcagcatgatcgaggacatcgagtccccgagctccatctgggtgttcgcgggcgcccccgaccggtgcccgccgacctgcctgttcatcgccggcatcgccgagctcggggccttcttcagcatcctgcaggacatgcgcaacacgatcatggcgagcaagaccgtgggcacctccgaggagaagctgcgcaagaagtccagcttctaccagagctacctccggcgcacccagtccatggggatccagctggaccagcggatcatcgtcctgttcatggtggcctggggcaaggaggccgtggacaacttccacctcggggacgacatggaccccgagctgcgcacgctggcccagagcctcatcgacgtcaaggtgaaggagatctccagccaggagcccctgaagctgtga

SEQ ID NO: 6353 - RNA, 1290 nt, synthetic construct
  misc_feature 1..1290: note = derived and/or modified CDS sequence (opt1) from HTNV(Aa15-56)__KU207195.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccgtgtgcgggctgtaccccgcccagatcaaggcccggcagatgatcagcccggtcatgtccgtgatcggcttcctggcgctcgccaaggactggagcgaccgcatcgagcagtggctgaacgagccctgcaagctgctccccgacacggccgccgtgtccctgctgggcgggcccgccaccaaccgggactacctccgccagcggcaggtcgcgctgggcaacatggagaccaaggagagcaaggccatccgccagcacgccgaggccgccgggtgctccatgatcgaggacatcgagagcccgtccagcatctgggtgttcgcgggcgcccccgaccggtgcccgccgacctgcctgttcatcgccggcatcgccgagctcggggccttcttctccatcctgcaggacatgcgcaacacgatcatggcgagcaagaccgtgggcaccagcgaggagaagctgcgcaagaagtccagcttctaccagtcctacctccggcgcacccagagcatggggatccagctggaccagcggatcatcgtcctgttcatggtggcctggggcaaggaggccgtggacaacttccacctcggggacgacatggaccccgagctgcgcacgctggcccagtccctcatcgacgtcaaggtgaaggagatcagcaaccaggagcccctgaagctgtga

SEQ ID NO: 6354 - RNA, 1290 nt, synthetic construct
  misc_feature 1..1290: note = derived and/or modified CDS sequence (opt1) from HTNV(AA1719)__AF427319.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccatctgcgggctgtaccccgcccagatcaaggcccggcagatgatcagcccggtgatgtccgtcatcggcttcctggcgctcgccaaggactggagcgaccgcatcgagcagtggctgtccgagccctgcaagctgctccccgacacggccgccgtgagcctgctgggcgggcccgccaccaaccgggactacctccgccagcgccaggtggcgctgggcaacatggagaccaaggagtccaaggccatccggcagcacgccgaggccgccgggtgcagcatcatcgaggacatcgagtccccgagctccatctgggtcttcgcgggcgcccccgaccggtgcccgccgacctgcctgttcatcgccggcatcgccgagctcggggccttcttcagcatcctgcaggacatgcgcaacacgatcatggcgagcaagaccgtgggcacctccgaggagaagctgcgcaagaagtccagcttctaccagagctacctccggcgcacccagtccatggggatccagctggaccagcggatcatcgtgctgttcatggtcgcctggggcaaggaggccgtggacaacttccacctcggggacgacatggaccccgagctgcgcacgctggcccagagcctcatcgacgtgaaggtcaaggagatctccaaccaggagcccctgaagctgtga

SEQ ID NO: 6355 - RNA, 1290 nt, synthetic construct
  misc_feature 1..1290: note = derived and/or modified CDS sequence (opt1) from HTNV(AP1168)__AF427323.1__N
  source 1..1290: mol_type = other RNA
atggccaccatggaggagctgcagaaggagatcaacgcccacgagggccagctcgtgatcgcgcgccagaaggtccgggacgccgagcgccagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggacccgaccggcgtggagcccggggaccacctcaaggagcggtccatgctgagctacggcaacgtcctggacctcaaccacctggacatcgacgagcccaccggccagaccgccgactggctgtccatcgtggtgtacctcacgagcttcgtcgtgcccatcctgctgaaggcgctctacatgctgaccacccgcgggcggcagaccacgaaggacaacaagggcacccgcatccggttcaaggacgactccagcttcgaggacgtgaacgggatccgcaagccgaagcacctgtacgtctccctccccaacgcccagagctccatgaaggccgaggagatcacccccggccggtaccgcaccgccatctgcgggctgtaccccgcccagatcaaggcgcggcagatggtgagcccggtgatgtccgtcatcggcttcctggccctcgccaaggactggggcgaccgcatcgagcagtggctgagcgagccctgcaagctgctccccgacacggccgccgtgtccctgcacgggggccccgcgaccaaccgggactacctgcgccagcggcaggccgccctcgggaacatggagaccaaggagagcaaggccatccgccagcacgccgagaccgcgggctgctccatgatcgaggacatcgagagcccgtccagcatctgggtgttcgccggcgcccccgaccggtgcccgcccacgtgcctgttcatcgccgggatcgccgagctgggcgcgttcttctccatcctccaggacatgcgcaacaccatcatggccagcaagaccgtcgggaccagcgaggagaagctgcgcaagaagtccagcttctaccagtcctacctgcggcgcacgcagagcatgggcatccagctcgaccagcggatcatcgtgctgttcatggtggcctgggggaaggaggccgtcgacaacttccacctgggcgacgacatggaccccgagctccgcaccctggcgcagtccctgatcgacctcaaggtgaaggagatcagcaaccaggagcccctgaagctgtga

SEQ ID NO: 6356 - RNA, 1290 nt, synthetic construct
  misc_feature 1..1290: note = derived and/or modified CDS sequence (opt1) from HTNV(AP708)__AF427322.1__N
  source 1..1290: mol_type = other RNA
atggccaccatggaggagctgcagaaggagatcaacgcccacgagggccagctcgtgatcgcgcgccagaaggtccgggacgccgagcgccagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggacccgaccggcgtggagcccggggaccacctcaaggagcggtccatgctgagctacggcaacgtcctggacctcaaccacctggacatcgacgagcccaccggccagaccgccgactggctgtccatcgtggtgtacctcacgagcttcgtcgtgcccatcctgctgaaggcgctctacatgctgaccacccgcgggcggcagaccacgaaggacaacaagggcacccgcatccggttcaaggacgactccagcttcgaggacgtgaacgggatccgcaagccgaagcacctgtacgtctccctccccaacgcccagagctccatgaaggccgaggagatcacccccggccggtaccgcaccgccatctgcgggctgtaccccgcccagatcaaggcgcggcagatggtgagcccggtgatgtccgtcatcggcttcctggccctcgccaaggactggggcgaccgcatcgagcagtggctgagcgagccctgcaagctgctccccgacacggccgccgtgtccctgcacgggggccccgcgaccaaccgggactacctgcgccagcggcaggccgccctcgggaacatggagaccaaggagagcaaggccatccgccagcacgccgagaccgcgggctgctccatgatcgaggacatcgagagcccgtccagcgtgtgggtcttcgccggcgcccccgaccggtgcccgcccacgtgcctgttcatcgccgggatcgccgagctgggcgcgttcttctccatcctccaggacatgcgcaacaccatcatggccagcaagaccgtggggaccagcgaggagaagctgcgcaagaagtccagcttctaccagtcctacctgcggcgcacgcagagcatgggcatccagctcgaccagcggatcatcgtgctgttcatggtcgcctgggggaaggaggccgtggacaacttccacctgggcgacgacatggaccccgagctccgcaccctggcgcagtccctgatcgacctcaaggtgaaggagatcagcaaccaggagcccctgaagctgtga

SEQ ID NO: 6357 - RNA, 1290 nt, synthetic construct
  misc_feature 1..1290: note = derived and/or modified CDS sequence (opt1) from HTNV(DandongHu-32)__KC570386.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccatctgcgggctgtaccccgcccagatcaaggcccggcagatgatcagcccggtgatgtccgtcatcggcttcctggcgctcgccaaggactggagcgaccgcatcgagcagtggctgtccgagccctgcaagctgctccccgacacggccgccgtgagcctgctgggcgggcccgccaccaaccgggactacctccgccagcgccaggtggcgctgggcaacatggagaccaaggagtccaaggccatccggcagcacgccgaggccgccgggtgcagcatgatcgaggacatcgagtccccgagctccatctgggtcttcgcgggcgcccccgaccggtgcccgccgacctgcctgttcatcgccggcatcgccgagctcggggccttcttcagcatcctgcaggacatgcgcaacacgatcatggcgagcaagaccgtgggcacctccgaggagaagctgcgcaagaagtccagcttctaccagagctacctccggcgcacccagtccatggggatccagctggaccagcggatcatcgtgctgttcatggtcgcctggggcaaggaggccgtggacaacttccacctcggggacgacatggaccccgagctgcgcatcctggcccagagcctcatcgacgtgaaggtcaaggagatctccaaccaggagcccctgaagctgtga

SEQ ID NO: 6358 - RNA, 1290 nt, synthetic construct
  misc_feature 1..1290: note = derived and/or modified CDS sequence (opt1) from HTNV(DandongHu-34)__KC570387.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccatctgcgggctgtaccccgcccagatcaaggcccggcagatgatcagcccggtgatgtccgtcatcggcttcctggcgctcgccaaggactggagcgaccgcatcgagcagtggctgtccgagccctgcaagctgctccccgacacggccgccgtgagcctgctgggcgggcccgccaccaaccgggactacctccgccagcgccaggtggcgctgggcaacatggagaccaaggagtccaaggccatccggcagcacgccgaggccgccgggtgcagcatgatcgaggacatcgagtccccgagctccatctgggtcttcgcgggcgcccccgaccggtgcccgccgacctgcctgttcatcgccggcatggccgagctcggggccttcttcagcatcctgcaggacatgcgcaacacgatcatggcgagcaagaccgtgggcacctccgaggagaagctgcgcaagaagtccagcttctaccagagctacctccggcgcacccagtccatggggatccagctggaccagcggatcatcgtgctgttcatggtcgcctggggcaaggaggccgtggacaacttccacctcggggacgacatggaccccgagctgcgcacgctggcccagagcctcatcgacgtgaaggtcaaggagatctccaaccaggagcccctgaagctgtga

SEQ ID NO: 6359 - RNA, 1290 nt, synthetic construct
  misc_feature 1..1290: note = derived and/or modified CDS sequence (opt1) from HTNV(DandongHu-89)__KC570389.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtgcgtgtccctccccaacgcgcagagctccatgaaggccgaggagatcacccccggccggtaccgcaccgccatctgcgggctgtaccccgcccagatcaaggcccggcagatgatcagcccggtgatgtccgtcatcggcttcctggcgctcgccaaggactggagcgaccgcatcgagcagtggctgtccgagccctgcaagctgctccccgacacggccgccgtgagcctgctgggcgggcccgccaccaaccgggactacctccgccagcgccaggtggcgctgggcaacatggagaccaaggagtccaaggccatccggcagcacgccgaggccgccgggtgcagcatgatcgaggacatcgagtccccgagctccatctgggtcttcgcgggcgcccccgaccggtgcccgccgacctgcctgttcatcgccggcatcgccgagctcggggccttcttcagcatcctgcaggacatgcgcaacacgatcatggcgagcaagaccgtgggcacctccgaggagaagctgcgcaagaagtccagcttctaccagagctacctccggcgcacccagtccatggggatccagctggaccagcggatcatcgtgctgttcatggtcgcctggggcaaggaggccgtggacaacttccacctcggggacgacatggaccccgagctgcgcacgctggcccagagcctcatcgacgtgaaggtcaaggagatctccaaccaggagcccctgaagctgtga

SEQ ID NO: 6360 - RNA, 1290 nt, synthetic construct
  misc_feature 1..1290: note = derived and/or modified CDS sequence (opt1) from HTNV(DandongHu-91)__KC570390.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctggggatcgtgatctacctcacgtccttcgtcgtgcccatcctgctgaaggccctctacatgctgaccacccgcggccggcagaccacgaaggacaacaaggggacccgcatccggttcaaggacgacagctccttcgaggacgtgaacggcatccgcaagccgaagcacctgtacgtcagcctccccaacgcgcagtccagcatgaaggccgaggagatcacccccgggcggtaccgcaccgccatctgcggcctgtaccccgcccagatcaaggcccggcagatgatctccccggtgatgagcgtgatcggcttcctggcgctcgccaaggactggtccgaccgcatcgagcagtggctgagcgagccctgcaagctgctccccgacacggccgccgtctccctgctcgggggccccgccaccaaccgggactacctgcgccagcgccaggtggcgctggggaacatggagaccaaggagagcaaggccatccggcagcacgccgaggccgccggctgctccatgatcgaggacatcgagagcccgtccagcatctgggtgttcgcgggcgcccccgaccggtgcccgccgacctgcctgttcatcgccgggatggccgagctcggcgccttcttctccatcctgcaggacatgcgcaacacgatcatggcgagcaagaccgtcgggaccagcgaggagaagctgcgcaagaagtccagcttctaccagtcctacctccggcgcacccagagcatgggcatccagctggaccagcggatcatcgtgctgttcatggtggcctgggggaaggaggccgtcgacaacttccacctcggcgacgacatggaccccgagctgcgcacgctggcccagtccctcatcgacgtgaaggtgaaggagatcagcaaccaggagcccctgaagctgtga

SEQ ID NO: 6361 - RNA, 1290 nt, synthetic construct
  misc_feature 1..1290: note = derived and/or modified CDS sequence (opt1) from HTNV(Fuyuan-Aa-145)__KJ857349.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccatctgcgggctgcaccccgcccagatcaaggcccggcagatgatcagcccggtgatgtccgtcatcggcttcctggcgctcgccaaggactggagcgaccgcatcgagcagtggctgtccgagccctgcaagctgctccccgacacggccgccgtgagcctgctgggcgggcccgccaccaaccgggactacctccgccagcgccaggtggcgctgggcaacatggagaccaaggagtccaaggccatccggcagcacgccgaggccgccgggtgcagcatgatcgaggacatcgagtccccgagctccatctgggtcttcgcgggcgcccccgaccggtgcccgccgacctgcctgttcatcgccggcatcgccgagctcggggccttcttcagcatcctgcaggacatgcgcaacacgatcatggcgagcaagaccgtgggcacctccgaggagaagctgcgcaagaagtccagcttctaccagagctacctccggcgcacccagtccatggggatccagctggaccagcggatcatcgtgctgttcatggtcgcctggggcaaggaggccgtggacaacttccacctcggggacgacatggaccccgagctgcgcacgctggcccagagcctcatcgacgtgaaggtcaaggagatctccaaccaggagcccctgaagctgtga

SEQ ID NO: 6362 - RNA, 1290 nt, synthetic construct
  misc_feature 1..1290: note = derived and/or modified CDS sequence (opt1) from HTNV(Fuyuan-Aa-26)__KJ857347.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgccgtgcccatcctgctgaaggcgctctacatgctgaccacccgcgggcggcagaccacgaaggacaacaagggcacccgcatccggttcaaggacgactccagcctggaggacgtgaacgggatccgcaagccgaagcacctctacgtctccctgcccaacgcccagagctccatgaaggccgaggagatcacccccggccggtaccgcaccgccatctgcgggctgtaccccgcccagatcaaggcgcggcagatgatcagcccggtgatgtccgtgatcggcttcctcgccctggccaaggactggagcgaccgcatcgagcagtggctgtccgagccctgcaagctcctgcccgacacggccgccgtcagcctgctcggcgggcccgcgaccaaccgggactacctgcgccagcgccaggtggccctgggcaacatggagaccaaggagtccaaggccatccggcagcacgccgaggccgcggggtgcagcatgatcgaggacatcgagtccccgagctccatctgggtgttcgccggcgcccccgaccggtgcccgccgacctgccccttcatcgccggcatcgccgagctcggggcgttcttcagcatcctgcaggacatgcgcaacacgatcatggccagcaagaccgtcggcacctccgaggagaagctgcgcaagaagtccagcttctaccagagctacctccggcgcacccagtccatggggatccagctggaccagcggatcatcgtgctgttcatggtggcctggggcaaggaggccgtcgacaacttccacctcggggacgacatggaccccgagctgcgcacgctggcgcagagcctcatcgacgtgaaggtgaaggagatctccaaccaggagcccctgaagctgtga

SEQ ID NO: 6363 - RNA, 1290 nt, synthetic construct
  misc_feature 1..1290: note = derived and/or modified CDS sequence (opt1) from HTNV(JS1)__KP970572.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaacgaccccgacgagctgaacaagcgggccctgaccaaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcatcgtgtacctcacgagcttcgtcgtgcccatcctgctgaaggccctctacatgctgaccacccgcgggcggcagaccacgaaggacaacaagggcacccgcatccggttcaaggacgactccagcttcgaggacgtgaacgggatccgcaagccgaagcacctgtacgtctccctccccaacgcgcagagctccatgaaggccgaggagatcacccccggccggtaccgcaccgccgtgtgcgggctgtaccccgcccagatcaaggcccggcagatgatcagcccggtgatgtccgtcatcggcttcctggcgctcgccaaggactggagcgaccgcatcgagcagtggctgatcgagccctgcaagctgctccccgacacggccgccgtgtccctgctgggcgggcccgccaccaaccgggactacctccgccagcgccaggtggcgctgggcaacatggagaccaaggagagcaaggccatccggcagcacgccgaggccgccgggtgctccatgatcgaggacatcgagagcccgtccagcatctgggtcttcgcgggcgcccccgaccggtgcccgccgacctgcctgttcatcgccggcatcgccgagctcggggccttcttctccatcctgcaggacatgcgcaacacgatcatggcgagcaagaccgtgggcaccagcgaggagaagctgcgcaagaagtccagcttctaccagtcctacctccggcgcacccagagcatggggatccagctggaccagcggatcatcgtgctgttcatggtcgcctggggcaaggaggccgtggacaacttccacctcggggacgacatggaccccgagctgcgcacgctggcccagtccctcatcgacgtgaaggtcaaggagatcagcaaccaggagcccctgaagctgtga

SEQ ID NO: 6364 - RNA, 1290 nt, synthetic construct
  misc_feature 1..1290: note = derived and/or modified CDS sequence (opt1) from HTNV(LongquanAa-08-150)__JQ912697.1__N
  source 1..1290: mol_type = other RNA
atggccaccatggaggagctgcagcgcgagatcgacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggacccgaccggcgtggagcccggggaccacctcaaggagcggtccatgctgagctacggcaacgtcctggacctcaaccacctggacatcgacgagcccaccggccagaccgccgactggctgtccatcgtggtgtacctcacgagcttcgtcgtgcccatcctgctgaaggcgctctacatgctgaccacccgcgggcggcagaccacgaaggacaacaagggcacccgcatccggttcaaggacgactccagcttcgaggacgtgaacgggatccgcaagccgaagcacctgtacgtctccctccccaacgcccagagctccatgaaggccgaggagatcacccccggccggtaccgcaccgccatctgcgggctgtaccccgcccagatcaaggcgcggcagatgatcagcccggtgatgtccgtgatcggcttcctggccctcgccaaggactgggccgaccgcatcgagcagtggctgagcgagccctgcaagctgctccccgacacggccgcggtctccctgcacggcgggcccgccaccaaccgggactacctgcgccagcgccaggtggccctcggcaacatggagaccaaggagagcaaggccatccggcagcacgccgagaccgcggggtgctccatgatcgaggacatcgagagcccgtccagcatctgggtgttcgccggcgcccccgaccggtgcccgcccacgtgcctgttcatcgccggcatcgccgagctgggggcgttcttctccatcctccaggacatgcgcaacaccatcatggccagcaagaccgtcggcaccagcgaggagaagctgcgcaagaagtccagcttctaccagtcctacctgcggcgcacgcagagcatggggatccagctcgaccagcggatcatcgtgctgttcatggtggcctggggcaaggaggccgtcgacaacttccacctgggggacgacatggaccccgagctccgcaccctggcgcagtccctgatcgacgtgaaggtgaaggagatcagcaaccaggagcccctcaagctgtga

SEQ ID NO: 6365 - RNA, 1290 nt, synthetic construct
  misc_feature 1..1290: note = derived and/or modified CDS sequence (opt1) from HTNV(LongquanAa-08-157)__JQ912698.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggacccgaccggcgtggagcccggggaccacctcaaggagcggtccatgctgagctacggcaacgtcctggacctcaaccacctggacatcgacgagcccaccggccagaccgccgactggctgtccatcgtggtgtacctcacgagcttcgtcgtgcccatcctgctgaaggcgctctacatgctgaccacccgcgggcggcagaccacgaaggacaacaagggcacccgcatccggttcaaggacgactccagcttcgaggacgtgaacgggatccgcaagccgaagcacctgtacgtctccctccccaacgcccagagctccatgaaggccgaggagatcacccccggccggtaccgcaccgccatctgcgggctgtaccccgcccagatcaaggcgcggcagatgatcagcccggtgatgtccgtgatcggcttcctggccctcgccaaggactgggccgaccgcatcgagcagtggctgagcgagccctgcaagctgctccccgacacggccgcggtctccctgcacggcgggcccgccaccaaccgggactacctgcgccagcgccaggtggccctcggcaacatggagaccaaggagagcaaggccatccggcagcacgccgagaccgcggggtgctccatgatcgaggacatcgagagcccgtccagcatctgggtgttcgccggcgcccccgaccggtgcccgcccacgtgcctgttcatcgccggcatcgccgagctgggggcgttcttctccatcctccaggacatgcgcaacaccatcatggccagcaagaccgtcggcaccagcgaggagaagctgcgcaagaagtccagcttctaccagtcctacctgcggcgcacgcagagcatggggatccagctcgaccagcggatcatcgtgctgttcatggtggcctggggcaaggaggccgtcgacaacttccacctgggggacgacatggaccccgagctccgcaccctggcgcagtccctgatcgacgtgaaggtgaaggagatcagcaaccaggagcccctcaagctgtga

SEQ ID NO: 6366 - RNA, 1290 nt, synthetic construct
  misc_feature 1..1290: note = derived and/or modified CDS sequence (opt1) from HTNV(LongquanAa-08-314)__JQ912709.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatgcaggcgaagatcgacgagctcaagcggcagctggccgaccgcatcgccacgggcaagaacctggggaaggagcaggacccgaccggcgtggagcccggggaccacctcaaggagcggtccatgctgagctacggcaacgtcctggacctcaaccacctggacatcgacgagcccaccggccagaccgccgactggctgtccatcgtggtgtacctcacgagcttcgtcgtgcccatcctgctgaaggcgctctacatgctgaccacccgcgggcggcagaccacgaaggacaacaagggcacccgcatccggttcaaggacgactccagcttcgaggacgtgaacgggatccgcaagccgaagcacctgtacgtctccctccccaacgcccagagctccatgaaggccgaggagatcacccccggccggtaccgcaccgccatctgcgggctgtaccccgcccagatcaaggcgcggcagatgatcagcccggtgatgtccgtgatcggcttcctggccctcgccaaggactgggccgaccgcatcgagcagtggctgagcgagccctgcaagctgctccccgacacggccgcggtctccctgcacggcgggcccgccaccaaccgggactacctgcgccagcgccaggtggccctcggcaacatggagaccaaggagagcaaggccatccggcagcacgccgagaccgcggggtgctccatgatcgaggacatcgagagcccgtccagcatctgggtgttcgccggcgcccccgaccggtgcccgcccacgtgcctgttcatcgccggcatcgccgagctgggggcgttcttctccatcctccaggacatgcgcaacaccatcatggccagcaagaccgtcggcaccagcgaggagaagctgcgcaagaagtccagcttctaccagtcctacctgcggcgcacgcagagcatggggatccagctcgaccagcggatcatcgtgctgttcatggtggcctggggcaaggaggccgtcgacaacttccacctgggggacgacatggaccccgagctccgcaccctggcgcagtccctgatcgacgtgaaggtgaaggagatcagcaaccaggagcccctcaagctgtga

SEQ ID NO: 6367 - RNA, 1290 nt, synthetic construct
  misc_feature 1..1290: note = derived and/or modified CDS sequence (opt1) from HTNV(LongquanAa-08-573)__JQ912714.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggacccgaccggcgtggagcccggggaccacctcaaggagcggtccatgctgagctacggcaacgtcctggacctcaaccacctggacatcgacgagcccaccggccagaccgccgactggctgtccatcgtggtgtacctcacgagcttcgtcgtgcccatcctgctgaaggcgctctacatgctgaccacccgcgggcggcagaccacgaaggacaacaagggcacccgcatccggttcaaggacgactccagcttcgaggacgtgaacgggatccgcaagccgaagcacctgtacgtctccctccccaacgcccagagctccatgaaggccgaggagatcacccccggccggtaccgcaccgccatctgcgggctgtaccccgcccagatcaaggcgcggcagatgatcagcccggtgatgtccgtgatcggcttcctggccctcgccaaggactgggccgaccgcatcgagcagtggctgagcgagccctgcaagctgctccccgacacggccgcggtctccctgcacggcgggcccgccaccaaccgggactacctgcgccagcgccaggtggccctcggcaacatggagaccaaggagagcaaggccatccggcagcacgccgcgaccgccgggtgctccatgatcgaggacatcgagagcccgtccagcatctgggtgttcgccggcgcccccgaccggtgcccgcccacgtgcctgttcatcgccggcatcgcggagctgggggccttcttctccatcctccaggacatgcgcaacaccatcatggccagcaagaccgtcggcaccagcgaggagaagctgcgcaagaagtccagcttctaccagtcctacctgcggcgcacgcagagcatggggatccagctcgaccagcggatcatcgtgctgttcatggtggcctggggcaaggaggcggtcgacaacttccacctgggggacgacatggaccccgagctccgcaccctggcccagtccctgatcgacgtgaaggtgaaggagatcagcaaccaggagcccctcaagctgtga

SEQ ID NO: 6368 - RNA, 1290 nt, synthetic construct
  misc_feature 1..1290: note = derived and/or modified CDS sequence (opt1) from HTNV(LongquanAa-09-113)__JQ912716.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggaccccaccggcgtggagcccggggaccacctcaaggagcggtccatgctgagctacggcaacgtcctggacctcaaccacctggacatcgacgagcccaccggccagaccgccgactggctgtccatcgtggtgtacctcacgagcttcgtcgtgcccatcctgctgaaggcgctctacatgctgaccacccgcgggcggcagaccacgaaggacaacaagggcacccgcatccggttcaaggacgactccagcttcgaggacgtgaacgggacccgcaagccgaagcacctgtacgtctccctccccaacgcccagagctccatgaaggccgaggagatcacccccggccggtaccgcacggccatctgcgggctgtaccccgcccagatcaaggcgcggcagatgatcagcccggtgatgtccgtgatcggcttcctggccctcgccaaggactgggccgaccgcatcgagcagtggctgagcgagccctgcaagctgctccccgacaccgccgcggtctccctgcacggcgggcccgccaccaaccgggactacctgcgccagcgccaggtggccctcggcaacatggagaccaaggagagcaaggccatccggcagcacgccgagacggcggggtgctccatgatcgaggacatcgagagcccgtccagcatctgggtgttcgccggcgcccccgaccggtgcccgccgacctgcctgttcatcgccggcatcgccgagctgggggcgttcttctccatcctccaggacatgcgcaacaccatcatggccagcaagaccgtcggcacgagcgaggagaagctgcgcaagaagtccagcttctaccagtcctacctgcggcgcacccagagcatggggatccagctcgaccagcggatcatcgtgctgttcatggtggcctggggcaaggaggccgtcgacaacttccacctgggggacgacatggaccccgagctccgcaccctggcgcagtccctgatcgacgtgaaggtgaaggagatcagcaaccaggagcccctcaagctgtga

SEQ ID NO: 6369 - RNA, 1290 nt, synthetic construct
  misc_feature 1..1290: note = derived and/or modified CDS sequence (opt1) from HTNV(LongquanAa-09-191)__JQ912719.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggaccccaccggcgtggagcccggggaccacctcaaggagcggtccatgctgagctacggcaacgtcctggacctcaaccacctggacatcgacgagcccaccggccagaccgccgactggctgtccatcgtggtgtacctcacgagcttcgtcgtgcccatcctgctgaaggcgctctacatgctgaccacccgcgggcggcagaccatcaaggacaacaagggcacgcgcatccggttcaaggacgactccagcttcgaggacgtgaacgggatccgcaagccgaagcacctgtacgtctccctccccaacgcccagagctccatgaaggccgaggagatcacccccggccggtaccgcaccgccatctgcgggctgtaccccgcccagatcaaggcgcggcagatgatcagcccggtgatgtccgtgatcggcttcctggccctcgccaaggactgggccgaccgcatcgagcagtggctgagcgagccctgcaagctgctccccgacaccgccgcggtctccctgcacggcgggcccgccacgaaccgggactacctgcgccagcgccaggtggccctcggcaacatggagaccaaggagagcaaggccatccggcagcacgccgagaccgcggggtgctccatgatcgaggacatcgagagcccgtccagcatctgggtgttcgccggcgcccccgaccggtgcccgccgacctgcctgttcatcgccggcatcgccgagctgggggcgttcttctccatcctccaggacatgcgcaacacgatcatggccagcaagaccgtcggcaccagcgaggagaagctgcgcaagaagtccagcttctaccagtcctacctgcggcgcacccagagcatggggatccagctcgaccagcggatcatcgtgctgttcatggtggcctggggcaaggaggccgtcgacaacttccacctgggggacgacatggaccccgagctccgcacgctggcgcagtccctgatcgacgtgaaggtgaaggagatcagcaaccaggagcccctcaagctgtga

SEQ ID NO: 6370 - RNA, 1290 nt, synthetic construct
  misc_feature 1..1290: note = derived and/or modified CDS sequence (opt1) from HTNV(LongquanAa-09-192)__JQ912720.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatgcagggcaagatcgacgagctcaagcggcagctggcggaccgcatcgccacggggaagaacctgggcaaggagcaggacccgaccggggtggagcccggcgaccacctcaaggagcggtccatgctgagctacggcaacgtcctggacctcaaccacctggacatcgacgagcccaccgggcagaccgccgactggctgtccatcgtggtgtacctcacgagcttcgtcgtgcccatcctgctgaaggccctctacatgctgaccacccgcggccggcagaccacgaaggacaacaaggggacccgcatccggttcaaggacgactccagcttcgaggacgtgaacggcatccgcaagccgaagcacctgtacgtctccctccccaacgcgcagagctccatgaaggccgaggagatcacccccgggcggtaccgcaccgccatctgcggcctgtaccccgcccagatcaaggcccggcagatgatcagcccggtgatgtccgtgatcggcttcctggcgctcgccaaggactgggccgaccgcatcgagcagtggctgagcgagccctgcaagctgctccccgacacggccgccgtctccctgcacgggggccccgcgaccaaccgggactacctgcgccagcgccaggtggccctcgggaacatggagaccaaggagagcaaggccatccggcagcacgccgagaccgccggctgctccatgatcgaggacatcgagagcccgtccagcatctgggtgttcgcgggcgcccccgaccggtgcccgcccacgtgcctgttcatcgccgggatcgccgagctgggcgccttcttctccatcctccaggacatgcgcaacaccatcatggcgagcaagaccgtcgggaccagcgaggagaagctgcgcaagaagtccagcttctaccagtcctacctgcggcgcacgcagagcatgggcatccagctcgaccagcggatcatcgtgctgttcatggtggcctgggggaaggaggccgtcgacaacttccacctgggcgacgacatggaccccgagctccgcaccctggcccagtccctgatcgacgtgaaggtgaaggagatcagcaaccaggagcccctcaagctgtga

SEQ ID NO: 6371 - RNA, 1290 nt, synthetic construct
  misc_feature 1..1290: note = derived and/or modified CDS sequence (opt1) from HTNV(LongquanAa-10-46)__JQ912754.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggacccgaccggcgtggagcccggggaccacctcaaggagcggtccatgctgagctacggcaacgtcctggacctcaaccacctggacatcgacgagcccaccggccagaccgccgactggctgtccatcgtggtgtacctcacgagcttcgtcgtgcccatcctgctgaaggcgctctacatgctgaccacccgcgggcggcagaccacgaaggacaacaagggcacccgcatccggttcaaggacgactccagcttcgaggacgtgaacgggatccgcaagccggagcacctgtacgtctccctccccaacgcccagagctccatgaaggccgaggagatcacccccggccggtaccgcaccgccatctgcgggctgtaccccgcccagatcaaggcgcggcagatgatcagcccggtgatgtccgtgatcggcttcctggccctcgccaaggactgggccgaccgcatcgagcagtggctgagcgagccctgcaagctgctccccgacacggccgcggtctccctgcacggcgggcccgccaccaaccgggactacctgcgccagcgccaggtggccctcggcaacatggagaccaaggagagcaaggccatccggcagcacgccgagaccgcggggtgctccatgatcgaggacatcgagagcccgtccagcatctgggtgttcgccggcgcccccgaccggtgcccgcccacgtgcctgttcatcgccggcatcgccgagctgggggcgttcttctccatcctccaggacatgcgcaacaccatcatggccagcaagaccgtcggcaccagcgaggagaagctgcgcaagaagtccagcttctaccagtcctacctgcggcgcacgcagagcatggggatccagctcgaccagcggatcatcgtgctgttcatggtggcctggggcaaggaggccgtcgacaacttccacctgggggacgacatggaccccgagctccgcaccctggcgcagtccctgatcgacgtgaaggtgaaggagatcagcaaccaggagcccctcaagctgtga

SEQ ID NO: 6372 - RNA, 1290 nt, synthetic construct
  misc_feature 1..1290: note = derived and/or modified CDS sequence (opt1) from HTNV(LongquanAa-11-745)__KC344237.1__N
  source 1..1290: mol_type = other RNA
atggccaccatggaggagctgcagaaggagatcaacgcccacgagggccagctcgtgatcgcgcgccagaaggtccgggacgccgagaagcagtacgagaaggaccccgacgagctgaacaagcgcgccctgaccgaccgggagggggtggccgccagcatccaggcgaagatcgacgagctcaagcgccagctggccgaccggatcgccacgggcaagaacctggggaaggagcaggacccgaccggcgtggagcccggggaccacctcaaggagcgctccatgctgagctacggcaacgtcctggacctcaaccacctggacatcgacgagcccaccggccagaccgccgactggctgtccatcgtggtgtacctcacgagcttcgtcgtgcccatcctgctgaaggcgctctacatgctgaccacccgggggcgccagaccacgaaggacaacaagggcacccggatccgcttcaaggacgactccagcttcgaggacgtgaacgggatccggaagccgaagcacctgtacgtctccctccccaacgcccagagctccatgaaggccgaggagatcacccccggccgctaccggaccgccatctgcgggctgtaccccgcccagatcaaggcgcgccagatgatcagcccggtgatgtccgtgatcggcttcctggccctcgccaaggactgggccgaccggatcgagcagtggctgagcgagccctgcaagctgctccccgacacggccgcggtctccctgcacggcgggcccgccaccaaccgcgactacctgcggcagcgccaggtggccctcggcaacatggagaccaaggagagcaaggccatccggcagcacgccgagaccgcggggtgctccatgatcgaggacatcgagagcccgtccagcatctgggtgttcgccggcgcccccgaccgctgcccgcccacgtgcctgttcatcgccggcatcgccgagctgggggcgttcttctccatcctccaggacatgcggaacaccatcatggccagcaagaccgtcggcaccagcgaggagaagctgcgcaagaagtccagcttctaccagtcctacctgcgccggacgcagagcatggggatccagctcgaccagcgcatcatcgtgctgttcatggtggcctggggcaaggaggccgtcgacaacttccacctgggggacgacatggaccccgagctccggaccctggcgcagtccctgatcgacgtgaaggtgaaggagatcagcaaccaggagcccctcaagctgtga

SEQ ID NO: 6373 - RNA, 1290 nt, synthetic construct
  misc_feature 1..1290: note = derived and/or modified CDS sequence (opt1) from HTNV(ROKA14-11)__KU207207.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccgtgtgcgggctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacacggccgccgtgagcctgctgggcgggcccgccaccaaccgggactacctccgccagcggcaggtcgcgctgggcaacatggagaccaaggagtccaaggccatccgccagcacgccgaggccgccgggtgcagcatgatcgaggacatcgagtccccgagctccatctgggtgttcgcgggcgcccccgaccggtgcccgccgacctgcctgttcgtggccggcatcgccgagctcggggccttcttcagcatcctgcaggacatgcgcaacacgatcatggcgagcaagaccgtcggcacctccgaggagaagatgcgcaagaagtccagcttctaccagagctacctgcggcgcacccagtccatggggatccagctcgaccagcggatcatcgtgctgttcatggtggcctggggcaaggaggccgtcgacaacttccacctgggggacgacatggaccccgagctccgcacgctggcccagagcctgatcgacgtgaaggtgaaggagatctccaaccaggagcccctcaagctgtga

SEQ ID NO: 6374 - RNA, 1290 nt, synthetic construct
  misc_feature 1..1290: note = derived and/or modified CDS sequence (opt1) from HTNV(US8A14-2)__KU207208.1__N
  source 1..1290: mol_type = other RNA
atggccaccatggaggagctgcagcgcgagatcaacgcccacgagggccagctcgtgatcgcgcggcagaaggtccgcgacgccgagaagcaggacgggaaggaccccgacgagctgaacaagcgggccctgaccgaccgcgagggcgtggccgtgagcatccaggccaagatcgacgagctcaagcggcagctggcggaccgcatcgccacggggaagaacctgggcaaggagcaggaccccaccggggtcgagcccggcgaccacctcaaggagcggtccatgctgagctacggcaacgtgctggacctcaaccacctggacatcgacgagcccaccgggcagaccgccgactggctgtccatcgtggtctacctcacgagcttcgtggtgcccatcctgctgaaggccctctacatgctgaccacccgcggccggcagaccacgaaggacaacaaggggacccgcatccggttcaaggacgactccagcttcgaggacgtcaacggcatccgcaagccgaagcacctgtacgtgtccctccccaacgcgcagagctccatgaaggccgaggagatcacccccgggcggtaccgcaccgccgtgtgcggcctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacacggccgccgtgagcctgctcgggggccccgccaccaaccgggactacctgcgccagcggcaggtcgcgctggggaacatggagaccaaggagtccaaggccatccgccagcacgccgaggccgccggctgcagcatgatcgaggacatcgagtccccgagctccatctgggtgttcgcgggcgcccccgaccggtgcccgccgacctgcctgttcatcgccgggatcgccgagctcggcgccttcttcagcatcctgcaggacatgcgcaacacgatcatggcgagcaagaccgtggggacctccgaggagaagctgcgcaagaagtccagcttctaccagagctacctccggcgcacccagtccatgggcatccagctggaccagcggatcatcgtcctgttcatggtggcctgggggaaggaggccgtggacaacttccacctcggcgacgacatggaccccgagctgcgcacgctggcccagagcctcatcgacgtcaaggtgaaggagatctccaaccaggagcccctgaagctgtga

SEQ ID NO: 6375 - RNA, 1290 nt, synthetic construct
  misc_feature 1..1290: note = derived and/or modified CDS sequence (opt1) from HTNV(US8A15-1)__KU207209.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccgtgtgcgggctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacacggccgccgtgagcctgctgggcgggcccgccaccaaccgggactacctccgccagcggcaggtcgcgctgggcaacatggagaccaaggagtccaaggccatccgccagcacgccgaggccgccgggtgcagcatgatcgaggacatcgagtccccgagctccatctgggtgttcgcgggcgcccccgaccggtgcccgccgacctgcctgttcatcgccggcatcgccgagctcggggccttcttcagcatcctgcaggacatgcgcaacacgatcatggcgagcaagatcgtgggcacctccgaggagaagctgcgcaagaagtccagcttctaccagagctacctccggcgcacccagtccatggggatccagctggaccagcggatcatcgtcctgttcatggtggcctggggcaaggaggccgtggacaacttccacctcggggacgacatggaccccgagctgcgcaccctggcccagagcctcatcgacgtcaaggtgaaggagatctccaaccaggagcccctgaagctgtga

SEQ ID NO: 6376 - RNA, 1290 nt, synthetic construct
  misc_feature 1..1290: note = derived and/or modified CDS sequence (opt1) from HTNV(YaluRiver13)__HQ611981.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggggccagaccacgaaggacaacaaggggacccggatccgcttcaaggacgactccagcttcgaggacgtcaacggcatccggaagccgaagcacctgtacgtgtccctccccaacgcgcagagctccatgaaggccgaggagatcacccccgggcgctaccggaccgccatctgcggcctgtaccccgcccagatcaaggcccgccagatgatcagcccggtgatgtccgtcatcggcttcctggcgctcgccaaggactggagcgaccggatcgagcagtggctgtccgagccctgcaagctgctccccgacacggccgccgtgagcctgctcgggggccccgccaccaaccgcgactacctgcggcagcgccaggtggcgctggggaacatggagaccaaggagtccaaggccatccggcagcacgccgaggccgccggctgcagcatgatcgaggacatcgagtccccgagctccatctgggtcttcgcgggcgcccccgaccgctgcccgccgacctgcctgttcatcgccagcatcggggagctcggcgccttcttcagcatcctgcaggacatgcggaacacgatcatggcctccaagaccgtggggaccagcgaggagaagctgcgcaagaagtccagcttctaccagtcctacctccgccggacccagagcatgggcatccagctggaccagcgcatcatcgtgctgttcatggtctcctgggggaaggaggcggtggacaacttccacctcggcgacgacatggaccccgagctgcggacgctggcccagagcctcatcgacgtgaaggtcaaggagatccccaaccaggagcccctgaagctgtga

SEQ ID NO: 6377 - RNA, 1290 nt, synthetic construct
  misc_feature 1..1290: note = derived and/or modified CDS sequence (opt1) from HTNV(84FLi)__AY017064.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggacccgaccggcgtggagcccggggaccacctcaaggagcggtccatgctgagctacggcaacgtcctggacctcaactacctggacatcgacgagcccaccggccagacggccgactggctgtccatcgtgatctacctcaccagcttcgtggtccccatcctgctgaaggccctctacatgctgaccacccgcgggcggcagacgaccaaggacaacaagggcacccgcatccggttcaaggacgactccagcttcgaggacgtgaacgggatccgcaagccgaagcacctgtacgtgtccctccccaacgcgcagagctccatgaaggccgaggagatcacccccggccggtaccgcacggccatctgcgggctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacaccgccgccgtgagcctgcacggcgggcccgccaccaaccgggactacctgcgccagcggcaggtcgcgctcggcaacatggagaccaaggagtccaaggccatccgccagcacgccgagagcgccgggtgctccatgatcgaggacatcgagagcccgtccagcatctgggtgttcgccggcgcgcccgaccggtgcccgcccacgtgcctgttcatcgccggcatcgccgagctgggggccttcttcagcatcctccaggacatgcgcaacaccatcatggcctccaagaccgtgggcaccagcgaggagaagctgcgcaagaagtccagcttctaccagtcctacctgcggcgcacgcagagcatggggatccagctcgaccagcggatcatcgtcctgttcatggtggcgtggggcaaggaggccgtggacaacttccacctgggggacgacatggaccccgagctccgcaccctggcccagtccctgatcgacgtcaaggtgaaggagatcagcaaccaggagcccctcaagctgtga

SEQ ID NO: 6378 - RNA, 1290 nt, synthetic construct
  misc_feature 1..1290: note = derived and/or modified CDS sequence (opt1) from HTNV(Bao14)__AB127998.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgtgagcatccaggccaagatcgacgagctcaagcggcagctggccgaccgcatcgcgaccggcaagaacctggggaaggagcaggacccgaccggcgtcgagcccggggaccacctcaaggagcggtccatgctgagctacggcaacgtgctggacctcaaccacctggacatcgacgagcccaccggccagacggccgactggctgtccatcgtggtctacctcaccagcttcgtggtgcccatcctgctgaaggccctctacatgctgaccacccgcgggcggcagacgaccaaggacaacaagggcacccgcatccggttcaaggacgactccagcttcgaggacgtcaacgggatccgcaagccgaagcacctgtacgtgtccctccccaacgcccagagctccatgaaggcggaggagatcacccccggccggtaccgcacggccatctgcgggctgtaccccgcccagatcaaggcccggcagatgatcagcccggtgatgtccgtcatcggcttcctggccctcgcgaaggactggagcgaccgcatcgagcagtggctgtccgagccctgcaagctgctccccgacaccgccgccgtgagcctgctgggcgggcccgccaccaaccgggactacctccgccagcgccaggtggccctgggcaacatggagaccaaggagtccaaggcgatccggcagcacgccgaggccgccgggtgcagcatgatcgaggacatcgagtccccgagctccatctgggtcttcgccggcgcgcccgaccggtgcccgcccacgtgcctgttcatcgccggcatcgccgagctcggggccttcttcagcatcctgcaggacatgcgcaacaccatcatggccagcaagaccgtgggcacctccgaggagaagctgcgcaagaagtccagcttctaccagagctacctccggcgcacgcagtccatggggatccagctggaccagcggatcatcgtgctgttcatggtcgcgtggggcaaggaggccgtggacaacttccacctcggggacgacatggaccccgagctgcgcaccctggcccagagcctcatcgacgtgaaggtcaaggagatctccaaccaggagcccctgaagctgtga

SEQ ID NO: 6379 - RNA, 1290 nt, synthetic construct
  misc_feature 1..1290: note = derived and/or modified CDS sequence (opt1) from HTNV(Chen4)__AB027101.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggacccgaccggcgtggagcccggggaccacctcaaggagcggtccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgcgggcggcagacgaccaaggacaacaagggcacccgcatccggttcaaggacgactccagcttcgaggacgtgaacgggatccgcaagccgaagcacctgtacgtgtccctccccaacgcgcagagctccatgaaggccgaggagatcacccccggccggtaccgcacggccatctgcgggctgtaccccgcccagatcaaggcccggcagatgatcagcccggtcatgtccgtgatcggcttcctggcgctcgccaaggactggagcgaccgcatcgagcagtggctgtccgccccctgcaagctgctccccgacaccgccgccgtgagcctgcacggcgggcccgcgaccaaccgggacaacctgcgccagcggcaggtcgccctcggcaacatggagaccaaggagtccaaggccatccgccagcacgccgagagcgccgggtgctccatgatcgaggacatcgagagcccgtccagcatctgggtgttcgcgggcgcccccgaccggtgcccgcccacgtgcctgttcatcgccggcatcgccgagctgggggccttcttcagcatcctccaggacatgcgcaacaccatcatggcgtccaagaccgtgggcaccagcgaggagaagctgcgcaagaagtccagcttctaccagtcctacctgcggcgcacgcagagcatggggatccagctcgaccagcggatcatcgtcctgttcatggtggcctggggcaaggaggccgtggacaacttccgcctgggggacgacatggaccccgagctccggaccctggcccagtccctgatcgacgtcaaggtgaaggagatcagcaaccaggagcccctcaagctgtga

SEQ ID NO: 6380 - RNA, 1290 nt, synthetic construct
  misc_feature 1..1290: note = derived and/or modified CDS sequence (opt1) from HTNV(Hu)__AB027111.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggaccccaccggcgtggagcccggggaccacctcaaggagcggtccatgctgagctacggcaacgtcctggacctcaaccacctggacatcgacgagcccaccggccagaccgccgactggctgtccatcgtgatctacctcacgagcttcgtggtccccatcctgctgaaggcgctctacatgctgaccacccgcgggcggcagaccacgaaggacaacaagggcacccgcatccggttcaaggacgactccagcttcgaggacgtgaacgggatccgcaagccgaagcacctgtacgtgtccctccccaacgcccagagctccatgaaggccgaggagatcacccccggccggtaccgcaccgccatctgcgggctgtaccccgcccagatcaaggcgcggcagatgatcagcccggtcatgtccgtgatcggcttcctggccctcgccaaggactggagcgaccgcatcgagcagtggctgtccgagccctgcaagctgctccccgacacggccgccgtgagcctgcacggcgggcccgcgaccaaccgggactacctgcgccagcggcaggtcgccctcggcaacatggagaccaaggagtccaaggccatccgccagcacgccgaggccgcggggtgcagcatgatcgaggacatcgagtccccgagctccatctgggtgttcgccggcgcccccgaccggagcccgccgacctgcatgttcatcgccggcatcgacgagctgggggccttcttcagcatcctgcaggacatgcgcaacacgatcatggcgtccaagaccgtgggcaccagcgaggagaagctccgcaagaagtccagcttctaccagtcctacctgcggcgcacccagagcatggggatccagctggaccagcggatcatcgtcctcttcatggtggcctggggcaaggaggccgtggacaacttccacctgggggacgacatggaccccgagctgcgcacgctcgcccagtccctgatcgacatcaaggtcaaggagatcagcaaccaggagcccctgaagctctga

SEQ ID NO: 6381 - RNA, 1290 nt, synthetic construct
  misc_feature 1..1290: note = derived and/or modified CDS sequence (opt1) from HTNV(HubeiHu02)__JQ665905.1__N
  source 1..1290: mol_type = other RNA
atggccaccatggaggagctgcagaaggagatcaacgcccacgagggccagctcgtgatcgcgcgccagaaggtccgggacgccgagaagcagtacgagaaggaccccgacgagctgaacaagcgcaccctgacggaccgggagggggtggccgccagcatccaggccaagatcgacgagctcaagcgccagctggcggaccggatcgccaccggcaagaacctggggaaggagcaggacccgaccggcgtggagcccggggaccacctcaaggagcgctccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgggggcgccagacgaccaaggacaacaagggcacccggatccgcttcaaggacgactccagcttcgaggacgtgaacgggatccggaagccgaagcacctgtacgtgtccctccccaacgcgcagagctccatgaaggccgaggacatcacccccggccgctaccggacggccatctgcgggctgtaccccgcccagatcaaggcccgccagatgatcagcccggtcatgtccgtgatcggcttcctggcgctcgccaaggactggagcgaccggatcgagcagtggctgtccgagccctgcaagctgctccccgacaccgccgccgtgagcctgcacggcgggcccgccaccaaccgcgactacctgcggcagcgccaggtcgcgctcggcaacatggagaccaaggagtccaaggccatccggcagcacgccgagagcgccgggtgctccatgatcgaggacatcgagagcccgtccagcatctgggtgttcgccggcgcgcccgaccgctgcccgcccacgtgcctgttcatcgccggcatcgccgagctgggggccttcttcagcatcctccaggacatgcggaacaccatcatggcctccaagaccgtgggcaccagcgaggagaagctgcgcaagaagtccagcttctaccagtcctacctgcgccggacgcagagcatggggatccagctcgaccagcgcatcatcgtcctgttcatggtggcgtggggcaaggaggccgtggacaacttccacctgggggacgacatggaccccgagctccggaccctggcccagtccctgatcgacgtcaaggtgaaggagatcagcaaccaggagcccctcaagctgtga

SEQ ID NO: 6382 - RNA, 1290 nt, synthetic construct
  misc_feature 1..1290: note = derived and/or modified CDS sequence (opt1) from HTNV(HV004)__JQ083395.1__N
  source 1..1290: mol_type = other RNA
atggccaccatggaggagctgcagaaggagatcaacgcccacgagggccagctcgtgatcgcgcgccagaaggtccgggacgccgagaagcagtacgagaaggaccccgacgagctgaacaagcgcgccctgaccgaccgggagggggtggccgccagcatccaggcgaagatcgacgagctcaagcgccagctggccgaccggatcgccacgggcaagaacctggggaaggagcaggaccccaccggcgtggagcccggggaccacctcaaggagcgctccatgctgagctacggcaacgtcctggacctcaaccacctggacatcgacgagcccaccggccagaccgccgactggctgtccatcgtgatctacctcacgagcttcgtggtccccatcctgctgaaggcgctctacatgctgaccacccgggggcgccagaccacgaaggacaacaagggcacccggatccgcttcaaggacgactccagcttcgaggacgtgaacgggatccggaagccgaagcacctgtacgtgtccctccccaacgcccagagctccatgaaggccgaggagatcacccccggccgctaccggaccgccatctgcgggctgtaccccgcccagatcaaggcgcgccagatgatcagcccggtcatgtccgtgatcggcttcctggccctcgccaaggactggagcgaccggatcgagcagtggctgtccgagccctgcaagctgctccccgacacggccgccgtgagcctgcacggcgggcccgcgaccaaccgcgactacctgcggcagcgccaggtcgccctcggcaacatggagaccaaggagtccaaggccatccggcagcacgccgagagcgccgggtgctccatgatcgaggacatcgagagcccgtccagcatctgggtgttcgcgggcgcccccgaccgctgcccgccgacctgcctgttcatcgccggcatcgccgagctgggggccttcttcagcatcctccaggacatgcggaacacgatcatggcgtccaagaccgtgggcaccagcgaggagaagctgcgcaagaagtccagcttctaccagtcctacctgcgccggacccagagcatggggatccagctcgaccagcgcatcatcgtcctgttcatggtggcctggggcaaggaggccgtggacaacttccacctgggggacgacatggaccccgagctccggacgctggcccagtccctgatcgacgtcaaggtgaaggagatcagcaaccaggagcccctcaagctgtga

SEQ ID NO: 6383 - RNA, 1290 nt, synthetic construct
  misc_feature 1..1290: note = derived and/or modified CDS sequence (opt1) from HTNV(Maaji-1)__AF321094.1__N
  source 1..1290: mol_type = other RNA
atggccaccatggaggagctgcagaaggagatcaacgcccacgagggccagctcgtgatcgcgcgccagaaggtccgggacgccgagcgccagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggacccgaccggcgtggagcccggggaccacctcaaggagcggtccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgcgggcggcagacgaccaaggacaacaagggcacccgcatccggttcaaggacgactccagcttcgaggacgtgaacgggatccgcaagccgaagcacctgtacgtgtccctccccaacgcgcagagctccatgaaggccgaggagatcacccccggccggtaccgcacggccgtctgcgggctgtaccccgcccagatcaaggcccggcagatgatcagcccggtgatgtccgtgatcggcttcatggcgctggccaaggactggagcgagcgcatcgagcagtggctctccgagccctgcaagctgctgcccgacaccagcgccgtctccctcctgggcgggcccgccaccaacaaggactacctgcggcagcgccaggtggccctcggcaacatggagaccaaggagagcaaggcgatccggcagcaggccgaggcctccgggtgcagcatgatcgaggacatcgagtccccgagcagcatctgggtgttcgccggcgcccccgaccgctgcccgcccacgtgcctgttcatcgcgggcatggccgagctgggggccttcttctccatcctccaggacatgcggaacaccatcatggccagcaagaccgtcggcacctccgaggagaagctgcgcaagaagtccagcttctaccagagctacctgcgccggacgcagtccatggggatccagctcgaccagcgcatcatcgtgctgttcatggtggcctggggcaaggaggcggtcgacaacttccacctgggggacgacatggaccccgagctccggaccctggcccagagcctgatcgacgtgaaggtgaaggagatctccaaccaggagcccctcaagctgtga

SEQ ID NO: 6384 - RNA, 1290 nt, synthetic construct
  misc_feature 1..1290: note = derived and/or modified CDS sequence (opt1) from HTNV(Maaji-2)__AF321095.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgtgagcatccaggccaagatcgacgagctcaagcggcagctggccgaccgcatcgcgaccggcaagaacttcgggaaggagcaggacccgaccggcgtcgagcccggggaccacctgaaggagcggtccatgctcagctacggcaacgtgctggacctgaaccacctcgacatcgacgagcccaccggccagacggccgactggctgtccatcgtggtctacctgaccagcttcgtggtgcccatcctcctgaaggccctgtacatgctcaccacccgcgggcggcagacgaccaaggacaacaagggcacccgcatccggttcaaggacgactccagcttcgaggacgtcaacgggatccgcaagccgaagcacctgtacgtgtccctgcccaacgcccagagctccatgaaggcggaggagatcacccccggccggtaccgcacggccgtgtgcgggctctaccccgcccagatcaaggcccggcagatgatcagcccggtcatgtccgtgatcggcttcctggccctggcgaaggactggagcgaccgcatcgagcagtggctctccgagccctgcaagctgctgcccgacaccgccgccgtgagcctcctgggcgggcccgccaccaaccgggactacctgcgccagcggcaggtcgccctcggcaacatggagaccaaggagtccaaggcgatccgccagcacgccgaggccgccgggtgcagcatgatcgaggacatcgagtccccgagctccatctgggtgttcgccggcgcgcccgaccggtgcccgcccacgtgcctgttcatcgccggcatcgccgagctgggggccttcttcagcatcctccaggacatgcgcaacaccatcatggccagcaagaccgtgggcacctccgaggagaagctgcgcaagaagtccagcttctaccagagctacctgcggcgcacgcagctcatggggatccagctggaccagcggatcatcgtcctgttcatggtggcgtggggcaaggaggccgtggacaacttccacctcggggacgacatggaccccgagctgcgcaccctggcccagtccctcatcgacgtcaaggtgaaggagatcagcaaccaggagcccctgaagctgtga

SEQ ID NO: 6385 - RNA, 1290 nt, synthetic construct
  misc_feature 1..1290: note = derived and/or modified CDS sequence (opt1) from HTNV(N8)__DQ658415.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggacccgaccggcgtggagcccggggaccacctcaaggagcggtccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgcgggcggcagacgaccaaggacaacaagggcacccgcatccggttcaaggacgactccagcttcgaggacgtgaacgggatccgcaagccgaagcacctgtacctctccctgcccaacgcgcagagctccatgaaggccgaggagatcacccccggccggtaccgcacggccatctgcgggctgtaccccgcccagatcaaggcccggcagatgatcagcccggtgatgtccgtcatcggcttcctcgcgctggccaaggactggagcgaccgcatcgagcagtggctgtccgagccctgcaagctcctgcccgacgccgccgccgtgagcctgcacggcgggcccgcgaccaaccgggactacctccgccagcgccaggtggccctgggcaacatggagaccaaggagtccaaggccatccggcagcacgccgagaccgccgggtgcagcatgatcgacgacatcgagtccccgagctccatctgggtcttcgcgggcgcccccgaccggtgcccgcccacgtgcctgttcatcgccggcatcgccgagctcggggccttcttcagcatcctgcaggacatgcgcaacaccatcatggcgagcaagaccgtgggcacctccgaggagaagctgcgcaagaagtccagcttctaccagagctacctccggcgcacgcagtccatggggatccagctggaccagcggatcatcgtgctgttcatggtcgcctggggcaaggaggccgtggacaacttccacctcggggacgacatggaccccgagctgcgcaccctggcccagagcctcatcgacgtgaaggtcaaggagatctccaaccaggagcccctgaagctgtga

SEQ ID NO: 6386 - RNA, 1290 nt, synthetic construct
  misc_feature 1..1290: note = derived and/or modified CDS sequence (opt1) from HTNV(Q32)__AB027097.1__N
  source 1..1290: mol_type = other RNA
atggccaccatggaggagctgcagcgcgagatcaacgcccacgagggccagctcgtgatcgcgcggctgaaggtccgcgacgccgagaagccctacgagaaggacccggacgagctgaacatgcggaccctcacggaccgcgagggggtggccgccagcatccaggccaagatcgacgagctgaagcggcagctggcggaccgcatcgccaccggcaagaacctcgggaaggagcaggaccccaccggcgtggagcccggggaccacctgaaggagcggtccatgctgagctacggcaacgtcctcgacctgaaccacctggacatcgacgagcccaccggccagacggccgactggctctccatcgtgatctacctgaccagcttcgtggtcccgatcctgctcaaggccctgtacatgctgaccacccgcgggcggcagacgaccaaggacaacaagggcacccgcatccggttcaaggacgactccagcttcgaggacgtgaacgggatccgcaagcccaagcacctctacgtgtccctgcccaacgcgcagagctccatgaaggccgaggagatcacccccggccggtaccgcacggccatctgcgggctgtacccggcccagatcaaggcccggcagatgatcagccccgtcatgtccgtgatcggcttcctcgcgctggccaaggactggagcgaccgcatcgagcagtggctgtccgagccctgcaagctcctgcccgacaccgccgccgtgagcctgcacggcgggccggccaccaaccgggactacctccgccagcggcaggtcgcgctgggcaacatggagaccaaggagtccaaggccatccgccagcacgccgagagcgccgggtgctccatggtggaggacatcgagagcccctccagcatctgggtgttcgccggcgcgcccgaccggtgcccgcccacgtgcctgttcatcgccggcatcgccgagctcggggccttcttcagcatcctgcaggacatgcgcaacaccatcatggcctccaagaccgtcggcaccagcgaggagaagctgcgcaagaagtccagcttctaccagtcctacctccggcgcacgcagagcatggggatccagctggaccagcggatcatcgtgctgttcatggtggcgtggggcaaggaggccgtcgacaacttccagcccggggacgacatggaccccgagctccgcaccctggcccagtccctgatcgacgtgaaggtgaaggagatcagcaaccaggagcccctcaagctgtga

SEQ ID NO: 6387 - RNA, 1290 nt, synthetic construct
  misc_feature 1..1290: note = derived and/or modified CDS sequence (opt1) from HTNV(SXHu2012B1)__KC844226.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggaccccaccggcgtggagcccggggaccacctcaaggagcggtccatgctgagctacggcaacgtcctggacctcaaccacctggacatcgacgagcccaccggccagaccgccgactggctgtccatcgtgatctacctcacgagcttcgtggtccccatcctgctgaaggcgctctacatgctgaccacccgcgggcggcagaccacgaaggacaacaagggcacccgcatccggttcaaggacgactccagcttcgaggacgtgaacgggatccgcaagccgaagcacctgtacgtgtccctccccaacgcccagagctccatgaaggccgaggagatcacccccggccggtaccgcaccgccatctgcgggctgtaccccgcccagatcaaggcgcggcagatgatcagcccggtcatgtccgtgatcggcttcctggccctcgccaaggactggagcgaccgcatcgagcagtggctgtccgagccctgcaagctgctccccgacacggccgccgtgagcctgcacggcgggcccgcgaccaaccgggactacctgcgccagcggcaggtcgccctcggcaacatggagaccaaggagtccaaggccatccgccagcacgccgagagcgccgggtgctccatggtggaggacatcgagagcccgtccagcatctgggtgttcgcgggcgcccccgaccggtgcccgccgacctgcctgttcatcgccggcatcgccgagctgggggccttcttcagcatcctccaggacatgcgcaacacgatcatggcgtccaagaccgtcggcaccagcgaggagaagctgcgcaagaagtccagcttctaccagtcctacctgcggcgcacccagagcatggggatccagctcgaccagcggatcatcgtgctgttcatggtggcctggggcaaggaggccgtcgacaacttccacctgggggacgacatggaccccgagctccgcacgctggcccagtccctgatcgacgtgaaggtgaaggagatcagcaaccaggagcccctcaagctgtga

SEQ ID NO: 6388 - RNA, 1290 nt, synthetic construct
  misc_feature 1..1290: note = derived and/or modified CDS sequence (opt1) from HTNV(TJJ16)__AY839871.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgaggggctcgccgccagcatccaggcgaagatcgacgagctgaagcggcagctggccgaccgcatcgccacgggcaagaacctcgggaaggagcgggaccccaccggcgtggagcccggggaccacctgaaggagcgctccatgctgagctacggcaacgtgctcgacctgaaccacctggacatcgacgagcccaccggccagaccgccgactggctctccatcgtcatctacctgacgagcttcgtggtgcccatcctgctcaaggcgctgtacatgctgaccacccgggggcgccagaccacgaaggacaacaagggcacccggatccgcttcaaggacgactccagcttcgaggacgtcaacgggatccggaagccgaagcacctctacgtgtccctgcccaacgcccagagctccatgaaggccgaggagatcacccccggccgctaccggaccgccatctgcgggctgtaccccgcccagatcaaggcgcgccagatgatcagcccggtgatgtccgtcatcggcttcctcgccctggccaaggactggagcgaccggatcgagcagtggctgtccgagccctgcaagctcctgcccgacacggccgccgtgagcctgcacggcgggcccgcgaccaaccgcgactacctccggcagcgccaggtggccctgggcaacatggagaccaaggagtccaaggccatccggcagcacgccgagagcgccgggtgctccatggtcgaggacatcgagagcccgtccagcatctgggtgttcgcgggcgcccccgaccgctgcccgccgacctgcctgtacatcgccggcatcgccgagctcggggccttcttcagcatcctgcaggacatgcgcaacacgatcatggcgtccaagaccgtgggcaccagcgaggagaagctgcggaagaagtccagcttctaccagtcctacctccgccggacccagagcatggggatccagctggaccagcgcatcatcgtcctgttcatggtggcctggggcaaggaggccgtggacaacttccacctcggggacgacatggaccccgagctgcggacgctggcccagtccctcatcgacgtcaaggtgaaggagatcagcaaccaggagcccctgaagctgtga

SEQ ID NO: 6389 - RNA, 1290 nt, synthetic construct
  misc_feature 1..1290: note = derived and/or modified CDS sequence (opt1) from HTNV(WCL)__KM355414.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcgagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccatctgcgggctgtaccccgcccagatcaaggcccggcagatgatcagcccggtgatgtccgtcatcggcttcctggcgctcgccaaggactggagcgaccgcatcgagcagtggctgtccgagccctgcaagctgctccccgacacggccgccgtgagcctgctgggcgggcccgccaccaaccgggactacctccgccagcgccaggtggcgctgggcaacatggagaccaaggagtccaaggccatccggcagcacgccgaggccgccgggtgcagcatgatcgaggacatcgagtccccgagctccatctgggtcttcgcgggcgcccccgaccggtgcccgccgacctgcctgttcatcgccggcatcgccgagctcggggccttcttcagcatcctgcaggacatgcgcaacacgatcatggcgagcaagaccgtgggcacctccgaggagaagctgcgcaagaagtccagcttctaccagagctacctccggcgcacccagtccatggggatccagctggaccagcggatcatcgtgctgttcatggtcgcctggggcaaggaggccgtggacaacttccacctcggggacgacatggaccccgagctgcgcacgctggcccagagcctcatcgacgtgaaggtcaaggagatctccaaccaggagcccctgaagctgtga

SEQ ID NO: 6390 - RNA, 1290 nt, synthetic construct
  misc_feature 1..1290: note = derived and/or modified CDS sequence (opt1) from HTNV(YN509)__GU329991.1__N
  source 1..1290: mol_type = other RNA
atggccaccatggaggagctgcagaaggagatcaacgcccacgagggccagctcatcatcgcgaagcagaaggtgaaggacgccgagaagcagtacgagaaggaccccgacgagctgaacaagcgcgccctgaccgaccgggagggggtcgccgccagcatccaggcgaagatcgacgagctcaagcgccagctggccgaccggatcgccacgggcaagaacctggggcaggaccgcgaccccaccggcgtggagcccggggaccacctcaaggagcggtccatgctgagctacggcaacatcctggacctcaaccacctggacatcgacgagcccaccggccagaccgccgactggctgtccatcatcgtgtacctcacgagcttcgtcgtgcccatcctgctgaaggcgctctacatgctgaccacccgcgggcggcagaccgccaaggacaacaagggcacgcgcatccggttcaaggacgactccagcttcgaggacgtgaacgggatccgcaagccgaagcacctgtacgtctccatgcccaacgcccagagctccatgaaggccgaggagatcacccccggccggtaccgcaccgccgtgtgcgggctctaccccgcgcagatcaaggcccggcagatggtgagcccggtcatgtccgtgatcggcttcatggccctggccaaggactggaccgaccgcatcgagaactggctgggcgagccctgcaagctcctgcccgacacgagctccgtgatcctgctcgggggccccgccaccaaccgggactacatccgccagcggcaggtcgcgctggggaacatggagaccaaggaggccaaggccgtgcgccagcacgccgagagcgccggctgctccatgatcgacaacatcgacagcccgtccagcatctgggtgttcgcgggcgcccccgaccggtgcccgccgacctgcctgttcgtcgccgggctcgccgagctgggcgccttcttctccatcctgcaggacatgcgcaacacgatcatggcgagcaagaccgtggggaccagcgaggagaagatgcggaagaagtccagcttctaccagtcctacctccgccgcacccagagcatgggcatccagctggaccagcggatcatcgtgctgttcatggtcgcctgggggaaggaggccgtggacaacttccacctcggcgacgacatggaccccgagctgcgcaacctggcccagtccctcatcgaccagaaggtgaaggagatcagcaaccaggagcccctgaagctgtga

SEQ ID NO: 6391 - RNA, 1290 nt, synthetic construct
  misc_feature 1..1290: note = derived and/or modified CDS sequence (opt1) from HTNV(YU62)__AY748309.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgaggggctcgccgccagcatccaggcgaagatcgacgagctgaagcggcagctggccgaccgcatcgccacgggcaagaacctcgggaaggagcaggaccccaccggcgtggagcccggggaccacctgaaggagcggtccatgctgagctacggcaacgtgctcgacctgaaccacctggacatcgacgagcccaccggccagaccgccgactggctctccatcgtcatctacctgacgagcttcgtggtgcccatcctgctcaaggcgctgtacatgctgaccacccgcgggcggcagaccacgaaggacaacaagggcacccgcatccggttcaaggacgactccagcttcgaggacgtcaacgggatccgcaagccgaagcacctctacgtgtccctgcccaacgcccagagctccatgaaggccgaggagatcacccccggccggtaccgcaccgccatctgcgggctgtaccccgcccagatcaaggcgcggcagatgatcagcccggtgatgtccgtcatcggcttcctcgccctggccaaggactggagcgaccgcatcgagcagtggctgtccgagccctgcaagctcctgcccgacacggccgccgtgagcctgcacggcgggcccgcgaccaaccgggactacctccgccagcgccaggtggccctgggcaacatggagaccaaggagtccaaggccatccggcagcacgccgagagcgccgggtgctccatggtcgaggacatcgagagcccgtccagcatctgggtgttcgcgggcgcccccgaccggtgcccgccgacctgcctgttcatcgccggcatcgccgagctcggggccttcttcagcatcctgcaggacatgcgcaacacgatcatggcgtccaagaccgtgggcaccagcgaggagaagctgcgcaagaagtccagcttctaccagtcctacctccggcgcacccagagcatggggatccagctggaccagcggatcatcgtcctgttcatggtggcctggggcaaggaggccgtggacaacttccacctcggggacgacatggaccccgagctgcgcacgctggcccagtccctcatcgacgtcaaggtgaaggagatcagcaaccaggagcccctgaagctgtga

SEQ ID NO: 6392 - RNA, 1290 nt, synthetic construct
  misc_feature 1..1290: note = derived and/or modified CDS sequence (opt1) from HTNV(ZLS6-11)__FJ753396.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggacccgaccggcgtggagcccggggaccacctcaaggagcggtccatgctgagctacggcaacgtcctggacctcaaccacctggacatcgacgagcccaccggccagaccgccgactggctgtccatcgtgatctacctcacgagcttcgtggtccccatcctgctgaaggcgctctacatgctgaccacccgcgggcggcagaccacgaaggacaacaagggcacccgcatccggttcaaggacgactccagcttcgaggacatcaacgggatccgcaagccgaagcacctgtacgtgtccctccccaacgcccagagctccatgaaggccgaggagatcacccccggccggtaccgcaccgccatctgcgggctgtaccccgcccagatcaaggcgcggcagatgatcagcccggtgatgtccgtcatcggcttcctggccctcgccaaggactggagcgaccgcatcgagcagtggctgtccgagccctgcaagctgctccccgacacggccgccgtgagcctgcacggcgggcccgcgaccaaccgggactacctgcgccagcgccaggtggccctcggcaacatggagaccaaggagtccaaggccatccggcagcacgccgagaccgccgggtgcagcatgatcgaggacatcgagtccccgagctccatctgggtcttcgcgggcgcccccgaccggtgcccgcccacgtgcctgttcatcgccggcatcgccgagctgggggccttcttcagcatcctccaggacatgcgcaacaccatcatggcgagcaagaccgtgggcacctccgaggagaagctgcgcaagaagtccagcttctaccagagctacctgcggcgcacgcagtccatggggatccagctcgaccagcggatcatcgtgctgttcatggtcgcctggggcaaggaggccgtggacaacttccacctgggggacgacatggaccccgagctccgcaccctggcccagagcctgatcgacgtgaaggtcaaggagatctccaaccaggagcccctcaagctgtga

SEQ ID NO: 6393 - RNA, 1290 nt, synthetic construct
  misc_feature 1..1290: note = derived and/or modified CDS sequence (opt1) from HTNV__AB027523.1__N
  source 1..1290: mol_type = other RNA
atggccaccatggaggagctgcagaaggagatcaacgcccacgagggccagctcatcatcgcgaagcagaaggtgaaggacgccgagaagcagtacgagaaggaccccgacgagctgaacaagcgcgccctgaccgaccgggagggggtcagcgcctccatccaggccaagatcgacgagctcaagcgccagctggcggaccggatcgccacgggcaagaacctggggcaggaccgcgaccccaccggcgtggagcccggggaccacctcaaggagcggagcatgctgtcctacggcaacatcctggacctcaaccacctggacatcgacgagcccaccggccagaccgccgactggctgagcatcatcgtgtacctcacgtccttcgtcgtgcccatcctgctgaaggccctctacatgctgaccacccgcgggcggcagaccgcgaaggacaacaagggcacgcgcatccggttcaaggacgacagctccttcgaggacgtgaacgggatccgcaagccgaagcacctgtacgtcagcatgcccaacgcccagtccagcatgaaggccgaggagatcacccccggcgggtaccggaccgccgtgtgcggcctcttccccgcccagatcaaggcgcgccagatggtgtccccggtcatgagcgtgatcggcttcatggccctggccaaggactggaccgaccggatcgagtcctggctgggggagccctgcaagctcctgcccgacacgagcgccgtgtccctgctcggcgggcccgccaccaaccgcgactacatccggcagcgccaggtcgcgctgggcaacatggagaccaaggaggccaaggccgtgcggcagcacgccgagagcgccggctgctccatgatcgacaacatcgacagcccgtccagcatctgggtgttcgcgggggcccccgaccgctgcccgccgacctgcctgttcatcgccggcatcgccgagctcggggccttcttcagcatcctgcaggacatgcggaacacgatcatggcgtccaagaccgtcggcaccagcgaggagaagatgcgcaagaagtccagcttctaccagtcctacctgcggcgcacccagagcatggggatccagctcgaccagcgcatcatcgtgctgttcatggtggcctggggcaaggaggccgccgacaacttccagcacggcgacgacatggaccccgagctgcggacgctcgcgcagtccctgatcgaccagaaggtcaaggagatcagcaaccaggagcccctgaagctctga

SEQ ID NO: 6394 - RNA, 1293 nt, synthetic construct
  misc_feature 1..1293: note = derived and/or modified CDS sequence (opt1) from HTNV__D25530.1__N
  source 1..1293: mol_type = other RNA
atgatggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccaaccgcgagggggtggccgtgagcatccaggccaagatcgacgagctcaagatgcagctggcggaccggatcgccacgggcaagaacctggggaaggagcaggaccccaccggcgtcgagcccggggaccacctcaaggagcgctccatgctgagctacggcaacgtgctggacctcaaccacctggacatcgacgagcccaccggccagaccgccgactggctgtccatcatcgtgtacctcacgagcttcgtcgtgcccatcctgctgaaggccctctacatgctgaccacccgggggcgccagaccacgaaggacaacaagggcacccggatccgcttcaaggacgactccagcttcgaggacgtgaacgggatccggaagccgaagcacctgtacgtctccctccccaacgcgcagagctccatgaaggccgaggagatcacccccggccgctaccggaccgccgtgtgcgggctgtaccccgcccagatcaaggcccgccagatgatcagcccggtgatgtccgtcatcggcttcctggcgctcgccaaggactggagcgaccggatcgagcagtggctgatcgagccctgcaagctgctccccgacacggccgccgtgtccctgctgggcgggcccgccaccaaccgcgactacctccggcagcgccaggtggcgctgggcaacatggagaccaaggagagcaaggccatccggcagcacgccgaggccgccgggtgctccatgatcgaggacatcgagagcccgtccagcatctgggtcttcgcgggcgcccccgaccgctgcccgccgacctgcctgttcatcgccggcatcgccgagctcggggccttcttctccatcctgcaggacatgcggaacacgatcatggcgagcaagaccgtgggcaccagcgaggagaagctgcgcaagaagtccagcttctaccagtcctacctccgccggacccagagcatggggatccagctggaccagcgcatcatcgtgctgttcatggtcgcctggggcaaggaggccgtggacaacttccacctcggggacgacatggaccccgagctgcggacgctggcccagtccctcatcgacgtgaaggtcaaggagatcagcaaccaggagcccctgaagctgtga

SEQ ID NO: 6395 - RNA, 1290 nt, synthetic construct
  misc_feature 1..1290: note = derived and/or modified CDS sequence (opt1) from HTNV__M14626.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgtgagcatccaggccaagatcgacgagctcaagcggcagctggccgaccgcatcgcgaccggcaagaacctggggaaggagcaggacccgaccggcgtcgagcccggggaccacctcaaggagcggtccatgctgagctacggcaacgtgctggacctcaaccacctggacatcgacgagcccaccggccagacggccgactggctgtccatcatcgtgtacctcaccagcttcgtcgtgcccatcctgctgaaggccctctacatgctgaccacccgcgggcggcagacgaccaaggacaacaagggcacccgcatccggttcaaggacgactccagcttcgaggacgtgaacgggatccgcaagccgaagcacctgtacgtctccctccccaacgcccagagctccatgaaggcggaggagatcacccccggccggtaccgcacggccgtgtgcgggctgtaccccgcccagatcaaggcccggcagatgatcagcccggtgatgtccgtcatcggcttcctggccctcgcgaaggactggagcgaccgcatcgagcagtggctgatcgagccctgcaagctgctccccgacaccgccgccgtgtccctgctgggcgggcccgccaccaaccgggactacctccgccagcgccaggtggccctgggcaacatggagaccaaggagagcaaggcgatccggcagcacgccgaggccgccgggtgctccatgatcgaggacatcgagagcccgtccagcatctgggtcttcgccggcgcgcccgaccggtgcccgcccacgtgcctgttcatcgccggcatcgccgagctcggggccttcttctccatcctgcaggacatgcgcaacaccatcatggccagcaagaccgtgggcaccagcgaggagaagctgcgcaagaagtccagcttctaccagtcctacctccggcgcacgcagagcatggggatccagctgggccagcggatcatcgtgctgttcatggtcgcgtgggggaaggaggccgtggacaacttccacctcggcgacgacatggaccccgagctgcgcaccctggcccagtccctcatcgacgtgaaggtcaaggagatcagcaaccaggagcccctgaagctgtga

SEQ ID NO: 6396 - RNA, 1290 nt, synthetic construct
  misc_feature 1..1290: note = derived and/or modified CDS sequence (opt1) from HTNV__X95077.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgtgagcatccaggccaagatcgacgagctcaagcggcagctggccgaccgcatcgcgaccggcaagaacctggggaaggagcaggaccccaccggcgtcgagcccggggaccacctcaaggagcggtccatgctgagctacggcaacgtgctggacctcaaccacctggacatcgacgagcccaccggccagacggccgactggctgtccatcgtggtctacctcaccagcttcgtggtgcccaccctgctgaaggccctctacatgctgaccacgcgcgggcggcagaccaccaaggacaacaagggcacccgcatccggttcaaggacgactccagcttcgaggacgtcaacgggatccgcaagccgaagcacctgtacgtgtccctccccaacgcccagagctccatgaaggcggaggagatcacgcccggccggtaccgcaccgccgtgtgcgggctgtaccccgcccagatcaaggcccggcagatgatcagcccggtcatgtccgtgatcggcttcctggccctcgcgaaggactggagcgaccgcatcgagcagtggctgtccgagccctgcaagctgctccccgacaccaccgccgtgagcctgctgggcgggcccgccacgaaccgggactacctccgccagcggcaggtcgccctgggcaacatggagaccaaggagtccaaggccatccgccagcacgcggaggccgccgggtgcagcatgatcgaggacatcgagtccccgagctccatctgggtgttcgccggcgcccccgaccggtgcccgccgacctgcctgttcatcgcgggcatcgccgagctcggggccttcttcagcatcctgcaggacatgcgcaacaccatcatggccagcaagacggtgggcacctccgaggagaagctgcgcaagaagtccagcttctaccagagctacctccggcgcacccagtccatggggatccagctggaccagcggatcatcgtcctgttcatggtggcctggggcaaggaggcggtggacaacttccacctcggggacgacatggaccccgagctgcgcaccctggcccagagcctcatcgacgtcaaggtgaaggagatctccaaccaggagcccctgaagctgtga

SEQ ID NO: 6397 - RNA, 1290 nt, synthetic construct
  misc_feature 1..1290: note = derived and/or modified CDS sequence (opt1) from HTNV(CGAa1011)__EF990913.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggaccccaccggcgtggagcccggggaccacctcaaggagcggtccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgcgggcggcagacgaccaaggacaacaagggcacccgcatccggttcaaggacgactccagcttcgaggacgtgaacgggatccgcaagccgaagcacctggacgtgtccctccccaacgcgcagagctccatgaaggccgaggagatcacccccggccggtaccgcacggccatctgcgggctgtaccccgcccagatcaaggcccggcagatgatcagcccggtcatgtccgtgatcggcttcctggcgctcgccaaggactggagcgaccgcatcgagcagtggctgggcgagccctgcaagctgctccccgacaccgccgccgtgtccctgctcgggggccccgccaccaaccgggactacctgcgccagcggcaggtcgcgctggggaacatggagaccaaggagagcaaggccatccgccagcacgccgagacggccggctgctccatgatcgaggacatcgagagcccgtccagcatctgggtgttcgccggcgcgcccgaccggtgcccgccgacctgcctgttcatcgccgggatcgccgagctcggcgccttcttctccgtgctgcaggacatgcgcaacaccatcatggccagcaagaccgtcgggacgagcgaggagaagctgcgcaagaagtccagcttctaccagtcctacctcggccggacccagagcatggggatccagctggaccagcgcatcatcgtgctgttcatggtggcgtggggcaaggaggccgtcgacaacttccacctcggcgacgacgtggaccccgagctgcggaccctggcccagtccctcatcgacgtgaaggtcaaggagatcagcgaccaggagcccctgaagctgtga

SEQ ID NO: 6398 - RNA, 1290 nt, synthetic construct
  misc_feature 1..1290: note = derived and/or modified CDS sequence (opt1) from HTNV(CGAa1015)__EF990912.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggaccccaccggcgtggagcccggggaccacctcaaggagcggtccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgcgggcggcagacgaccaaggacaacaagggcacccgcatccggttcaaggacgactccagcttcgaggacgtgaacgggatccgcaagccgaagcacctggacgtgtccctccccaacgcgcagagctccatgaaggccgaggagatcacccccggccggtaccgcacggccatctgcgggctgtaccccgcccagatcaaggcccggcagatgatcagcccggtcatgtccgtgatcggctacctggcgctcgccaaggactggagcgaccgcatcgagcagtggctgggcgagccctgcaagctgctccccgacaccgccgccgtgtccctgctcgggggccccgccaccaaccgggactacctgcgccagcggcaggtcgcgctggggaacatggagaccaaggagagcaaggccatccgccagcacgccgagacggccggctgctccatgatcgaggacatcgagagcccgtccagcatctgggtgttcgccggcgcgcccgaccggtgcccgccgacctgcctgttcatcgccgggatcgccgagctcggcgccttcatctccgtgctgcaggacatgcgcaacaccatcatggccagcaagaccgtcgggacgagcgaggagaagctgcgcaagaagtccagcttctaccagtcctacctcggccggacccagagcatggggatccagctggaccagcgcatcatcgtgctgttcatggtggcgtggggcaaggaggccgtcgacaacttccacctcggcgacgacgtggaccccgagctgcggaccctggcccagtccctcatcgacgtgaaggtcaaggagatcagcgaccaggagcccctgaagctgtga

SEQ ID NO: 6399 - RNA, 1290 nt, synthetic construct
  misc_feature 1..1290: note = derived and/or modified CDS sequence (opt1) from HTNV(CGAa2)__EU092219.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggaccccaccggcgtggagcccggggaccacctcaaggagcggtccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgcgggcggcagacgaccaaggacaacaagggcacccgcatccggttcaaggacgactccagcttcgaggacgtgaacgggatccgcaagccgaagcacctgtacgtgtccctccccaacgcgcagagctccatgaaggccaaggagatcacccccggccggtaccgcacggccatctgcgggctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacaccgccgccgtgagcctgcacggcgggcccgccaccaaccgggactacctgcgccagcggcaggtcgcgctcggcaacatggagccgaaggagtccaaggccatccgccagcacgccgagagcgccgggtgctccatggtggaggacatcgagagcccctccagcatctgggtgttcgccggcgcgcccgaccggtgcccgccgacctgcctgttcatcgccggcatcgccgagctgggggccttcttcagcatcctccaggacatgcgcaacacgatcatggcctccaagaccgtcggcaccagcgaggagaagctgcgcaagaagtccagcttctaccagtcctacctgcggcgcacccagagcatggggatccagctcgaccagcggatcatcgtgctgttcatggtggcgtggggcaaggaggccgtcgacaacttccacctgggggacgacatggaccccgagctccgcacgctggcccagtccctgatcgacgtgaaggtgaaggagatcagcaaccaggagcccctcaagctgtga

SEQ ID NO: 6400 - RNA, 1290 nt, synthetic construct
  misc_feature 1..1290: note = derived and/or modified CDS sequence (opt1) from HTNV(CGAa31MP7)__EF990911.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggacccgaccggcgtggagcccggggaccacctcaaggagcggtccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgcgggcggcagacgaccaaggacaacaagggcacccgcatccggttcaaggacgactccagcttcgaggacgtgaacgggatccgcaagccgaagcacctgtacgtgtccctccccaacgcgcagagctccatgaaggccgaggagatcacccccggccggtaccgcacggccatctgcgggctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacaccgccgccgtgagcctgcacggcgggcccgccaccaaccgggactacctgcgccagcggcaggtcgcgctcggcaacatggagaccaaggagtccaaggccatccgccagcacgccgagagcgccgggtgctccatggtggaggacatcgagagcccgtccagcatctgggtgttcgccggcgcgcccgaccggtgcccgcccacgtgcctgttcatcgccggcatcgccgagctgggggccttcttcagcatcctccaggacatgcgcaacaccatcatggcctccaagaccgtcggcaccagcgaggagaagctgcgcaagaagtccagcttctaccagtcctacctgcggcgcacgcagagcatggggatccagctcgaccagcggatcatcgtgctgttcatggtggcgtggggcaaggaggccgtcgacaacttccacctgggggacgacatggaccccgagctccgcaccctggcccagtccctgatcgacgtgaaggtgaaggagatcagcaaccaggagcccctcaagctgtga

SEQ ID NO: 6401 - RNA, 1290 nt, synthetic construct
  misc_feature 1..1290: note = derived and/or modified CDS sequence (opt1) from HTNV(CGAa31P9)__EF990910.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggacccgaccggcgtggagcccggggaccacctcaaggagcggtccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgcgggcggcagacgaccaaggacaacaagggcacccgcatccggttcaaggacgactccagcttcgaggacgtgaacgggatccgcaagccgaagcacctgtacgtgtccctccccaacgcgcagagctccatgaaggccgaggagatcacccccggccggtaccgcacggccatctgcgggctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacaccgccgccgtgagcctgcacggcgggcccgccaccaaccgggactacctgcgccagcggcaggtcgcgctcggcaacatggagaccaaggagtccaaggccatccgccagcacgccgagagcgccgggtgctccatggtggaggacatcgagagcccgtccagcatctgggtgttcgccggcgcgcccgaccggtgcccgcccacgtgcctgttcatcgccgagatcgccgagctgggcgccttcttcagcatcctccaggacatgcgcaacaccatcatggcctccaagaccgtcgggaccagcgaggagaagctgcgcaagaagtccagcttctaccagtcctacctgcggcgcacgcagagcatgggcatccagctcgaccagcggatcatcgtgctgttcatggtggcgtgggggaaggaggccgtcgacaacttccacctgggcgacgacatggaccccgagctccgcaccctggcccagtccctgatcgacgtgaaggtgaaggagatcagcaaccaggagcccctcaagctgtga

SEQ ID NO: 6402 - RNA, 1290 nt, synthetic construct
  misc_feature 1..1290: note = derived and/or modified CDS sequence (opt1) from HTNV(CGAa4MP9)__EF990915.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggaccccaccggcgtggagcccggggaccacctcaaggagcggtccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgcgggcggcagacgaccaaggacaacaagggcacccgcatccggttcaaggacgactccagcttcgaggacgtgaacgggatccgcaagccgaagcacctgtacgtgtccctccccaacgcgcagagctccatgaaggccgaggagatcacccccggccggtaccgcacggccatctgcgggctgtaccccgcccagatcaaggcccggcagatgatcagcccggtcatgtccgtgatcggcttcctggcgctcgccaaggactggagcgaccgcatcgagcagtggctgggcgagccctgcaagctgctccccgacaccgccgccgtgtccctgctcgggggccccgccaccaaccgggactacctgcgccagcggcaggtcgcgctggggaacatggagaccaaggagagcaaggccatccgccagcacgccgagacggccggctgctccatgatcgaggacatcgagagcccgtccagcatctgggtgttcgccggcgcgcccgaccggtgcccgccgacctgcctgttcatcgccgggatcgccgagctcggcgccttcttctccgtgctgcaggacatgcgcaacaccatcatggccagcaagaccgtcgggacgagcgaggagaagctgcgcaagaagtccagcttctaccagtcctacctccggcgcacccagagcatgggcatccagctggaccagcggatcatcgtgctgttcatggtggcgtgggggaaggaggccgtcgacaacttccacctcggcgacgacatggaccccgagctgcgcaccctggcccagtccctcatcgacgtgaaggtgaaggagatcagcaaccaggagcccctgaagctgtga

SEQ ID NO: 6403 - RNA, 1290 nt, synthetic construct
  misc_feature 1..1290: note = derived and/or modified CDS sequence (opt1) from HTNV(CGAa75)__EU092220.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggacccgaccggcgtggagcccggggaccacctcaaggagcggtccatgctgagctacggcaacgtcctggacctcaaccacctggacatcgacgagcccaccggccagacggccgactggctgtccatcgtgatctacctcaccagctccgtggtccccatcctgctgaaggccctctacatgctgaccacccgcgggcggcagacgaccaaggacaacaagggcacccgcatccggttcaaggacgacagctccttcgaggacgtgaacgggatccgcaagccgaagcacctgtacgtgagcctccccaacgcgcagtccagcatgaaggccgaggagatcacccccggccggtaccgcacggccatctgcgggctgtaccccgcccagatcaaggcccggcagatgatctccccggtcatgaacgtgatcggcttcctggcgctcgccaaggactggagcgaccgcatcgagcagtggctgtccgagccctgcaagctgctccccgacaccgccgccgtgagcctgcacggcgggcccgccaccaaccgggactacctgcgccagcggcaggtcgcgctcggcaacatggagaccaaggagtccaaggccatccgccagcacgccgagagcgccgggtgctccatggtggaggacatcgagagcccgtccagcatctgggtgttcgccggcgcgcccgaccggtgcccgcccacgtgcctgttcatcgccggcatcgccgagctgggggccttcttcagcatcctccaggacatgcgcaacaccatcatggcctccaagaccgtcggcaccagcgaggagaagctgcgcaagaagtccagcttctaccagtcctacctgcggcgcacgcagagcatggggatccagctcgaccagcggatcatcgtgctgttcatggtggcgtggggcaaggaggccgtcgacaacttccacctgggggacgacatggaccccgagctccgcaccctggcccagtccctgatcgacgtgaaggtgaaggagatcagcaaccaggagcccctcaagctgtga

SEQ ID NO: 6404 - RNA, 1290 nt, synthetic construct
  misc_feature 1..1290: note = derived and/or modified CDS sequence (opt1) from HTNV(CGHu1)__EU092218.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggacagcgacgagctgaacaagcggaccctgacggaccgcgagggggtggccgtgtccatccaggccaagatcgacgagctcaagcggcagctggccgaccgcatcgcgaccggcaagaacctggggaaggagcaggaccccaccggcgtcgagccgggggaccacctcaaggagcggagcatgctgtcctacggcaacgtgctggacctcaaccacctggacatcgacgagcccaccggccagacggccgactggctgagcatcgtggtctacctcacctccctggtggtgcccatcctgctcaaggccctgtacatgctgaccaccaaggggcgccagacgaccaaggacaacaagggcacccggatccgcttcaaggacgacagctccttcgaggacgtcaacgggatccggaagcccaagcacctctacgtgagcctgctgaacgcccagtccagcatgaaggcggaggagatcaccccgggccgctaccggacggccatctgcgggccctaccccgcccagatcaaggcccgccagatgatctcccccgtgatgagcgtcatcggcttcctcgccctggcgaaggactggtccgaccggatcgagcagtggctgagcgagccgtgcaagctcctgcccgacaccgccgccgtgtccctgctcggcgggcccgccaccaaccgcgactacctgcggcagcgccaggtggccctgggcaacatggagaccaaggagagcaaggcgatccggcagcacgccgaggccgccgggtgctccatgatcgaggacatcgagagcccctccagcatctgggtcagcgccggcgcgccggaccgctgcccgcccacgtgcctcttcatcgccggcatcgccgagctgggggccttcttctccatcctgcaggacatgcggaacaccatcatggccagcaagaccgtgggcacctccgaggagaagctccgcaagaagtccagcttctaccagagctacctgcgccggacgcagtccatggggatccagctggaccagcgcatcatcgtcctcttcatggtggcgtggggcaaggaggccgtggacaacttccacctgggggacgacatggaccccgagctgcggaccctcgcccagagcctgatcgacgtgaaggtcaaggagatctccaaccaggagcccctgaagctctga

SEQ ID NO: 6405 - RNA, 1290 nt, synthetic construct
  misc_feature 1..1290: note = derived and/or modified CDS sequence (opt1) from HTNV(CGHu2)__EU363813.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggacccgaccggcgtggagcccggggaccacctcaaggagcggtccatgctgagctacggcaacgtcctggacctcaaccacctggacatcgacgagcccaccggccagacggccgactggctgtccatcgtgatctacctcaccagcctggtggtccccatcctgctcaaggccctgtacatgctgaccacccgcgggcggcagacgaccaaggacaacaagggcacccgcatccggttcaaggacgactccagcttcgaggacgtgaacgggatccgcaagccgaagcacctctacgtgtccctgcccaacgcgcagagctccatgaaggccgaggagatcacccccggccggtaccgcacggccatctgcgggctgtaccccgcccagatcaaggcccggcagatgatcagcccggtcatgtccgtgatcggcttcctcgcgctggccaaggactggagcgaccgcatcgagcagtggctgtccgagccctgcaagctcctgcccgacaccgccgccgtgagcctgcacggcgggcccgccaccaaccgggactacctccgccagcggcaggtcgcgctgggcaacatggagaccaaggagtccaaggccatccgccagcacgccgagagcgccgggtgctccatggtggaggacatcgagagcccgtccagcatctgggtgttcgccggcgcgcccgaccggtgcccgcccacgtgcctgttcatcgccggcatcgccgagctcggggccttcttcagcatctcccaggacatgcgcaacaccatcatggccagcaagaccgtcggcacctccgaggagaagctgcgcaagaagtccagcttctaccagagctacctgcggcgcacgcagtccatggggatccagctcgaccagcggatcatcgtgctgttcatggtggcgtggggcaaggaggccgtcgacaacttccacctgggggacgacatggaccccgagctccgcaccctggcccagagcctgatcgacgtgaaggtgaaggagatctccaaccaggagcccctcaagctgtga

SEQ ID NO: 6406 - RNA, 1290 nt, synthetic construct
  misc_feature 1..1290: note = derived and/or modified CDS sequence (opt1) from HTNV(CGHu3612)__EF990909.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgaggggctcgccgccagcatccaggcgaagatcgacgagctgaagcggcagctggccgaccgcgtggccacgggcaagaacctcgggaaggagcaggaccccaccggcgtggagcccggggaccacctgaaggagcggtccatgctgagctacggcaacgtcctcgacctgaaccacctggacatcgacgagcccaccggccagaccgccgactggctctccatcgtgatctacctgacgagcttcgtggtccccatcctgctcaaggcgctgtacatgctgaccacccgcgggcggcagaccacgaaggacaacaagggcacccgcatccggttcaaggacgactccagcttcgaggacgtgaacgggatccgcaagccgaagcacctctacgtgtccctgcccaacgcccagagctccatgaaggccgaggagatcacccccggccggtaccgcaccgccatctgcgggctgtaccccgcccagatcaaggcgcggcagatgatcagcccggtcatgtccgtgatcggcttcctcgccctggccaaggactggagcgaccgcatcgagcagtggctgtccgagccctgcaagctcctgcccgacacggccgccgtgagcctgcacggcgggcccgcgaccaaccgggactacctccgccagcggcaggtcgccctgggcaacatggagaccaaggagtccaaggccatccgccagcacgccgagagcgccgggtgctccatggtggaggacatcgagagcccgtccagcatctgggtgttcgcgggcgcccccgaccggtgcccgccgacctgcctgttcatcgccggcatcgccgagctcggggccttcttcagcatcctgcaggacatgcgcaacacgatcatggcgtccaagaccgtcggcaccagcgaggagaagctgcgcaagaagtccagcttctaccagtcctacctccggcgcacccagagcatggggatccagctggaccagcggatcatcgtgctgttcatggtggcctggggcaaggaggccgtcgacaacttccacctcggggacgacatggaccccgagctgcgcacgctggcccagtccctcatcgacgtgaaggtgcgggagatcagcaaccaggagcccctgaagctgtga

SEQ ID NO: 6407 - RNA, 1290 nt, synthetic construct
  misc_feature 1..1290: note = derived and/or modified CDS sequence (opt1) from HTNV(CGRn15)__EU363810.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggaccccaccggcgtggagcccggggaccacctcaaggagcggtccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgcgggcggcagacgaccaaggacaacaagggcacccgcatccggttcaaggacgactccagcttcgaggacgtgaacgggatccgcaagccgaagcacctgtacgtgaccctccccaacgcgcagtccagcatgaaggccgaggagatcacgcccggccggtaccgcaccgccatctgcgggctgtaccccgcccagatcaaggcccggcagatgatctccccggtcatgagcgtgatcggcttcctggcgctcgccaaggactggtccgaccgcatcgagcagtggctgagcgagccctgcaagctgctccccgacaccgccgccgtgtccctgcacggcgggcccgccaccaaccgggactacctgcgccagcggcaggtcgcgctcggcaacatggagacgaaggagagcaaggccatccgccagcacgccgagtccgccgggtgcagcatggtggaggacatcgagtccccgagctccatctgggtgttcgccggcgcgcccgaccggtgcccgccgacctgcctgttcatcgccggcatcgccgagctgggggccttcttcagcatcctccaggacatgcgcaacaccatcatggccagcaagaccgtcggcacgtccgaggagaagctgcgcaagaagtccagcttctaccagagctacctgcggcgcacccagtccatggggatccagctcgaccagcggatcatcgtgctgttcatggtggcgtggggcaaggaggccgtcgacaacttccacctgggggacgacatggaccccgagctccgcaccctggcccagagcctgatcgacgtgaaggtgaaggagatctccaaccaggagcccctcaagctgtga

SEQ ID NO: 6408 - RNA, 1290 nt, synthetic construct
  misc_feature 1..1290: note = derived and/or modified CDS sequence (opt1) from HTNV(CGRn2616)__EU363811.1__N
  source 1..1290: mol_type = other RNA
atggccaccatggaggagctgcagcgcgagatcaacgcccacgagggccagctcgtgatcgcgcggcagaaggtccgcgacgccgggaagcagtacgagaaggaccccgacgagctgaacaagcggaccctgacggaccgcgagggcgtggccgccagcatccaggccaagatcgacgagctcaagcggcagctggcggaccgcatcgccaccgggaagaacctgggcaaggagcaggacccgaccggggtggagcccggcgaccacctcaaggagcggtccatgctgagctacggcaacgtcctggacctcaaccacctggacatcgacgagcccaccgggcagacggccgactggctgtccatcgtgatctacctcaccagcttcgtggtccccatcctgctgaaggccctctacatgctgaccacccgcggccggcagacgaccaaggacaacaaggggacccgcatccggttcaaggacgactccagcttcgaggacgtgaacggcatccgcaagccgaagcacctgtacgtgtccctccccaacgcgcagagctccatgaaggccgaggagatcacccccgggcggtaccgcacggccatctgcggcctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacaccgccgccgtgagcctgcacgggggccccgccaccaaccgggactacctgcgccagcggcaggtcgcgctcgggaacatggagaccaaggagtccaaggccatccgccagcacgccgagagcgccggctgctccatggtggaggacatcggcagcccgtccagcatctgggtgttcgccggggcgcccgaccggtgcccgcccacgtgcctgttcatcgccggcatcgccgagctgggggccttcttcagcatcctccaggacatgcgcaacaccatcatggcctccaagaccgtcggcaccagcgaggagaagctgcgcaagaagtccagcttctaccagtcctacctgcggcgcacgcagagcatggggatccagctcgaccagcggatcatcgtgctgttcatggtggcgtggggcaaggaggccgtcgacaacttccacctgggcgacgacatggaccccgagctccgcaccctggcccagtccctgatcgacgtggaggtgaaggagatcagcaaccaggagcccctcaagctgtga

SEQ ID NO: 6409 - RNA, 1290 nt, synthetic construct
  misc_feature 1..1290: note = derived and/or modified CDS sequence (opt1) from HTNV(CGRn53)__EF990907.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggaccccaccggcgtggagcccggggaccacctcaaggagcggtccatgctgagctacggcaacgtcctggacctcaaccacctggacatcgacgagcccaccggccagaccgccgactggctgtccatcgtgatctacctcacgagcttcgtggtccccatcctgctgaaggcgctctacatgctgaccacccgcgggcggcagaccacgaaggacaacaagggcacccgcatccggttcaaggacgactccagcttcgaggacgtgaacgggatccgcaagccgaagcacctgtacgtgtccctccccaacgcccagagctccatgaaggccgaggagatcacccccggccggtaccgcaccgccatctgcgggctgtaccccgcccagatcaaggcgcggcagatgatcagcccggtcatgtccgtgatcggcttcctggccctcgccaaggactggagcgaccgcatcgagcagtggctgtccgagccctgcaagctgctccccgacacggccgccgtgagcctgcacggcgggcccgcgaccaaccgggactacctgcgccagcggcaggtcgccctcggcaacatggagaccaaggagtccaaggccatccgccagcacgccgaggccgcggggtgcagcatgatcgaggacatcgagtccccgagctccatctgggtgttcgccggcgcccccgaccggtgcccgccgacctgcctgttcatcgccggcatcgccgagctgggggcgttcttcagcatcctccaggacatgcgcaacacgatcatggccagcaagaccgtgggcacctccgaggagaagctgcgcaagaagtccagcttctaccagagctacctgcggcgcacccagtccatggggatccagctcgaccagcggatcatcgtcctgttcatggtggcctggggcaaggaggccgtggacaacttccacctgggggacgacatggaccccgagctccgcacgctggcgcagagcctgatcgacgtcaaggtgaaggagatctccaaccaggagcccctcaagctgtga

SEQ ID NO: 6410 - RNA, 1290 nt, synthetic construct
  misc_feature 1..1290: note = derived and/or modified CDS sequence (opt1) from HTNV(CGRn5310)__EF990906.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagcccaacaagcgggccctgaccgaccgcgagggggtggccgccagcatccaggcgaagatcgacgagctgaagcggcagctcgccgaccgcatcgccacgggcaagaacctggggaaggagcaggaccccaccggcgtggagcccggggaccacctgaaggagcggtccatgctcagctacggcaacgtcctggacctgaaccacctcgacatcgacgagcccaccggccagaccgccgactggctgtccatcgtgatctacctgacgagcttcgtggtcccgatcctcctgaaggcgctgtacatgctcaccacccgcgggcggcagaccacgaaggacaacaagggcacccgcatccggttcaaggacgactccagcttcgaggacgtgaacgggatccgcaagcccaagcacctgtacgtgtccctgcccaacgcccagagctccatgaaggccgaggagatcacccccggccggtaccgcaccgccatctgcgggctctacccggcccagatcaaggcgcggcagatgatcagccccgtcatgtccgtgatcggcttcctggccctggccaaggactggagcgaccgcatcgagcagtggctctccgagccctgcaagctgctgcccgacacggccgccgtgagcctccacggcgggccggcgaccaaccgggactacctgcgccagcggcaggtcgccctgggcaacatggagaccaaggagtccaaggccatccgccagcacgccgaggccgcggggtgcagcatgatcgaggacatcgagtcccccagctccatctgggtgttcgccggcgcccccgaccggtgcccgccgacctgcctcttcatcgccggcatcgccgagctgggggcgttcttcagcatcctgcaggacatgcgcaacacgatcatggccagcaagaccgtgggcacctccgaggagaagctccgcaagaagtccagcttctaccagagctacctgcggcgcacccagtccatggggatccagctggaccagcggatcatcgtcctcttcatggtggcctggggcaaggaggccgtggacaacttccacctgggggacgacatggaccccgagctgcgcacgctcgcgcagagcctgatcgacgtcaaggtgaaggagatctccaaccaggagcccctgaagctctga

SEQ ID NO: 6411 - RNA, 1290 nt, synthetic construct
  misc_feature 1..1290: note = derived and/or modified CDS sequence (opt1) from HTNV(CGRn93MP8)__EF990905.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgcccccatccaggcgaagatcgacgagctcaagcggcagctggccgaccgcatcgccacgggcaagaacctggggaaggagcaggaccccaccggcgtggagcccggggaccacctcaaggagcggagcatgctgtcctacggcaacgtcctggacctcaaccacctggacatcgacgagcccaccggccagaccgccgactggctgagcatcgtgatctacctcacgtccttcgtggtcccgatcctgctgaaggcgctctacatgctgaccacccgcgggcggcagaccacgaaggacaacaagggcagccgcatccggttcaaggacgactccagcttcgaggacgtgaacgggatccgcaagcccaagcacctgtacgtgtccctccccaacgcccagagctccatgaaggccgaggagatcacccccggccggtaccgcaccgccatctgcgggctgtacccggcccagatcaaggcgcggcagatgatcagccccgtcatgtccgtgatcggcttcctggccctcgccaaggactggagcgaccgcatcgagcagtggctgtccgagccctgcaagctgctccccgacaccgccgccgtgagcctgcacggcgggccggcgacgaaccgggactacctgcgccagcggcaggtcgccctcggcaacatggagaccaaggagtccaaggccatccgccagcacgccgaggccgcggggtgcagcatgatcgaggacatcgagtcccccagctccatctgggtgttcgccggcgcccccgaccggtgcccgccgacctgcctgttcatcgccggcatcgccgagctgggggcgttcttcagcatcctccaggacatgcgcaacaccatcatggccagcaagacggtgggcacctccgaggagaagctgcgcaagaagtccagcttctaccagagctacctgcggcgcacccagtccatggggatccagctcgaccagcggatcatcgtcctgttcatggtggcctggggcaaggaggccgtggacaacttccacctgggggacgacatggaccccgagctccgcaccctggcgcagagcctgatcgacgtcaaggtgaaggagatctccaaccaggagcccctcaagctgtga

SEQ ID NO: 6412 - RNA, 1290 nt, synthetic construct
  misc_feature 1..1290: note = derived and/or modified CDS sequence (opt1) from HTNV(CGRn93P8)__EF990904.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggaccccaccggcgtggagcccggggaccacctcaaggagcggtccatgctgagctacggcaacgtcctggacctcaaccacctggacatcgacgagcccaccggccagaccgccgactggctgtccatcgtgatctacctcacgagcttcgtggtccccatcctgctgaaggcgctctacatgctgaccacccgcgggcggcagaccacgaaggacaacaagggcacccgcatccggttcaaggacgactccagcttcgaggacgtgaacgggatccgcaagccgaagcacctgtacgtgtccctccccaacgcccagagctccatgaaggccgaggagatcacccccggccggtaccgcaccgccatctgcgggctgtaccccgcccagatcaaggcgcggcagatgatcagcccggtcatgtccgtgatcggcttcctggccctcgccaaggactggagcgaccgcatcgagcagtggctgtccgagccctgcaagctgctccccgacacggccgccgtgagcctgcacggcgggcccgcgaccaaccgggactacctgcgccagcggcaggtcgccctcggcaacatggagaccaaggagtccaaggccatccgccagcacgccgaggccgcggggtgcagcatgatcgaggacatcgagtccccgagctccatctgggtgttcgccggcgcccccgaccggtgcccgccgacctgcctgttcatcgccggcatcgccgagctgggggcgttcatcagcatcctccaggacatgcgcaacacgatcatggccagcaagaccgtgggcacctccgaggagaagctgcgcaacaagagctccttctaccagagctacctgcggcgcacccagtccatggggatccagctcgaccagcggatcatcgtcctgttcatggtggcctggggcaaggaggccgtggacaacttccacctgggggacgacatggaccccgagctccgcacgctggcgcagagcctgatcgacgtcaaggtgaaggagatctccaaccaggagcccctcaagctgtga

SEQ ID NO: 6413 - RNA, 1290 nt, synthetic construct
  misc_feature 1..1290: note = derived and/or modified CDS sequence (opt1) from HTNV(CGRni1)__EU363812.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggcgggagcaggacccgaccggcgtggagcccggggaccacctcaaggagcgctccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgggggcgccagacgaccaaggacaacaagggcacccggatccgcttcaaggacgactccagcttcgaggacatcaacgggatccggaagccgaagcacctgtacgtgtccctccccaacgcgcagagctccatgaaggccgaggagatcacccccggccgctaccggacggccatctgcgggctgtaccccgcccagatcaaggcccgccagatgatcagcccggtgatgtccgtcatcggcttcctggcgctcgccaaggactggagcgaccggatcgagcagtggctgtccgagccctgcaagctgctccccgacaccgccgccgtgagcctgcacggcgggcccgccaccaaccgcgactacctgcggcagcgccaggtggcgctcggcaacatggagaccaaggagtccaaggccatccggcagcacgccgagagcgccgggtgctccatggtcgaggacatcgagagcccgtccagcatctgggtgttcgccggcgcgcccgaccgctgcccgcccacgtgcctgttcatcgccggcatcgccgagctgggggccttcttcagcatcctccaggacatgcgcaacaccatcatggcctccaagaccgtgggcaccagcgaggagaagctgcggaagaagtccagcttctaccagtcctacctgcgccggacgcagagcatggggatccagctcgaccagcgcatcatcgtcctgctgatggtggcgtggggcaaggaggccgtggacaacttccacctcggggacgacatggaccccgagctgcggaccctggcccagtccctcatcgacgtcaaggtgaaggagatcagcaaccaggagcccctgaagctgtga

SEQ ID NO: 6414 - RNA, 1290 nt, synthetic construct
  misc_feature 1..1290: note = derived and/or modified CDS sequence (opt1) from HTNV(CJAp93)__EF208929.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgtgagcatccaggccaagatcgacgagctcaagcggcagctggccgaccgcatcgcgaccggcaagaacctggggaaggagcaggacccgaccggcgtcgagcccggggaccacctcaaggagcggtccatgctgagctacggcaacgtgctggacctcaaccacctggacatcgacgagcccaccggccagacggccgactggctgtccatcgtggtctacctcaccagcttcgtggtgcccatcctgctgaaggccctctacatgctgaccacccgcgggcggcagacgaccaaggacaacaagggcacccgcatccggttcaaggacgactccagcttcgaggacgtcaacgggatccgcaagccgaagcacctgtacgtgtccctccccaacgcccagagctccatgaaggcggaggagatcacccccggccggtaccgcacggccatctgcgggctgtaccccgcccagatcaaggcccggcagatgatcagcccggtgatgtccgtcatcggcttcctggccctcgcgaaggactggagcgaccgcatcgagcagtggctgtccgagccctgcaagctgctccccgacaccgccgccgtgggcctgctcgggggccccgccaccaaccgggactacctgcgccagcgccaggtggccctggggaacatggagaccaaggagagcaaggcgatccggcagcacgccgaggccgccggctgctccatgatcgaggacatcgagagcccgtccagcatctgggtcttcgccggcgcgcccgaccggtgcccgcccacgtgcctgttcatcgccgggatcgccgagctcggcgccttcttctccatcctgcaggacatgcgcaacaccatcatggccagcaagaccgtggggaccagcgaggagaagctgcgcaagaagtccagcttctaccagtcctacctccggcgcacgcagagcatgggcatccagctggaccagcggatcatcgtgctgttcatggtcgcgtgggggaaggaggccgtgaacaacttccacctcggcgacgacatggaccccgagctgcgcaccctggcccagtccctcatcgacgtgaaggtcaaggagatcagcaaccaggagcccctgaagctgtga

SEQ ID NO: 6415 - RNA, 1290 nt, synthetic construct
  misc_feature 1..1290: note = derived and/or modified CDS sequence (opt1) from HTNV(Aa14_207)__KX687234.1__N
  source 1..1290: mol_type = other RNA
atggccaccatggaggagctgcagcgcgagatcaacgcccacgagggccagctcgtgatcgcgcggcagaaggtccgcgacgccgagaagcagtacgggaaggaccccgacgagctgaacaagcgggccctgaccgaccgcgagggcgtggccgtgagcatccaggccaagatcgacgagctcaagcggcagctggcggaccgcatcgccacggggaagaacctgggcaaggagcaggaccccaccggggtcgagcccggcgaccacctcaaggagcggtccatgctgagctacggcaacgtgctggacctcaaccacctggacatcgacgagcccaccgggcagaccgccgactggctgtccatcgtggtctacctcacgagcttcgtggtgcccatcctgctgaaggccctctacatgctgaccacccgcggccggcagaccacgaaggacaacaaggggacccgcatccggttcaaggacgactccagcttcgaggacgtcaacggcatccgcaagccgaagcacctgtacgtgtccctccccaacgcgcagagctccatgaaggccgaggagatcacccccgggcggtaccgcaccgccgtgtgcggcctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacacggccgccgtgagcctgctcgggggccccgccaccaaccgggactacctgcgccagcggcaggtcgcgctggggaacatggagaccaaggagtccaaggccatccgccagcacgccgaggccgccggctgcagcatgatcgaggacatcgagtccccgagctccatctgggtgttcgcgggcgcccccgaccggtgcccgccgacctgcctgttcgtggccgggatcgccgagctcggcgccttcttcagcatcctgcaggacatgcgcaacacgatcatggcgagcaagaccgtcgggacctccgaggagaagctgcgcaagaagtccagcttctaccagagctacctccggcgcacccagtccatgggcatccagctggaccagcggatcatcgtgctgttcatggtggcctgggggaaggaggccgtcgacaacttccacctcggcgacgacatggaccccgagctgcgcacgctggcccagagcctcatcgacgtgaaggtgaaggagatctccaaccaggagcccctgaagctgtga

SEQ ID NO: 6416 - RNA, 1290 nt, synthetic construct
  misc_feature 1..1290: note = derived and/or modified CDS sequence (opt1) from HTNV(Aa14_234)__KX687235.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgtgagcatccaggccaagatcgacgagctcaagcggcagctggcggaccgcatcgccacgggcaagaacctggggaaggagcaggaccccaccggcgtcgagcccggggaccacctcaaggagcggtccatgctgagctacggcaacgtgctggacctcaaccacctggacatcgacgagcccaccggccagaccgccgactggctgtccatcgtggtctacctcacgagcttcgtggtgcccatcctgctgaaggccctctacatgctgaccacccgcgggcggcagaccacgaaggacaacaagggcacccgcatccggttcaaggacgactccagcttcgaggacgtcaacgggatccgcaagccgaagcacctgtacgtgtccctccccaacgcgcagagctccatgaaggccgaggagatcacccccggccggtaccgcaccgccgtgtgcgggctgtaccccgcccagatcaaggcccggcagatgatcagcccggtcatgtccgtgatcggcttcctggcgctcgccaaggactggagcgaccgcatcgagcagtggctgggcgagccctgcaagctgctccccgacacggccgccgtgtccctgctcgggggccccgccaccaaccgggactacctgcgccagcggcaggtcgcgctggggaacatggagaccaaggagagcaaggccatccgccagcacgccgaggccgccggctgctccatgatcgaggacatcgagagcccgtccagcatctgggtgttcgcgggcgcccccgaccggtgcccgccgacctgcctgttcatcgccgggatcgccgagctcggcgccttcttctccatcctgcaggacatgcgcaacacgatcatggcgagcaagaccgtggggaccagcgaggagaagctgcgcaagaagtccagcttctaccagtcctacctccggcgcacccagagcatgggcatccagctggaccagcggatcatcgtcctgttcatggtggcctgggggaaggaggccgtggacaacttccacctcggcgacgacatggaccccgagctgcgcacgctggcccagtccctcatcgacgtcaaggtgaaggagatcagcaaccaggagcccctgaagctgtga

SEQ ID NO: 6417 - RNA, 1290 nt, synthetic construct
  misc_feature 1..1290: note = derived and/or modified CDS sequence (opt1) from HTNV(Aa14_239)__KX687236.1__N
  source 1..1290: mol_type = other RNA
atggccaccatggaggagctgcagcgcgagatcaacgcccacgagggccagctcgtgatcgcgcggcagaaggtccgcgacgccgagaagcaggacgggaaggaccccgacgagctgaacaagcgggccctgaccgaccgcgagggcgtggccgtgagcatccaggccaagatcgacgagctcaagcggcagctggcggaccgcatcgccacggggaagaacctgggcaaggagcaggaccccaccggggtcgagcccggcgaccacctcaaggagcggtccatgctgagctacggcaacgtgctggacctcaaccacctggacatcgacgagcccaccgggcagaccgccgactggctgtccatcgtggtctacctcacgagcttcgtggtgcccatcctgctgaaggccctctacatgctgaccacccgcggccggcagaccacgaaggacaacaaggggacccgcatccggttcaaggacgactccagcttcgaggacgtcaacggcatccgcaagccgaagcacctgtacgtgtccctccccaacgcgcagagctccatgaaggccgaggagatcacccccgggcggtaccgcaccgccgtgtgcggcctgtaccccgcccagatcaaggcccggcagatgatcagcccggtcatgtccgtgatcggcttcctggcgctcgccaaggactggagcgaccgcatcgagcagtggctgggggagccctgcaagctgctccccgacacggccgccgtgtccctgctgggcgggcccgccaccaaccgggactacctccgccagcggcaggtcgcgctgggcaacatggagaccaaggagagcaaggccatccgccagcacgccgaggccgccggctgctccatgatcgaggacatcgagagcccgtccagcatctgggtgttcgcgggggcccccgaccggtgcccgccgacctgcctgttcatcgccggcatcgccgagctcggggccttcttctccatcctgcaggacatgcgcaacacgatcatggcgagcaagaccgtgggcaccagcgaggagaagctgcgcaagaagtccagcttctaccagtcctacctccggcgcacccagagcatggggatccagctggaccagcggatcatcgtcctgttcatggtggcctggggcaaggaggccgtggacaacttccacctcggcgacgacatggaccccgagctgcgcacgctggcccagtccctcatcgacgtcaaggtgaaggagatcagcaaccaggagcccctgaagctgtga

SEQ ID NO: 6418 - RNA, 1290 nt, synthetic construct
  misc_feature 1..1290: note = derived and/or modified CDS sequence (opt1) from HTNV(AY133/2011)__KY807166.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacatcgggaaggagcaggacccgaccggcgtggagcccggggaccacctgaaggagcggtccatgctcagctacggcaacgtcctggacctgaaccacctcgacatcgacgagcccaccggccagaccgccgactggctgtccatcgtgatctacctgacgagcttcgtggtccccatcctcctgaaggcgctgtacatgctcaccacccgcgggcggcagaccacgaaggacaacaagggcacccgcatccggttcaaggacgactccagcttcgaggacgtgtccgggatccgcaagccgaagcacctgtacctgagcctccccaacgcccagtccagcatgaaggccgaggagatcacccccggccggtaccgcaccgccatctgcgggctgtaccccgcccagatcaaggcgcggcagatgatctccccggtgatgagcgtcatcggcttcctggccctcgccaaggactggtccgaccgcatcgagcagtggctgagcgagccctgcaagctgctccccgacacggccgccgtgtccctgcacggcgggcccgcgaccaaccgggactacctgcgccagcgccaggtggccctcggcaacatggagaccaaggagagcaaggccatccggcagcacgccgagaccgccgggtgctccatgatcgacgacatcgagagcccgtccagcatctgggtcttcgcgggcgcccccgaccggtgcccgcccacgtgcctgttcatcgccggcatcgccgagctgggggccttcttcagcatcctccaggacatgcgcaacaccatcatggcgtccaagaccgtgggcaccagcgaggagaagctgcgcaagaagtccagcttctaccagtcctacctgcggcgcacgcagagcatggggatccagctcgaccagcggatcatcgtgctgttcatggtcgcctggggcaaggaggccgtggacaacttccacctgggggacgacatggaccccgagctccgcaccctggcccagtccctgatcgacgtgaaggtcaaggagatcagcaaccaggagcccctcaagctgtga

SEQ ID NO: 6419 - RNA, 1290 nt, synthetic construct
  misc_feature 1..1290: note = derived and/or modified CDS sequence (opt1) from HTNV(GAN13/2011)__KY807168.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggacccgaccggcgtggagcccggggaccacctcaaggagcggtccatgctgagctacggcaacgtcctggacctcaaccacctggacatcgacgagcccaccggccagaccgccgactggctgtccatcgtgatctacctcacgagcttcgtggtccccatcctgctgaaggcgctctacatgctgaccacccgcgggcggcagaccacgaaggacaacaagggcacccgcatccggttcaaggacgactccagcttcgaggacgtgaacgggatccgcaagccgaagcacctgtacctctccctgcccaacgcccagagctccatgaaggccgaggagatcacccccggccggtaccgcaccgccatctgcgggctgtaccccgcccagatcaaggcgcggcagatgatcagcccggtgatgtccgtcatcggcttcctcgccctggccaaggactggagcgaccgcatcgagcagtggctgtccgagccctgcaagctcctgcccgacacggccgccgtgagcctgcacggcgggcccgcgaccaaccgggactacctccgccagcgccaggtggccctgggcaacatggagaccaaggagtccaaggccatccggcagcacgccgagaccgccgggtgcagcatgatcgacgacatcgagtccccgagctccatctgggtcttcgcgggcgcccccgaccggtgcccgcccacgtgcctgttcatcgccggcatcgccgagctcggggccttcttcagcatcctgcaggacatgcgcaacaccatcatggcgagcaagaccgtgggcacctccgaggagaagctgcgcaagaagtccagcttctaccagagctacctccggcgcacgcagtccatggggatccagctggaccagcggatcatcgtgctgttcatggtcgcctggggcaaggaggccgtggacaacttccacctcggggacgacatggaccccgagctgcgcaccctggcccagagcctcatcgacgtgaaggtcaaggagatctccaaccaggagcccctgaagctgtga

SEQ ID NO: 6420 - RNA, 1290 nt, synthetic construct
  misc_feature 1..1290: note = derived and/or modified CDS sequence (opt1) from HTNV(GAN19/2011)__KY807172.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccgaccgcgagggggtggccgccagcatccaggcgaagatcgacgagctcaagcggcagctggccgaccgcatcgccacgggcaagaacctggggaaggagcaggaccccaccggcgtggagcccggggaccacctcaaggagcggtccatgctgagctacggcaacgtcctggacctcaaccacctggacatcgacgagcccaccggccagaccgccgactggctgtccatcgtgatctacctcacgagcttcgtggtccccatcctgctgaaggcgctctacatgctgaccacccgcgggcggcagaccacgaaggacaacaagggcacccgcatccggttcaaggacgactccagcttcgaggacgtgaacgggatccgcaagccgaagcacctgtacctctccctgcccaacgcccagagctccatgaaggccgaggagatcacccccggccggtaccgcaccgccatctgcgggctgtaccccgcccagatcaaggcgcggcagatgacgagcccggtgatgtccgtcatcggcttcctcgccctggccaaggactggagcgaccgcatcgagcagtggctgtccgagccctgcaagctcctgcccgacaccgccgccgtgagcctgcacggcgggcccgcgacctcccgggactacctccgccagcgccaggtggccctgggcaacatggagaccaaggagagcaaggccatccggcagcacgccgagacggccgggtgctccatgatcgacgacatcgagagcccgtccagcatctgggtcttcgcgggcgcccccgaccggtgcccgccgacctgcctgttcatcgccggcatcgccgagctcggggccttcttcagcatcctgcaggacatgcgcaacaccatcatggcgtccaagaccgtgggcacgagcgaggagaagctgcgcaagaagtccagcctctaccagtcctacctgcggcgcacccagagcatggggatccagctggaccagcggatcatcgtcctcttcatggtggcctggggcaaggaggccgtggacaacttccacctgggggacgacatggaccccgagctgcgcaccctcgcccagtccctgatcgacgtgaaggtcaaggagatcagcaaccaggagcccctgaagctctga

SEQ ID NO: 6421 - RNA, 1290 nt, synthetic construct
  misc_feature 1..1290: note = derived and/or modified CDS sequence (opt1) from HTNV(LR1)__AF288294.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccaaccgcgagggggtggccgtgagcatccaggccaagatcgacgagctcaagatgcagctggcggaccggatcgccacgggcaagaacctggggaaggagcaggaccccaccggcgtcgagcccggggaccacctcaaggagcgctccatgctgagctacggcaacgtgctggacctcaaccacctggacatcgacgagcccaccggccagaccgccgactggctgtccatcatcgtgtacctcacgagcttcgtcgtgcccatcctgctgaaggccctctacatgctgaccacccgggggcgccagaccacgaaggacaacaagggcacccggatccgcttcaaggacgactccagcttcgaggacgtgaacgggatccggaagccgaagcacctgtacgtctccctccccgacgcgcagagctccatgaaggccgaggagatcacccccggccgctaccggaccgccgtgtgcgggctgtaccccgcccagatcaaggcccgccagatgatcagcccggtgatgtccgtcatcggcttcctggcgctcgccaaggactggagcgaccggatcgagcagtggctgatcgagccctgcaagctgctccccgacacggccgccgtgtccctgctgggcgggcccgccaccaaccgcgactacctccggcagcgccaggtggcgctgggcaacatggagaccaaggagagcaaggccatccggcagcacgccgaggccgccgggtgctccatgatcgaggacatcgagagcccgtccagcatctgggtcttcgcgggcgcccccgaccgctgcccgccgacctgcctgttcatcgccggcatcgccgagctcggggccttcttctccatcctgcaggacatgcggaacacgatcatggcgagcaagaccgtgggcaccagcgaggagaagctgcgcaagaagtccagcttctaccagtcctacctccgccggacccagagcatggggatccagctggaccagcgcatcatcgtgctgttcatggtcgcctggggcaaggaggccgtggacaacttccacctcggggacgacatggaccccgagctgcggacgctggcccagtccctcatcgacgtgaaggtcaaggagatcagcaaccaggagcccctgaagctgtga

SEQ ID NO: 6422 - RNA, 1290 nt, synthetic construct
  misc_feature 1..1290: note = derived and/or modified CDS sequence (opt1) from HTNV(RG9)__AF288296.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggacccgaccggcgtggagcccggggaccacctcaaggagcggtccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgcgggcggcagacgaccaaggacaacaagggcacccgcatccggttcaaggacgactccagcttcgaggacgtgaacgggatccgcaagccgaagcacctgtacgtgtccctccccaacgcgcagagctccatgaaggccgaggagatcacccccggccggtaccgcacggccatctgcgggctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacaccgccgccgtgagcctgcacggcgggcccgccaccaaccgggactacctgcgccagcggcaggtcgcgctcggcaacatggagaccaaggagtccaaggccatccgccagcacgccgagagcgccgggtgctccatgatcgaggacatcgagagcccgtccagcatctgggtgttcgccggcgcgcccgaccggtgcccgcccacgtgcctgttcatcgccggcatcgccgagctgggggccttcttcagcatcctccaggacatgcgcaacaccatcaccgcctccaagaccgtgggcacgagcgaggagaagctgcgcaagaagtccagcttctaccagtcctacctgcggcgcacccagagcatggggatccagctcgaccagcggatcatcgtcctgttcatggtggcgtggggcaaggaggccgtggacaacttccacctgggggacgacatggaccccgagctccgcaccctggcccagtccctgatcgacgtcaaggtgaaggagatcagcaaccaggagcccctcaagctgtga

SEQ ID NO: 6423 - RNA, 1290 nt, synthetic construct
  misc_feature 1..1290: note = derived and/or modified CDS sequence (opt1) from HTNV(S85-46)__AF288659.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagagcgccctgaccaaccgggagggggtggccgtgtccatccaggccaagatcgacgagctcaagatgcagctggcggaccgcatcgccacgggcaagaacctggggaaggagcaggaccccaccggcgtcgagcccggggaccacctcaaggagcggagcatgctgtcctacggcaacgtgctggacctcaaccacctggacatcgacgagcccaccggccagaccgccgactggctgagcatcatcgtgtacctcacgtccttcgtcgtgcccatcctgctgaaggccctctacatgctgaccacccgcgggcggcagaccacgaaggacaacaagggcacccgcatccggttcaaggacgacagctccttcgaggacgtgaacgggatccgcaagccgaagcacctgtacgtcagcctccccaacgcgcagtccagcatgaaggccgaggagatcacccccggccggtaccgcaccgccgtgtgcgggctgtaccccgcccagatcaaggcccggcagatgatctccccggtgatgagcgtcatcggcttcctggcgctcgccaaggactggtccgaccgcatcgagcagtggctgatcgagccctgcaagctgctccccgacacggccgccgtgagcctgctgggcgggcccgccaccaaccgggactacctccgccagcgccaggtggcgctgggcaacatggagaccaaggagtccaaggccatccggcagcacgccgaggccgccgggtgcagcatgatcgaggacatcgagtccccgagctccatctgggtcttcgcgggcgcccccggccggtgcccgccgacctgcctgttcatcgccgggatcgccgagctcggcgccttcttcagcatcctgcaggacatgcgcaacacgatcatggcgagcaagaccgtggggacctccgaggagaagctgcggaagaagtccagcttctaccagagctacctccgccgcacccagtccatgggcatccagctggaccagcggatcatcgtgctgttcatggtcgcctgggggaaggaggccgtggacaacttccacctcggcgacgacatggaccccgagctgcgcacgctggcccagagcctcatcgacgtgaaggtcaaggagatctccaaccaggagcccctgaagctgtga

SEQ ID NO: 6424 - RNA, 1290 nt, synthetic construct
  misc_feature 1..1290: note = derived and/or modified CDS sequence (opt1) from HTNV(SN7)__AF288657.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggaccccaccggcgtggagcccggggaccacctcaaggagcggtccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgcgggcggcagacgaccaaggacaacaagggcacccgcatccggttcaaggacgactccagcttcgaggacgtgaacgggatccgcaagccgaagcacctgtacgtgtccctccccaacgcgcagagctccatgaagaccgaggagatcacgcccggccggtaccgcaccgccatctgcgggctgtaccccgcccagatcaaggcccggcagatgatcagcccggtcatgtccgtgatcggcttcctggccctcgcgaaggactggagcgaccgcatcgagcagtggctgtccgagccctgcaagctgctccccgacaccgccgccgtgagcctgcacggcgggcccgccaccaaccgggactacctgcgccagcggcaggtcgccctcggcaacatggagacgaaggagtccaaggcgatccgccagcacgccgagagcgccgggtgctccatgatcgaggacatcgagagcccgtccagcatctgggtgttcgccggcgcccccgaccggtgcccgccgacctgcctgttcatcgcgggcatcgccgagctgggggccttcttcagcatcctccaggacatgcgcaacaccatcatggcctccaagaccgtgggcacgagcgaggagaagctgcgcaagaagtccagcttctaccagtcctacctgcggcgcacccagagcatggggatccagctcgaccagcggatcatcgtcctgttcatggtggcctggggcaaggaggcggtggacaacttccacctgggggacgacatggaccccgagctccgcaccctggcccagtccctgatcgacgtcaaggtgaaggagatcagcaaccaggagcccctcaagctgtga

SEQ ID NO: 6425 - RNA, 1290 nt, synthetic construct
  misc_feature 1..1290: note = derived and/or modified CDS sequence (opt1) from HTNV(84FLi)__AF366568.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgccagcatccaggccaagatcgacgagctcaagcggcagctggcggaccgcatcgccaccggcaagaacctggggaaggagcaggacccgaccggcgtggagcccggggaccacctcaaggagcggtccatgctgagctacggcaacgtcctggacctcaaccacctggacatcgacgagcccaccggccagacggccgactggctgtccatcgtgatctacctcaccagcttcgtggtccccatcctgctgaaggccctctacatgctgaccacccgcgggcggcagacgaccaaggacaacaagggcacccgcatccggttcaaggacgactccagcttcgaggacgtgaacgggatccgcaagccgaagcacctgtacgtgtccctccccaacgcgcagagctccatgaaggccgaggagatcacccccggccggtaccgcacggccatctgcgggctgtaccccgcccagatcaaggcccggcagatgatcagcccggtcatgtccgtgatcggcttcctggcgctcgccaaggactggagcgaccgcatcgagcagtggctgtccgagccctgcaagctgctccccgacaccgccgccgtgagcctgcacggcgggcccgccaccaaccgggactacctgcgccagcggcaggtcgcgctcggcaacatggagaccaaggagtccaaggccatccgccagcacgccgagagcgccgggtgctccatgatcgaggacatcgagagcccgtccagcatctgggtgttcgccggcgcgcccaaccggtgcccgcccacgtgcctgttcatcgccggcatcgccgagctgggggccttcttcagcatcctccaggacatgcgcaacaccatcatggcctccaagaccgtgggcaccagcgaggagaagctgcgcaagaagtccagcttctaccagtcctacctgcggcgcacgcagagcatggggatccagctcgaccagcggatcatcgtcctgttcatggtggcgtggggcaaggaggccgtggacaacttccacctgggggacgacatggaccccgagctccgcaccctggcccagtccctgatcgacgtcaaggtgaaggagatcagcaaccaggagcccctcaagctgtga

SEQ ID NO: 6426 - RNA, 1290 nt, synthetic construct
  misc_feature 1..1290: note = derived and/or modified CDS sequence (opt1) from HTNV(KHF,clone:4)__LC209206.1__N
  source 1..1290: mol_type = other RNA
atggccaccatggaggagctgcagcgcgagatcaacgcccacgagggccagctcgtgatcgcgcggcagaaggtccgcgacgccgagaagcagtacgagaaggaccccgacgagctgaacaagcggaccctgacggaccgcgagggggtggccgtgagcatccaggccaagatcgacgagctcaagcggcagctggccgaccgcatcgcgaccggcaagaacctggggaaggagcaggacccgaccggcgtcgagcccggggaccacctcaaggagcggtccatgctgagctacggcaacgtgctggacctcaaccacctggacatcgacgagcccaccggccagacggccgactggctgtccatcgtggtctacctcaccagcttcgtggtgcccatcctgctgaaggccctctacatgctgaccacccgcgggcggcagacgaccaaggacaacaagggcacccgcatccggttcaaggacgactccagcttcgaggacgtcaacgggatccgcaagccgaagcacctgtacgtgtccctccccaacgcccagagctccatgaaggcggaggagatcacccccggccggtaccgcacggccgtgtgcgggctgtaccccgcccagatcaaggcccggcagatgatcagcccggtcatgtccgtgatcggcttcctggccctcgcgaaggactggagcgaccgcatcgagcagtggctgtccgagccctgcaagctgctccccgacaccgccgccgtgagcctgctgggcgggcccgccaccaaccgggactacctccgccagcggcaggtcgccctgggcaacatggagaccaaggagtccaaggcgatccgccagcacgccgaggccgccgggtgcagcatgatcgaggacatcgagtccccgagctccatctgggtgttcgccggcgcgcccgaccggtgcccgcccacgtgcctgttcatcgccggcatcgccgagctcggggccttcttcagcatcctgcaggacatgcgcaacaccatcatggccagcaagaccgtgggcacctccgaggagaagctgcgcaagaagtccagcttctaccagagctacctccggcgcacgcagtccatggggatccagctggaccagcggatcatcgtcctgttcatggtggcgtggggcaaggaggccgtggacaacttccacctcggggacgacatggaccccgagctgcgcaccctggcccagagcctcatcgacgtcaaggtgaaggagatctccaaccaggagcccctgaagctgtga

SEQ ID NO: 6427 - RNA, 1287 nt, synthetic construct
  misc_feature 1..1287: note = derived and/or modified CDS sequence (opt1) from LANV(510B)__AF005727.1__N
  source 1..1287: mol_type = other RNA
atgagcaacctgcaggaggtgcaggagggcatcaccctccacgagcagcagctggtcgccgcccgccagaagctgaaggacgcggagaaggccgtggaggtggaccccgacgacgtcaacaagtccaccctccagagccggcgcgccgccgtgtccgccctggagaacaagctggcggagctcaagcggcagctggccgacctggtggccgcccagaagctcgcggccaagccggtcgaccccacggggctggagcccgacgaccacctgaaggagaagtccgccctccgctacggcaacgtgctggacgtgaacgccatcgacctggaggagcccagcgggcagaccgccgactggaaggcgatcggcgcctacatcctcgggttcgtcatcccgatcatcctgaaggccctgtacatgctcagcacccggggccgccagaccgtgaaggagaacaagggcacgcggatccgcttcaaggacgactccagcttcgaggaggtgaacgggatccggaagcccaagcacctgtacgtctccatgcccaccgcccagagcaccatgaaggccgacgagatcacccccggccgcttccggacgatcgcgtgcgggctgttcccggcccagatcaaggcccgcaacatcatctcccccgtgatgggcgtgatcgggttcggccacttcgtcaaggactggatggagcggatcgacaacttcctcggcgaggactgccccttcctgcccaaggcccgcgtgcagagcgaggccttcatgtccaccaaccgggcgtacttcctgaaccgccagcgccaggtggacgagagccggatccaggacatcgtcgacctcatccaggccgccgaggcctccagcgccaccctgttcaacgacatcgcgaccccgcactccgcctgggtgttcgcctgcgcccccgaccggtgcccgcccacggcgctgtacgtggccggggtccccgagctcggcgccttcttcgccatcctgcaggacatgcgcaacaccatcatggccagcaagtccgtggggaccgcggaggagaagctgaagaagaagtccgccttctaccagagctacctccggcgcacccagagcatgggcatccagctggaccagaagatcatcatcctgtacatgctcagctggggcaaggaggccgtgaaccacttccacctgggggacgacatggaccccgagctgcgccagctcgcccagacgctgatcgacgccaaggtcaaggagatctccaaccaggagcccctgaagctctga

SEQ ID NO: 6428 - RNA, 1287 nt, synthetic construct
  misc_feature 1..1287: note = derived and/or modified CDS sequence (opt1) from LANV(12234)__ALD61435.1__N
  source 1..1287: mol_type = other RNA
atgagcaccctgcaggaggtgcaggagggcatcaccctccacgagcagcagctggtcgccgcccgccagaagctgaaggacgcggagaaggccgtggaggtggaccccgacgacgtcaacaagtccacgctccagagccggcgcgccgccgtgtccgccctggagaacaagctggcggagctcaagcggcagctggccgacctggtggccgcccagaagctcgcggccaagccggtcgaccccaccgggctggagcccgacgaccacctgaaggagaagtccgccctccgctacggcaacgtgctggacgtgaacgccatcgacctggaggagcccagcgggcagaccgccgactggaaggcgatcggcgcctacatcctcgggttcgtcatcccgatcatcctgaaggccctgtacatgctcagcacccggggccgccagacggtgaaggagaacaagggcacccggatccgcttcaaggacgactccagcttcgaggaggtgaacgggatccggaagcccaagcagctgtacgtctccatgcccaccgcccagagcaccatgaaggccgacgagatcacgcccggccgcttccggaccatcgcgtgcgggctgttcccggcccagatcaaggcccgcaacatcatctcccccgtgatgggcgtgatcgggttcagccacttcgtcaaggactggatggagcggatcgacgacttcctcgccgccgactgccccttcctgcccaagccgcgcgtgcagtccgaggcgttcatggccaccaaccgggcctacttcatcaaccgccagcggcagatcgacgagagccgcatgcccgacatcatggacctgatccaggccgccgaggcgggctccgccaccctcttcaacgacatcgccacgccccacagcgcctgggtgttcgcgtgcgcccccgaccggtgcccgcccaccgccctgtacgtcgccggcgtgcccgagctgggggccttcttcgcgatcctccaggacatgcgcaacaccatcatggcctccaagagcgtgggcaccgccgaggagaagctgaagaagaagtccgccttctaccagagctacctgcggcgcacgcagagcatggggatccagctcgaccagaagatcatcatcctgtacatgctgtcctggggcaaggaggccgtcaaccacttccacctcggcgacgacatggaccccgagctgcgccagctggcgcagaccctcatcgacaccaaggtgaaggagatcagcaaccaggagccgctgaagctgtga

SEQ ID NO: 6429 - RNA, 1272 nt, synthetic construct
  misc_feature 1..1272: note = derived and/or modified CDS sequence (opt1) from LQUV(Longquan-Rs-32)__JX465422.1__N
  source 1..1272: mol_type = other RNA
atggccaccggccgcgacctgcaggacgagctcgagcagatcgagcaggagatcacccaggccaaggcgaagtacgagaagcagaaggccgccatcggggaggagcccgacacgatcgagctgaaggtgctgcagcagcgggaggagaccatccacatgctcgaggagaagcgcaaggagctgctgcagcggatcgcccagcagatgaagtccccgcgccagcccgtcaagggccgggacctcgacgaggacgagcacctgagcgagcgcagcaccctgcggtacgggaacgtgatcgacctcgaggagctggacatcgacgagcccgccggcgggtccgcggactggctggccatcggcatctacatcttcagcttccccgtgcagctcctgctgaagaccctctacatcctgacgacccgcggccggcagaccatcaaggagaacaaggggaaccgcctgcggttcaaggactccagctccaccatggacgtcaacggcgtgaagacgccccgccacctctacatcagcctgcccaccgcccagtccagcatgaagaccgaggagatcacccccgggcggtaccgcacggtggcctgcggcatcctgtccggggagatgcgggcgcgcaagctcgtcagccccgtgatgggcgtgatcggcttcaactacctggccgagaagtggggcgagtacatcgacgccttcctgatgaagcagtccccgcacctccccgtcagcaccgggtcccccgagagcgccaccaacttcgcctacctgatccagcggcaggacgtgctgaacaagtccaagaccgtggagtacctcgagctgtgggagcaggcggagaaggccgggcgccacctggtcgaccggatcgagagccccctcacgccgtggctgttcgccggctcccccgaccgctgcccgcccaccagcctgtacgtggccggcatcgccgagctcggggcgttcttcagcatcctgcaggacatccggaacgccatcatggcctccaagctggtgggcaccgccgaggagaagctcaagcgcaagagctccttctaccagagctacctgcgccggacccagtccatgggggtccagctggaccagcgcatcatcatcctctacatgatggagtggggcaagatgatggtggaccacttccacctgggggacgacatggacagcgagctgcggaaggcctgccagtccctcatcgacgagaaggtggcgcaggtcagcaaccaggaggccctgaagctgtga

SEQ ID NO: 6430 - RNA, 1272 nt, synthetic construct
  misc_feature 1..1272: note = derived and/or modified CDS sequence (opt1) from LQUV(Longquan-Ra-14)__JX465414.1__N
  source 1..1272: mol_type = other RNA
atggccaccggccgcgacctgcaggacgagctcgagcagatcgagcaggagatcacccaggccaaggcgaagtacgagaagcagaaggccgccatcggggaggagcacgacacgatcgagctgaaggtgctgcagcagcgggaggagaccatccacatgctcgaggagaagcgcaaggagctgctgcagcggatcgcccagcagatgaagtccccgcgccagcccgtcaagggccgggacctcgacgaggacgagcacctgtccgagcgcagcaccctgcggtacgggaacgtgatcgacctcgaggagctggacatcgacgagcccgccggcgggtccgcggactggctggccatcggcatctacatcttcagcttccccgtgcagctcctgctgaagaccctctacatcctgacgacccgcggccggcagaccatcaaggagaacaaggggaaccgcctgcggttcaaggactccagctccaccatggacgtcaacggcgtgaagacgccccgccacctctacatcagcctgcccaccgcccagtccagcatgaagaccgaggagatcacccccgggcggtaccgcacggtggcctgcggcatcctgtccggggagatgcgggcgcgcaagctcgtcagccccgtgatgggcgtgatcggcttcaactacctggccgagaagtggggcgagtacatcgacgccttcctgatgaagcagagcccccacctcccggtcagcaccgggtcccccgagagcgccaccaacttcgcctacctgatccagcggcaggacgtgctgaacaagtccaagaccgtggagtacctcgagctgtgggagcaggcggagaaggccgggcgccacctggtcgaccggatcgagagccccctcacgccctggctgttcgccggctccccggaccgctgcccgcccaccagcctgtacgtggccggcatcgccgagctcggggcgttcttcagcatcctgcaggacatccggaacgccatcatggcctccaagctggtgggcaccgccgaggagaagctcaagcgcaagagctccttctaccagagctacctgcgccggacccagtccatgggggtccagctggaccagcgcatcatcatcctctacatgatggagtggggcaagatgatggtggaccacttccacctgggggacgacatggacagcgagctgcggaaggcctgccagtccctcatcgacgagaaggtggcgcaggtcagcaaccaggaggccctgaagctgtga

SEQ ID NO: 6431 - RNA, 1272 nt, synthetic construct
  misc_feature 1..1272: note = derived and/or modified CDS sequence (opt1) from LQUV(Longquan-Ra-25)__JX465415.1__N
  source 1..1272: mol_type = other RNA
atggccaccggccgcgacctgcaggacgagctcgagcagatcgagcaggagatcacccaggccaaggcgaagtacgagaagcagaaggccgccatcggggaggagcccgacacgatcgagctgaaggtgctgcagcagcgggaggagaccatccacatgctcgaggagaagcgcaaggagctgctgcagcggatcgcccagcagatgaagtcccccaagcagcccgtcaagggccgcgacctcgacgaggacgagcacctgagcgagcggagcaccctgcgctacgggaacgtgatcgacctcgaggagctggacatcgacgagcccgccggcgggtccgcggactggctggccatcggcatctacatcttcagcttccccgtgcagctcctgctgaagaccctctacatcctgacgacccggggccgccagaccatcaaggagaacaaggggaaccggctgcgcttcaaggactccagctccaccatggacgtcaacggcgtgaagacgccgcggcacctctacatcagcctgcccaccgcccagtccagcatgaagaccgaggagatcacccccgggcgctaccggacggtggcctgcggcatcctgtccggggagatgcgcgcgcggaagctcgtcagccccgtgatgggcgtgatcggcttcaactacctggccgagaagtggggcgagtacatcgacgccttcctgatgaagcagtccccgcacctccccgtcagcaccgggtcccccgagagcgccaccaacttcgcctacctgatccagcgccaggacgtgctgaacaagtccaagaccgtggagtacctcgagctgtgggagcaggcggagaaggccgggcggcacctggtcgaccgcatcgagagccccctcacgccgtggctgttcgccggctcccccgaccggtgcccgcccaccagcctgtacgtggccggcatcgccgagctcggggcgttcttcagcatcctgcaggacatccgcaacgccatcatggcctccaagctggtgggcaccgccgaggagaagctcaagcgcaagagctccttctaccagagctacctgcggcgcacccagtccatggggatccagctggaccagcggatcatcatcctctacatgatggagtggggcaagatgatggtcgaccacttccacctgggggacgacatggacagcgagctgcgcaaggcctgccagtccctcatcgacgagaaggtggcccaggtgagcaaccaggaggcgctgaagctgtga

SEQ ID NO: 6432 - RNA, 1287 nt, synthetic construct
  misc_feature 1..1287: note = derived and/or modified CDS sequence (opt1) from NYV(RI-1)__U09488.1__N
  source 1..1287: mol_type = other RNA
atgagcaccctgaaggaggtgcaggacaacatcaccctccacgagcagcagctggtcacggcccgccagaagctgaaggacgccgagaaggcggtggaggtggaccccgacgacgtcaacaagtccaccctccagggccggcgcgccgccgtgagcgccctggagaccaagctgggggagctcaagcggcagctggccgacctgatcgcggcccagaagctcgcctccaagccgatcgaccccaccggcatcgagcccgacgaccacctgaaggagaagtccagcctgcgctacgggaacgtgctcgacgtcaacagcatcgacctggaggagccctccggccagacggccgactggaaggcgatcgggatgtacatcctgagcttcgccatcccgatcatcctcaaggccctgtacatgctgtccacccggggccgccagaccgtgaaggagaacaagggcacccggatccgcttcaaggacgacagctcctacgaggaggtgaacgggatccggaagccccgccacctctacgtcagcatgcccacggcccagtccaccatgaaggccgacgagatcacccccggccggttccgcaccatcgcgtgcgggctgttcccggcccaggtgaaggcccggaacatcatcagccccgtgatgggcgtcatcgggttcaacttcttcgtgaaggactggatggaccgcatcgacgacttcctggccgagcggtgccccttcctccccgagccgcgcgaccccaaggacgccgcgctgggcacgaaccgggcctacttcatcacccgccaggcccaggtggacgagtccaaggtcgtggacatcgaggagctgatcgtggacgcccgggccgagagcgcgaccctcttcgccgacatcgccacgccccactccgtctgggtgttcgcctgcgcccccgaccgctgcccgcccaccgcgctgtacgtggccggcatgcccgagctgggggccttcttcgccatcctccaggacatgcggaacaccatcatggcgagcaagtccgtcggcaccgccgaggagaagctgaagaagaagtccgccttctaccagagctacctgcgccgcacccagagcatggggatccagctcgaccagaagatcatcatcctgtacatgatccactggggcaaggaggccgtgaaccacttccacctgggcgacgacatggaccccgagctccgggagctggcccaggcgctggtggacgccaaggtcaaggagatcagcaaccaggagccgctcaagctgtga

SEQ ID NO: 6433 - RNA, 1302 nt, synthetic construct
  misc_feature 1..1302: note = derived and/or modified CDS sequence (opt1) from PUUV(K27)__L08804.1__N
  source 1..1302: mol_type = other RNA
atgagcgacctgaccgacatccaggaggagatcacccgccacgagcagcagctcgtggtcgcccggcagaagctgaaggacgccgagcgcgcggtggaggtgtaccccgacgacgtcatcaagaacacgctgcaggcccggcagcagaccgtgtccgccctcgaggacaagctggccgactacaagcgccggatggccgacgcggtgagccgcaagaagatggacaccaagccgaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccatcccgatcatcctgaaggccctctacatgctgagcacgcgggggcgccagaccgtgaaggagaacaagggcacccggatccgcttcaaggacgacacctccttcgaggacatcaacggcatccggcgccccaagcacctgtacgtgagcatgcccacggcgcagtccaccatgaaggccgaggagctcacccccgggcggttccgcaccatcgtctgcggcctgttcccgacgcagatccaggtgcggaacatcatgagccccgtgatgggggtcatcggcttctccttcttcgtgaaggactggcccgagaagatccgcgagttcatggagaaggagtgccccttcatcaagccggaggtgaagcccgggacccccgcccaggaggtcgagttcctgaagcggaaccgcgtgtacttcatgacccggcaggacgtgctcgacaagaaccacgtcgccgacatcgacaagctgatcgactacgccgcgagcggcgaccccacctccccggacgacatcaagagccccaacgccccctgggtgttcgcctgcgcccccgaccgctccccgcccacgtgcatctacgtggccggcatggcggagctgggggccttcttcagcatcctccaggacatgcgcaacaccatcatggcctccaagaccgtcggcaccgccgaggagaagctgaagcgcaagagctccttctaccagagctacctgcggcggacgcagagcatggggatccagctcgaccagcgcatcatcctgctgtacatgctcgagtggggcaaggagatggtggaccacttccacctgggcgacgacatggaccccgagctgcgggggctcgcccagtccctgatcgaccagaaggtcaaggagatcagcaaccaggagcccctgaagatctga

SEQ ID NO: 6434 - RNA, 1302 nt, synthetic construct
  misc_feature 1..1302: note = derived and/or modified CDS sequence (opt1) from PUUV(KS13/855)__KX815394.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgagcggatccgcgagttcatggagaaggagtgccccttcatcaagcccgaggtgaagccggggacccccgcccaggaggtggagttcctcaagaagaacaaggtctacttcatgcagcggcaggacgtgctggacaagaaccacgtggccgacatcgacaagctgatcgactacgcggccagcggcgaccccacctcccccgacaacatcgagagcccgaacgccccctgggtcttcgcctgcgcccccgaccgctgcccgccgacctgcatctacgtggcgggcatggccgagctcggggccttcttctccatcctgcaggacatgcggaacacgatcatggccagcaagaccgtgggcaccgccgaggagaagctgaagaagaagtccagcttctaccagtcctacctccgccgcacccagagcatggggatccagctggaccagcggatcatcctgctctacatgctggagtggggcaaggagatggtcgaccacttccacctgggcgacgacatggaccccgagctccgcgggctggcgcaggccctgatcgaccagaaggtgaaggagatcagcaaccaggagcccctcaagatctga

SEQ ID NO: 6435 - RNA, 1302 nt, synthetic construct
  misc_feature 1..1302: note = derived and/or modified CDS sequence (opt1) from PUUV(KS14/118)__KX815395.1__N
  source 1..1302: mol_type = other RNA
atgagcgacctgaccgacatccaggaggacatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgacttcaagcgccggatggccgacgcggtgagccgcaagaagatggacaccaagcccaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccatcccgatcatcctgaaggccctctacatgctgagcacgcgggggcgccagaccgtgaaggagaacaagggcacccggatccgcttcaaggacgacacctccttcgaggacatcaacggcatccggcgccccaagcacctgtacgtgagcatgcccacggcgcagtccaccatgaaggccgaggagctcacccccgggcggttccgcaccatcgtctgcggcctgttcccgacgcagatccaggtgcggaacatcatgagccccgtgatgggggtcatcggcttctccttcttcgtgaagaactggcccgagcgcatcaaggagttcatggagaaggagtgccccttcatcaagccggaggtgaagcccgggacccccgcccaggaggtcgagttcctgaagcggaacaaggtgtacttcatgaaccgccaggacgtgctcgacaagaaccacgtcgccgacatcgacaagctgatcgactacgccgcgagcggcgaccccacctccccggacgacatcgagagccccaacgccccctgggtgttcgcctgcgcccccgaccggtgcccgccgacctgcatctacgtggccggcatggcggagctgggggccttcttctccatcctccaggacatgcgcaacacgatcatggccagcaagaccgtcggcaccgccgaggagaagctgaagaagaagtccagcttctaccagtcctacctgcgccggacccagagcatggggatccagctcgaccagcgcatcatcctgctgtacatgctcgagtggggcaaggagatggtggaccacttccacctgggcgacgacatggaccccgagctgcgggggctcgcccaggcgctgatcgaccagaaggtcaaggagatcagcaaccaggagcccctgaagatctga

SEQ ID NO: 6436 - RNA, 1302 nt, synthetic construct
  misc_feature 1..1302: note = derived and/or modified CDS sequence (opt1) from PUUV(LT15/201)__KX757841.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagcccatcgaccccaccggcatcgagcccgacgaccacctgaaggagcgctccagcctccggtacgggaacgtgctggacgtcaacgccatcgacatcgaggagccctccggccagacggccgactggtacaccatcggggtgtacgtgatcggcttcaccctgccgatcatcctcaaggccctgtacatgctgagcacccgcgggcggcagacggtcaaggagaacaagggcacccgcatccggttcaaggacgacacctccttcgaggacatcaacggcatccgccggcccaagcacctctacgtgagcatgcccaccgcgcagtccacgatgaaggccgaggagctgacccccgggcgcttccggaccatcgtgtgcggcctgttcccgacccagatccaggtccgcaacatcatgagccccgtgatgggggtgatcggcttctccttcttcgtcaaggactgggccgagcggatccgcgagttcatggagaaggagtgccccttcatcaagcccgaggtgaagccggggacgcccgcccaggaggtggagttcctcaagaagaacaaggtctacttcatgcagcggcaggacgtgctggacaagaaccacgtggccgacatcgacaagctgatcgactacgcggccagcggcgaccccacctcccccgacaacatcgagagcccgaacgccccctgggtcttcgcctgcgcccccgaccgctgcccgccgacctgcatctacgtggcgggcatggccgagctcggggccttcttctccatcctgcaggacatgcggaacaccatcatggccagcaagacggtgggcaccgccgaggagaagctgaagaagaagtccagcttctaccagtcctacctccgccgcacccagagcatggggatccagctggaccagcggatcatcctgctctacatgctggagtggggcaaggagatggtcgaccacttccacctgggcgacgacatggaccccgagctccgcgggctggcgcaggccctgatcgaccagaaggtgaaggagatcagcaaccaggagcccctcaagatctga

SEQ ID NO: 6437 - RNA, 1302 nt, synthetic construct
  misc_feature 1..1302: note = derived and/or modified CDS sequence (opt1) from PUUV(PUU/Ernstbrunn/Cg641/1995)__AJ888752.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatcaagcgccccaagcacctctacgtgagcatgcccacggcgcagtccaccatgaaggccgagaagctgacccccgggcggttccgcaccatcgtgtgcggcctgttcccgacgcagatccaggtccggaacatcatgagccccgtgatgggggtgatcggcttctccttcttcgtcaaggactggagcgagcgcgtgcgggacttcatggagaaggagtgccccttcatcaagcccgagatcaagccggggaccccgccccaggaggccgagttcctcaagcgcaacaaggtgtacttcatgcagcggcaggacgtcctggacaagaaccacgtggccgacatcgacaagctgatcgactacgccgcgtccggcgaccccaccagccccgacaacctcgagtcccccaacgccccctgggtgttcgcctgcgcccccgaccgctgcccgccgacctgcatctacgtcgccggcatggcggagctgggggccttcttcagcatcctgcaggacatgcggaacacgatcatggcctccaagaccgtgggcaccgccgaggagaagctcaagaagaagtccagcttctaccagagctacctgcgccgcacccagagcatggggatccagctggaccagcggatcatcctcctgtacatgctggagtggggcaaggagatggtggaccacttccacctcggcgacgacatggaccccgagctgcgcgggctggcccaggcgctcatcgaccagaaggtcaaggagatctccaaccaggagcccctgaagatctga

SEQ ID NO: 6438 - RNA, 1302 nt, synthetic construct
  misc_feature 1..1302: note = derived and/or modified CDS sequence (opt1) from PUUV(PUU/Klippitztoerl/Cg9/1995)__AJ888751.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagcccggcgggcagaccgccgactggtacaccatcggcgtgtacgtgatcgggttcaccctgccgatcatcctcaaggccctgtacatgttctccacgcgcggccggcagaccgtcaaggagaacaagggcacccgcatccggttcaaggacgacaccagcttcgaggacatcaacgggatccgccggcccaagcacctgtacgtgtccatgcccacggcgcagagcaccatgaaggccgaggagctcacccccggccgcttccggaccatcgtgtgcgggctgttcccgacgcagatccaggtccgcaacatcatgtcccccgtgatgggcgtgatcgggttcagcttcttcgtcaaggactggtccgagcgggtgcgcgacttcatggagaaggagtgccccttcatcaagcccgagatcaagccgggcaccccgccccaggaggccgagttcctgaagcggaacaaggtgtacttcatgcagcgccaggacgtcctcgacaagaaccacgtggccgacatcgacaagctgatcgactacgccgcgagcggcgaccccacctcccccgacaacctggagagccccaacgccccctgggtgttcgcctgcgcccccgaccggtgcccgccgacctgcatctacgtcgccgggatggcggagctcggcgccttcttctccatcctgcaggacatgcgcaacacgatcatggccagcaagaccgtggggaccgccgaggagaagctgaagaagaagtccagcttctaccagtcctacctccgccggacccagagcatgggcatccagctggaccagcgcatcatcctgctctacatgctggagtggggcaaggagatggtggaccacttccacctgggggacgacatggaccccgagctccggggcctggcccaggcgctgatcgaccagaaggtcaaggagatcagcaaccaggagcccctcaagatctga

SEQ ID NO: 6439 - RNA, 1302 nt, synthetic construct
  misc_feature 1..1302: note = derived and/or modified CDS sequence (opt1) from PUUV(Balkan-1)__AJ314600.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactggagcgagcgggtgcgcgagttcatggagaaggagtgccccttcatcaagcccgagatcaagccggggaccccgccccaggaggccgagttcctcaagcggaacaaggtgtacttcatgcagcgccaggacgtcctggacaagaaccacgtggccgacatcgacaagctgctcgactacgccgcgtccggcgaccccaccagccacgacaacatcgagtcccccaacgccccctgggtgttcgcctgcgcccccgaccggtgcccgccgacctgcatctacgtcgccggcatggcggagctgggggccttcttcagcatcctgcaggacatgcgcaacacgatcatggcctccaagaccgtgggcaccgccgaggagaagctcaagaagaagtccagcttctaccagagctacctgcgccggacccagagcatggggatccagctggaccagcgcatcatcctcctgtacatgctggagtggggcaaggagatggtggaccacttccacctcggcgacgacatggaccccgagctgcgggggctggcccaggcgctcatcgaccagaaggtcaaggagatctccaaccaggagcccctgaagatctga

SEQ ID NO: 6440 - RNA, 1302 nt, synthetic construct
  misc_feature 1..1302: note = derived and/or modified CDS sequence (opt1) from PUUV(Balkan-2)__AJ314601.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgttcggcctgttcccgacgcagatccaggtccgcaacatcatgagccccgtgatgggggtgatcggcttctccttcttcgtcaaggactggagcgagcgggtgcgcgagttcatggagaaggagtgccccttcatcaagcccgagatcaagccgggggccccgccccaggaggccgagttcctcaagcggaacaaggtgtacttcatgcagcgccaggacgtcctggacaagaaccacgtggccgacatcgacaagctgatcgactacgcggcctccggcgaccccaccagccccgacaacatcgagtcccccaacgccccctgggtgttcgcctgcgcccccgaccggtgcccgccgacctgcatctacgtcgcgggcatggccgagctcggggccttcttcagcatcctgcaggacatgcgcaacaccatcatggcctccaagacggtgggcaccgccgaggagaagctgaagaagaagtccagcttctaccagagctacctccgccggacccagagcatggggatccagctggaccagcgcatcatcctgctctacatgctggagtggggcaaggagatggtggaccacttccacctgggcgacgacatggaccccgagctccgggggctggcgcaggccctgatcgaccagaaggtcaaggagatctccaaccaggagcccctcaagatctga

SEQ ID NO: 6441 - RNA, 1302 nt, synthetic construct
  misc_feature 1..1302: note = derived and/or modified CDS sequence (opt1) from PUUV(Baltic/205Cg/00)__AJ314599.1__N
  source 1..1302: mol_type = other RNA
atgagcgacctggccgacatccaggaggacatcacccgccacgagcagcagctcgtggtcgcccggcagaagctgaaggacgcggagcgcgccgtggaggtggaccccgacgacgtcaacaagaacaccctgcaggcccggcagcagacggtgtccgccctcgaggacaagctggccgactacaagcgccggatggcggacgccgtgagccgcaagaagatggacaccaagcccaccgaccccaccggcatcgagcccgacgaccacctgaaggagcggtccagcctccgctacgggaacgtcctggacgtgaacgccatcgacatcgaggagccctccggccagacggccgactggtacaccatcggggtgtacgtcatcggcttcaccctgccgatcatcctcaaggcgctgtacatgctgagcacccgggggcgccagacggtgaaggagaacaagggcacccggatccgcttcaaggacgacacctccttcgaggacatcaacggcatccggcgccccaagcacctctacgtgagcatgcccaccgcccagtccacgatgaaggccgaggagctgacccccgggcggttccgcaccatcgtctgcggcctgttcccgacccagatccaggtgcggaacatcatgagccccgtgatgggggtcatcggcttctccttcttcgtgaaggactggcccgagcgcatcaaggagttcatggagaaggagtgccccttcatcaagccggaggtgaagcccgggacgcccacccaggaggtcgagttcctcaagcggaacaaggtgtacttcatgaaccgccaggacgtgctggacaagaaccacgtcgccgacatcgacaagctgatcgactacgccgcgagcggcgaccccacctccccggacgacatcgagagccccaacgccccctgggtgttcgcctgcgcccccgaccggtgcccgccgacctgcatctacgtggccggcatggcggagctcggggccttcttctccatcctgcaggacatgcgcagcacgatcatggcctccaagaccgtcggcaccgccgaggagaagctgaagaagaagtccagcttctaccagagctacctccgccggacccagagcatggggatccagctggaccagcgcatcatcctgctctacatgctggagtggggcaaggagatggtggaccacttccacctgggcgacgacatggaccccgagctccgggggctggcccaggcgctgatcgaccagaaggtcaaggagatctccaaccaggagcccctcaagatctga

SEQ ID NO: 6442 - RNA, 1302 nt, synthetic construct
  misc_feature 1..1302: note = derived and/or modified CDS sequence (opt1) from PUUV(Baltic/49Cg/00)__AJ314598.1__N
  source 1..1302: mol_type = other RNA
atgagcgacctggccgacatccaggaggacatcacccgccacgagcagcagctcgtggtcgcccggcagaagctgaaggacgcggagcgcgccgtggaggtggaccccgacgacgtcaacaagaacaccctgcaggcccggcagcagacggtgtccgccctcgaggacaagctggccgactacaagcgccggatggcggacgccgtgagccgcaagaagatggacaccaagcccaccgaccccaccggcatcgagcccgacgaccacctgaaggagcggtccagcctccgctacgggaacgtcctggacgtgaacgccatcgacatcgaggagccctccggccagacggccgactggtacaccatcggggtgtacgtcatcggcttcaccctgccgatcatcctcaaggcgctgtacatgctgagcacccgggggcgccagacggtgaaggagaacaagggcacccggatccgcttcaaggacgacacctccttcgaggacatcaacggcatccggcgccccaagcacctctacgtgagcatgcccaccgcccagtccacgatgaaggccgaggagctgacccccgggcggttccgcaccatcgtctgcggcctgttcccgacccagatccaggtgcggaacatcatgagccccgtgatgggggtcatcggcttctccttcttcgtgaaggactggcccgagcgcatcaaggagttcatggagaaggagtgccccttcatcaagccggaggtgaagcccgggacgcccgcccaggaggtcgagttcctcaagcggaacaaggtgtacttcatgaaccgccaggacgtgctggacaagaaccacgtcgccgacatcgacaagctgatcgactacgcggccagcggcgaccccacctccccggacgacatcgagagccccaacgccccctgggtgttcgcctgcgcccccgaccggtgcccgccgacctgcatctacgtggcgggcatggccgagctcggggccttcttctccatcctgcaggacatgcgcaacaccatcatggccagcaagacggtcggcaccgccgaggagaagctgaagaagaagtccagcttctaccagtcctacctccgccggacccagagcatggggatccagctggaccagcgcatcatcctgctctacatgctggagtggggcaaggagatggtggaccacttccacctgggcgacgacatggaccccgagctccgggggctggcgcaggccctgatcgaccagaaggtcaaggagatcagcaaccaggagcccctcaagatctga

SEQ ID NO: 6443 - RNA, 1302 nt, synthetic construct
  misc_feature 1..1302: note = derived and/or modified CDS sequence (opt1) from PUUV(Pallasjarvi/63Cg/98)__AJ314597.1__N
  source 1..1302: mol_type = other RNA
atgagcgacctgaccgacatccaggaggacatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacgcggtgagccgcaagaagatggacaccaagcccaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccctgccgatcatcctcaaggccctgtacatgctgagcacgcgggggcgccagaccgtgaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtctgcggcctgttcccgacgcagatccaggtgcggaacatcatgagccccgtgatgggggtcatcggcttctccttcttcgtgaaggactggagcgagcgcatccgggagttcatggagaaggagtgccccttcatcaagcccgaggtgaagccggggacccccgcccaggaggtcgagatgctcaagcgcaacaagatctacttcatgcagcggcaggacgtgctggacaagaaccacgtggccgacatcgacaagctgatcgactacgccgcgtccggcgaccccaccagccccgacaacatcgactccccgaacgccccctgggtcttcgcctgcgcccccgaccgctgcccgccgacctgcatctacgtggccggcatggcggagctcggggccttcttcagcatcctgcaggacatgcgcaacacgatcatggcctccaagaccgtgggcaccgccgaggagaagctgaagaagaagtccagcttctaccagagctacctccggcgcacccagagcatggggatccagctggaccagcggatcatcctcctgttcatgctggagtggggcaaggagatggtcgaccacttccacctgggcgacgacatggaccccgagctccgcgggctggcccaggcgctgatcgaccagaaggtgaaggagatctccaaccaggagcccctcaagatctga

SEQ ID NO: 6444 - RNA, 1302 nt, synthetic construct
  misc_feature 1..1302: note = derived and/or modified CDS sequence (opt1) from PUUV(Sotkamo 2009)__HE801633.1__N
  source 1..1302: mol_type = other RNA
atgagcgacctgaccgacatccaggaggacatcacccgccacgagcagcagctcatcgtggcccggcagaagctgaaggacgccgagcgcgcggtcgaggtggaccccgacgacgtgaacaagaacacgctgcaggcccggcagcagaccgtctccgccctcgaggacaagctggccgactacaagcgccggatggccgacgcggtgagccgcaagaagatggacaccaagcccaccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgggggcgccagaccgtcaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtgtgcggcctgttcccgacgcagatccaggtccggaacatcatgagccccgtgatgggggtgatcggcttctccttcttcgtcaaggactggagcgagcgcatccgggagttcatggagaaggagtgccccttcatcaagcccgaggtgaagccggggacccccgcccaggagatcgagatgctcaagcgcaacaagatctacttcatgcagcggcaggacgtgctggacaagaaccacgtcgccgacatcgacaagctgatcgactacgccgcgtccggcgaccccaccagccccgacaacatcgactccccgaacgccccctgggtgttcgcctgcgcccccgaccgctgcccgccgacctgcatctacgtggccggcatggcggagctcggggccttcttcagcatcctgcaggacatgcgcaacacgatcatggcctccaagaccgtcggcaccgccgaggagaagctgaagaagaagtccagcttctaccagagctacctccggcgcacccagagcatggggatccagctggaccagcggatcatcctcctgttcatgctggagtggggcaaggagatggtggaccacttccacctgggcgacgacatggaccccgagctccgcgggctggcccaggcgctgatcgaccagaaggtgaaggagatctccaaccaggagcccctcaagatctga

SEQ ID NO: 6445 - RNA, 1302 nt, synthetic construct
  misc_feature 1..1302: note = derived and/or modified CDS sequence (opt1) from PUUV(CG 13891)__U22423.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcagatggccgacgcggtgagccgcaagaagatggacaccaagccgaccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgggggcgccagaccgtcaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtgtgcggcctgttcccgacgcagatccaggtccggaacatcatgagccccgtgatgggggtgatcggcttctccttcttcgtcaaggactgggccgaccgcatccgggagagcatggagaaggagtgccccttcctcaagcccgacgtgaagccggggacccccgcccaggagaccgagttcctgaagcgcaacaagatctacttcatgcagcggcaggaggtgctggacaagaaccacgtcgccgagatcgacaagctcatcgactacgcggcctccggcgaccccaccagccccgacaacatcgagtccccgaacgccccctgggtgttcgcctgcgcccccgaccgctgcccgcccacgtgcatctacgtggcgggcatggccgagctgggggccttcttcagcatcctgcaggacatgcggaacaccatcatggcctccaagaccgtcggcaccgccgaggagaagctcaagaagaagtccagcttctaccagagctacctgcgccgcacgcagagcatggggatccagctggaccagcggatcatcctcctgtacatgctggagtggggcaaggagatggtggaccacttccacctcggcgacgacatggaccccgagctgcgcgggctggcgcaggccctcatcgaccagaaggtgaaggagatctccaaccaggagcccctgaagatctga

SEQ ID NO: 6446 - RNA, 1302 nt, synthetic construct
  misc_feature 1..1302: note = derived and/or modified CDS sequence (opt1) from PUUV(CG1820)__M32750.1__N
  source 1..1302: mol_type = other RNA
atgagcgacctgaccgacatccaggaggagatcacccgccacgagcagcagctcgtggtcgcccggcagaagctgaaggacgccgagcgcgcggtggaggtggaccccgacgacgtcaacaagtccacgctgcaggcccggcagcagaccgtgagcgccctcgaggacaagctggccgactacaagcgccggatggccgacgcggtgtcccgcaagaagatggacaccaagccgaccgaccccacgggcatcgagcccgacgaccacctgaaggagcggagctccctccgctacgggaacgtcctggacgtgaacgccatcgacatcgaggagcccagcggccagaccgccgactggtacaccatcggggtgtacgtcatcggcttcaccatcccgatcatcctgaaggccctctacatgctgtccacgcgggggcgccagaccgtgaaggagaacaagggcacccggatccgcttcaaggacgacaccagcttcgaggacatcaacggcatccggcgccccaagcacctgtacgtgtccatgcccacggcgcagagcaccatgaaggccgaggagctcacccccgggcggttccgcaccatcgtctgcggcctgttcccgacgcagatccaggtgcggaacatcatgtcccccgtgatgggggtcatcggcttcagcttcttcgtgaaggactggcccgagaagatccgcgagttcatggagaaggagtgccccttcatcaagccggaggtgaagcccgggacccccgcccaggaggtcgagttcctgaagcggaaccgcgtgtacttcatgacccggcaggacgtgctcgacaagaaccacgtcgccgacatcgacaagctgatcgactacgccgcgtccggcgaccccaccagcccggacgacatcgagtcccccaacgccccctgggtgttcgcctgcgcccccgaccgctgcccgcccacgtgcatctacgtggccggcatggcggagctgggggccttcttcagcatcctccaggacatgcgcaacaccatcatggcctccaagaccgtcggcaccgccgaggagaagctgaagaagaagtccagcttctaccagagctacctgcggcgcacgcagagcatggggatccagctcgaccagcggatcatcctgctgtacatgctcgagtggggccgcgagatggtggaccacttccacctgggcgacgacatggaccccgagctgcgggggctcgcccagtccctgatcgaccagaaggtcaaggagatcagcaaccaggagcccctgaagatctga

SEQ ID NO: 6447 - RNA, 1302 nt, synthetic construct
  misc_feature 1..1302: note = derived and/or modified CDS sequence (opt1) from PUUV(Bussjo_95-1)__AM746297.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagccgaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactggcccgaccggatccgcgagttcatggagaaggagtgccccttcatcaagccggaggtgaagcccgggacccccacccaggagatcgagttcctcaagaagaacaaggtgtacttcatggaccggcagaacgtcctggacaagaaccacgtggccgacatcgacaagctgatcgactacgccgccagcggcgaccccacctccccggacaacatcgagagccccaacgcgccctgggtgttcgcctgcgcccccgaccgctgcccgcccacgtgcatctacgtcgccggcatggccgagctcggggcgttcttctccatcctgcaggacatgcggaacaccatcatggccagcaagaccgtgggcaccgccgaggagaagctgaagaagaagtccagcttctaccagtcctacctccgccgcacgcagagcatggggatccagctggaccagcggatcatcctgctctacatgctggagtggggcaaggagatggtggaccacttccacctgggcgacgacatggaccccgagctccgcgggctggcccaggccctgatcgaccagaaggtcaaggagatcagcaaccaggaccccctcaagatctga

SEQ ID NO: 6448 - RNA, 1302 nt, synthetic construct
  misc_feature 1..1302: note = derived and/or modified CDS sequence (opt1) from PUUV(CG144)__AF367064.1__N
  source 1..1302: mol_type = other RNA
atgagcgacctgaccgacatccaggaggacatcacccgccacgagcagcagctcgtggccgcccggcagaagctgaaggacgcggagcgcgccgtcgagatggaccccgacgacgtgaacaagaacacgctgcaggcccggcagcagaccgtgtccgccctcgaggacaagctggccgactacaagcgccggatggcggacgccgtcagccgcaagaagatggacaccaagcccgccgaccccaccggcatcgagcccgacgaccacctgaaggagcggtccagcctccgctacgggaacgtgctggacgtgaacgccatcgacatcgaggagccctccggccagacggcggactggtacaccatcgggatctacgtcatcggcttcaccctgccgatcatcctcaaggccctgtacatgctgagcacccgggggcgccagacggtgaaggagaacaagggcacccggatccgcttcaaggacgacacctccttcgaggacatcaacggcatccggcgccccaagcacctctacgtgagcatgcccaccgcccagtccacgatgaaggccgaggagctgacccccgggcggttccgcaccatcgtctgcggcctgttcccgacccagatccaggtgcggaacatcatgagccccgtgatgggggtcatcggcttctccttcttcgtgaaggactggcccgagcgcatccgggagttcatggagaaggagtgccccttcatcaagccggaggtgaagcccgggacgcccgcccaggagatcgagatgctcaagaagaacaagatctacttcatgcaccgccaggacgtcctggacaagaaccacgtggcggacatcgacaagctgatcgactacgccgccagcggcgaccccacctccccggacaacatcgacagccccaacgccccctgggtgttcgcctgcgcgcccgaccggtgcccgccgacctgcatctacgtcgccggcatggccgagctcggggccttcttctccatcctgcaggacatgcgcaacaccatcatggccagcaagacggtgggcaccgcggaggagaagctgaagaagaagtccagcttctaccagtcctacctccgccggacccagagcatggggatccagctggaccagcgcatcatcctgctctacatgctggagtggggcaaggagatggtggaccacttccacctgggcgacgacatggaccccgagctccgggggctggcccaggccctgatcgaccagaaggtcaaggagatcagcaaccaggagcccctcaagatctga

SEQ ID NO: 6449 - RNA, 1302 nt, synthetic construct
  misc_feature 1..1302: note = derived and/or modified CDS sequence (opt1) from PUUV(CG168)__AF367065.1__N
  source 1..1302: mol_type = other RNA
atgagcgacctgaccgacatccaggaggacatcacccgccacgagcagcagctcgtggccgcccggcagaagctgaaggacgcggagcgcgccgtcgagatggaccccgacgacgtgaacaagaacacgctgcaggcccggcagcagaccgtgtccgccctcgaggacaagctggccgactacaagcgccggatggcggacgccgtcagccgcaagaagatggacaccaagcccgccgaccccaccggcatcgagcccgacgaccacctgaaggagcggtccagcctccgctacgggaacgtgctggacgtgaacgccatcgacatcgaggagccctccggccagacggcggactggtacaccatcggggtctacgtgatcggcttcaccctgccgatcatcctcaaggccctgtacatgctgagcacccgggggcgccagacggtgaaggagaacaagggcacccggatccgcttcaaggacgacacctccttcgaggacatcaacggcatccggcgccccaagcacctctacgtcagcatgcccaccgcccagtccacgatgaaggccgaggagctgacccccgggcggttccgcaccatcgtgtgcggcctgttcccgacccagatccaggtgcggaacatcatgagccccgtcatgggggtgatcggcttctccttcttcgtgaaggactggcccgagcgcatccgggagttcatggagaaggagtgccccttcatcaagccggaggtcaagcccgggatccccgcccaggagatcgagatgctcaagaagaacaagatctacttcatgcaccgccaggacgtgctggacaagaaccacgtggcggacatcgacaagctgatcgactacgccgccagcggcgaccccacgtccccggacaacatcgacagccccaacgccccctgggtcttcgcctgcgcgcccgaccggtgcccgccgacctgcatctacgtggccggcatggccgagctcggggccttcttctccatcctgcaggacatgcgcaacaccatcatggccagcaagaccgtgggcacggcggaggagaagctgaagaagaagtccagcttctaccagtcctacctccgccggacccagagcatggggatccagctggaccagcgcatcatcctgctctacatgctggagtggggcaaggagatggtcgaccacttccacctgggcgacgacatggaccccgagctccgggggctggcccaggccctgatcgaccagaaggtgaaggagatcagcaaccaggagcccctcaagatctga

SEQ ID NO: 6450 - RNA, 1302 nt, synthetic construct
  misc_feature 1..1302: note = derived and/or modified CDS sequence (opt1) from PUUV(CG17/Baskiria-2001)__AF442613.1__N
  source 1..1302: mol_type = other RNA
atgagcgacctggccgacatccaggaggagatcacccgccacgagcagcagctcgtggccgcgcggcagaagctgaaggacgccgagcgcgccgtcgaggtggaccccgacgacgtgaacaagaacaccctgcaggcccggcagcagacggtctccgccctcgaggacaagctggcggactacaagcgccggatggccgacgccgtgagccgcaagaagatggacaccaagcccaccgaccccaccggcatcgagcccgacgaccacctgaaggagcggtccagcctccgctacgggaacgtgctggacgtcaacgccatcgacatcgaggagccctccggccagacggcggactggtacaccatcggggtgtacgtgatcggcttcaccatcccgatcatcctgaaggccctctacatgctgagcacccgggggcgccagacggtcaaggagaacaagggcacccggatccgcttcaaggacgacacctccttcgaggacatcaacggcatccggcgccccaagcacctgtacgtgagcatgcccaccgcccagtccacgatgaaggccgaggagctcacccccgggcggttccgcaccatcgtgtgcggcctgttcccgacccagatccaggtccggaacatcatgagccccgtgatgggggtgatcggcttctccttcttcgtcaaggactggcccgagaagatccgcgagttcatggagaaggagtgccccttcatcaagccggaggtgaagcccgggacgcccgcccaggaggtggagttcctgaagcggaaccgcgtctacttcatgacccggcaggacgtgctcgacaagaaccacgtggcggacatcgacaagctgatcgactacgccgccagcggcgaccccacctccccggacgacatcgagagccccaacgccccctgggtcttcgcctgcgcgcccgaccgctgcccgccgacctgcatctacgtggccggcatggccgagctgggggccttcttctccatcctccaggacatgcgcaacacgatcatggccagcaagaccgtgggcaccgcggaggagaagctgaagaagaagtccagcttctaccagtcctacctgcggcgcacccagagcatggggatccagctcgaccagcggatcatcctgctgtacatgctcgagtggggcaaggagatggtcgaccacttccacctgggcgacgacatggaccccgagctgcgcgggctcgcccagagcctgatcgaccagaaggtgaaggagatctccaaccaggagcccctgaagatctga

SEQ ID NO: 6451 - RNA, 1302 nt, synthetic construct
  misc_feature 1..1302: note = derived and/or modified CDS sequence (opt1) from PUUV(CG215)__AF367066.1__N
  source 1..1302: mol_type = other RNA
atgagcgacctgaccgacatccaggaggacatcacccgccacgagcagcagctcgtggccgcccggcagaagctgaaggacgcggagcgcgccgtcgagatggaccccgacgacgtgaacaagaacacgctgcaggcccggcagcagaccgtgtccgccctcgaggacaagctggccgactacaagcgccggatggcggacgccgtcagccgcaagaagatggacaccaagcccgccgaccccaccggcatcgagcccgacgaccacctgaaggagcggtccagcctccgctacgggaacgtgctggacgtgaacgccatcgacatcgaggagccctccggccagacggcggactggtacaccatcggggtctacgtgatcggcttcaccctgccgatcatcctcaaggccctgtacatgctgagcacccgggggcgccagacggtgaaggagaacaagggcacccggatccgcttcaaggacgacacctccttcgaggacatcaacggcatccggcgccccaagcacctctacgtcagcatgcccaccgcccagtccacgatgaaggccgaggagctgacccccgggcggttccgcaccatcgtgtgcggcctgttcccgacccagatccaggtgcggaacatcatgagccccgtcatgggggtgatcggcttctccttcttcgtgaaggactggcccgagcgcatccgggagttcatggagaaggagtgccccttcatcaagccggaggtcaagcccgggacgcccgcccaggagatcgagatgctcaagaagaacaagatctacttcatgcaccgccaggacgtgctggacaagaaccacgtggcggacatcgacaagctgatcgactacgccgccagcggcgaccccacctccccggacaacatcgacagccccaacgccccctgggtcttcgcctgcgcgcccgaccggtgcccgccgacctgcatctacgtggccggcatggccgagctcggggccttcttctccatcctgcaggacatgcgcaacaccatcatggccagcaagacggtgggcaccgcggaggagaagctgaagaagaagtccagcttctaccagtcctacctccgccggacccagagcatggggatccagctggaccagcgcatcatcctgctctacatgctggagtggggcaaggagatggtcgaccacttccacctgggcgacgacatggaccccgagctccgggggctggcccagaccctgatcgaccagaaggtgaaggagatcagcaaccaggagcccctcaagatctga

SEQ ID NO: 6452 - RNA, 1302 nt, synthetic construct
  misc_feature 1..1302: note = derived and/or modified CDS sequence (opt1) from PUUV(CG315)__AF367068.1__N
  source 1..1302: mol_type = other RNA
atgagcgacctgaccgacatccaggaggacatcacccgccacgagcagcagctcgtggccgcccggcagaagctgaaggacgcggagcgcgccgtcgagatggaccccgacgacgtgaacaagaacacgctgcaggcccggcagcagaccgtgtccgccctcgaggacaagctggccgactacaagcgccggatggcggacgccgtcagccgcaagaagatggacaccaagcccgccgaccccaccggcatcgagcccgacgaccacctgaaggagcggtccagcctccgctacgggaacgtgctggacgtgaacgccatcgacatcgaggagccctccggccagacggcggactggtacaccatcggggtctacgtgatcggcttcaccctgccgatcatcctcaaggccctgtacatgctgagcacccgggggcgccagacggtgaaggagaacaagggcacccggatccgcttcaaggacgacacctccttcgaggacatcaacggcatccggcgccccaagcacctctacgtcagcatgcccaccgcccagtccacgatgaaggccgaggagctgacccccgggcggttccgcaccatcgtgtgcggcctgttcccgacccagatccaggtgcggaacatcatgagccccgtcatgggggtgatcggcttctccttcttcgtgaaggactggcccgagcgcatccgggagttcatggagaaggagtgccccttcatgaagccggaggtcaagcccgggacgcccgcccaggagatcgagatgctcaagaagaacaagatctacttcatgcaccgccaggacgtgctggacaagaaccacgtggcggacatcgacaagctgatcgactacgccgccagcggcgaccccacctccccggacaacatcgacagccccaacgccccctgggtcttcgcctgcgcgcccgaccggtgcccgccgacctgcatctacgtggccggcatggccgagctcggggccttcttctccatcctgcaggacatgcgcaacaccatcatggccagcaagacggtgggcaccgcggaggagaagctgaagaagaagtccagcttctaccagtcctacctccgccggacccagagcatggggatccagctggaccagcgcatcatcctgctctacatgctggagtggggcaaggagatggtcgaccacttccacctgggcgacgacatggaccccgagctccgggggctggcccaggccctgatcgaccagaaggtgaaggagatcagcaaccaggagcccctcaagatctga

SEQ ID NO: 6453 - RNA, 1302 nt, synthetic construct
  misc_feature 1..1302: note = derived and/or modified CDS sequence (opt1) from PUUV(CRF161)__AF367069.1__N
  source 1..1302: mol_type = other RNA
atgagcgacctgaccgacatccaggaggacatcacccgccacgagcagcagctcgtggccgcccggcagaagctgaaggacgcggagcgcgccgtcgagatggaccccgacgacgtgaacaagaacacgctgcaggcccggcagcagaccgtgtccgccctcgaggacaagctggccgactacaagcgccggatggcggacgccgtcagccgcaagaagatggacaccaagcccgccgaccccaccggcatcgagcccgacgaccacctgaaggagcggtccagcctccgctacgggaacgtgctggacgtgaacgccatcgacatcgaggagccctccggccagacggcggactggtacaccatcggggtctacgtgatcggcttcaccctgccgatcatcctcaaggccctgtacatgctgagcacccgggggcgccagacggtgaaggagaacaagggcacccggatccgcttcaaggacgacacctccttcgaggacatcaacggcatccggcgccccaagcacctctacgtcagcatgcccaccgcccagtccacgatgaaggccgaggagctgacccccgggcggttccgcaccatcgtgtgcggcctgttcccgacccagatccaggtgcggaacatcatgagccccgtcatgggggtgatcggcttctccttcttcgtgaaggactggcccgagcgcatccgggagttcatggagaaggagtgccccttcatcaagccggaggtcaagcccgggacgcccgcccaggagatcgagatgctcaagaagaacaagatctacttcatgcaccgccaggacgtgctggacaagaaccacgtggcggacatcgacaagctgatcgactacgccgccagcggcgaccccacctccccggacaacatcgacagccccaacgccccctgggtcttcgcctgcgcgcccgaccggtgcccgccgacctgcatctacgtggccggcatggccgagctcggggccttcttctccatcctgcaggacatgcgcaacaccatcatggccagcaagacggtgggcaccgcggaggagaagctgaagaagaagtccagcttctaccagtcctacctccgccggacccagagcatggggatccagctggaccagcgcatcatcctgctctacatgctggagtggggcaaggagatggtcgaccacttccacctgggcgacgacatggaccccgagctccgggggctggcccaggccctgatcgaccagaaggtgaaggagatcagcaaccaggagcccctcaagatctga

SEQ ID NO: 6454 - RNA, 1302 nt, synthetic construct
  misc_feature 1..1302: note = derived and/or modified CDS sequence (opt1) from PUUV(CRF308)__AF367070.1__N
  source 1..1302: mol_type = other RNA
atgagcgacctgaccgacatccaggaggacatcacccgccacgagcagcagctcgtggccgcccggcagaagctgaaggacgcggagcgcgccgtcgagatggaccccgacgacgtgaacaagaacacgctgcaggcccggcagcagaccgtgtccgccctcgaggacaagctggccgactacaagcgccggatggcggacgccgtcagccgcaagaagatggacaccaagcccgccgaccccaccggcatcgagcccgacgaccacctgaaggagcggtccagcctccgctacgggaacgtgctggacgtgaacgccatcgacatcgaggagccctccggccagacggcggactggtacaccatcggggtctacgtgatcggcttcaccctgccgatcatcctcaaggccctgtacatgctgagcacccgggggcgccagacggtgaaggagaacaagggcacccggatccgcttcaaggacgacacctccttcgaggacatcaacggcatccggcgccccaagcacctctacgtcagcatgcccaccgcccagtccacgatgaaggccgaggagctgacccccgggcggttccgcaccatcgtgtgcggcctgttcccgacccagatccaggtgcggaacatcatgagccccgtcatgggggtgatcggcttctccttcttcgtgaaggactggcccgagcgcatccgggagttcatggagaaggagtgccccttcatcaagccggaggtcaagcccgggacgcccgcccaggagatcgagatgctcaagaagaacaagatctacttcatgcaccgccaggacgtgctggacaagaaccacgtggcggacatggacaagctgatcgactacgccgccagcggcgaccccacctccccggacaacatcgacagccccaacgccccctgggtcttcgcctgcgcgcccgaccggtgcccgccgacctgcatctacgtggccggcatggccgagctcggggccttcttctccatcctgcaggacatgcgcaacaccatcatggccagcaagacggtgggcaccgcggaggagaagctgaagaagaagtccagcttctaccagtcctacctccgccggacccagagcatggggatccagctggaccagcgcatcatcctgctctacatgctggagtggggcaaggagatggtcgaccacttccacctgggcgacgacatggaccccgagctccgggggctggcccaggccctgatcgaccagaaggtgaaggagatcagcaaccaggagcccctcaagatctga

SEQ ID NO: 6455 - RNA, 1302 nt, synthetic construct
  misc_feature 1..1302: note = derived and/or modified CDS sequence (opt1) from PUUV(CRF366)__AF367071.1__N
  source 1..1302: mol_type = other RNA
atgaccgacctgaccgacatccaggaggacatcacgcgccacgagcagcagctcgtggccgcccggcagaagctgaaggacgcggagcgcgccgtcgagatggaccccgacgacgtgaacaagaacaccctgcaggcccggcagcagaccgtgagcgccctcgaggacaagctggccgactacaagcgccggatggcggacgccgtctcccgcaagaagatggacaccaagccggccgaccccacgggcatcgagcccgacgaccacctgaaggagcggagctccctccgctacgggaacgtgctggacgtgaacgccatcgacatcgaggagcccagcggccagaccgcggactggtacaccatcgggatctacgtcatcggcttcaccctgccgatcatcctcaaggccctgtacatgctgtccacgcgggggcgccagaccgtgaaggagaacaagggcacccggatccgcttcaaggacgacaccagcttcgaggacatcaacggcatccggcgccccaagcacctctacgtgtccatgcccacggcccagagcaccatgaaggccgaggagctgacccccgggcggttccgcaccatcgtctgcggcctgttcccgacgcagatccaggtgcggaacatcatgtcccccgtgatgggggtcatcggcttcagcttcttcgtgaaggactggcccgagcgcatccgggagttcatggagaaggagtgccccttcatcaagccggaggtgaagcccgggacccccgcccaggagatcgagatgctcaagaagaacaagatctacttcatgcaccgccaggacgtcctggacaagaaccacgtggcggacatcgacaagctgatcgactacgccgcctccggcgaccccaccagcccggacaacatcgactcccccaacaccccctgggtgttcgcctgcgcccccgaccggtgcccgcccacgtgcatctacgtcgcgggcatggccgagctcggggccttcttcagcatcctgcaggacatgcgcaacaccatcatggcctccaagaccgtgggcaccgccgaggagaagctgaagaagaagtccagcttctaccagagctacctccgccggacgcagtccatggggatccagctggaccagcgcatcatcctgctctacatgctggagtggggcaaggagatggtggaccacttccacctgggcgacgacatggaccccgagctccgggggctggcgcaggccctgatcgaccagaaggtcaaggagatcagcaaccaggagcccctcaagatctga

SEQ ID NO: 6456 - RNA, 1302 nt, synthetic construct
  misc_feature 1..1302: note = derived and/or modified CDS sequence (opt1) from PUUV(Djaknebole_98-1)__AM746310.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagccgaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgaccggatccgcgagttcatggagaaggagtgccccttcatcaagcccgaggtgaagccggggacccccacccaggagatcgagttcctcaagaagaacaaggtgtacttcatggaccggcagaacgtcctggacaagaaccacgtggccgacatcgacaagctgatcgactacgccgcgagcggcgaccccacctcccccgacaacatcgagagcccgaacgccccctgggtgttcgcctgcgcccccgaccgctgcccgcccacgtgcatctacgtcgccggcatggcggagctcggggccttcttctccatcctgcaggacatgcggaacaccatcatggccagcaagaccgtgggcaccgccgaggagaagctgaagaagaagtccagcttctaccagtcctacctccgccgcacgcagagcatggggatccagctggaccagcggatcatcctgctctacatgctggagtggggcaaggagatggtggaccacttccacctgggcgacgacatggaccccgagctccgcgggctggcccaggcgctgatcgaccagaaggtcaaggagatcagcaaccaggaccccctcaagatctga

SEQ ID NO: 6457 - RNA, 1302 nt, synthetic construct
  misc_feature 1..1302: note = derived and/or modified CDS sequence (opt1) from PUUV(Fusong 114-05)__EF488804.1__N
  source 1..1302: mol_type = other RNA
atgagcgacctgaaggacatccaggaggacatcgcccgccacgagcagcagctcgtggtcgcccggcagaagctgcgcgacgcggagaaggccgtggagatggaccccgacgacgtgaacaagaacaccctgcaggcccggcagcagaccgtctccgccctcgaggacaagatcgccgacttcaagcgccggatggcggacatcgtgagccgcaagaagatggacacgaagccggccgaccccaccggcatcgagcccgacgaccacctgaaggagcggtccagcctgcgctacgggaacgtgctcgacgtcaacgccatcgacatcgaggagccctccggccagaccgccgactggtacaccatcggggtgtacatcatcgagttcacgctgccgatcatcctgaaggcgctctacatgctgagcacccggggccgccagaccgccaaggagaacaaggggacccggatccgcttcaaggacgacacgtccttcgaggacgtgaacggcatccggcgccccaagcacctgtacgtcagcatgcccaccgcccagtccaccatgaaggccgaggagctcacccccggccggttccgcacgatcgtgtgcgggctgttcccgacccagatccaggtgcggaacatcatgagccccgtcatgggcgtgatcgggttctccttcttcgccaaggactggcccgaccgcatcaaggagttcatggagaaggagtgccccttcatcaagccggaggtgaagcccggcacccccgcgaaggaggtcgagatcctgaagcggaacaagatctacttcatgcagcgccagggggtgctcgacaagaaccacgtgcccgacatcgacaagctgatcgactacgccgccagcggcgacccgaccagcccccggaacatcgactcccccaacgccccctgggtcttcgcctgcgcgccggaccgctgcccgcccacgtgcatctacgtggccggcatggccgagctgggggccttcttctccatcctccaggacatgcgcaacaccatcatggccagcaagaccgtgggcaccgcggaggagaagctgaagaagaagtccagcttctaccagtcctacctgcggcgcacgcagagcatggggatccagctcgaccagcggatcatcctgctgtacatgctcgagtggggcaaggagatggtcgaccacttccacctgggcgacgacatggaccccgagctgcgcagcctcgcccaggccctgatcgaccagaaggtgaaggagatctccaaccaggagcccctgaagatctga

SEQ ID NO: 6458 - RNA, 1302 nt, synthetic construct
  misc_feature 1..1302: note = derived and/or modified CDS sequence (opt1) from PUUV(Fusong 199-05)__EF488803.1__N
  source 1..1302: mol_type = other RNA
atgagcgacctgaaggacatccaggaggacatcgcccgccacgagcagcagctcgtggccgcgcggcagaagctgcgcgacgccgagaaggccgtcgagatggaccccgacgacgtgaacaagaacaccctgcaggcccggcagcagaccgtgtccgccctcgaggacaagatcgcggacttcaagcgccggatggccgacatcgtcagccgcaagaagatggacacgaagccggccgaccccaccggcatcgagcccgacgaccacctgaaggagcggtccagcctgcgctacgggaacgtgctcgacgtgaacgccatcgacatcgaggagccctccggccagaccgcggactggtacaccatcggggtctacatcatcggcttcacgctgccgatcatcctgaaggccctctacatgctgagcacccgggggcgccagaccgtgaaggagaacaagggcacccggatccgcttcaaggacgacacgtccttcgaggacgtgaacggcatccggcgccccaagcacctgtacgtcagcatgcccaccgcccagtccaccatgaaggccgaggagctcacccccgggcggttccgcacgatcgtgtgcggcctgttcccgacccagatccaggtgcggaacatcatgagccccgtcatgggggtgatcggcttctccttcttcgccaaggactggcccgaccgcatcaaggagttcatggagaaggagtgccccttcatcaagccggaggtgaagcccgggacccccgcgaaggaggtcgagatcctgaagcggaacaagatctacttcatgcagcgccaggacgtgctcgacaagaaccacgtgcccgacatcgacaagctgatcgactacgccgccagcggcgacccgacctcccccgagaacatcgacagccccaacgccccctgggtcttcgcctgcgcgccggaccggtgcccgcccacgtgcatctacgtggccggcatggccgagctgggggccttcttctccatcctccaggacatgcgcaacaccatcatggccagcaagaccgtgggcaccgcggaggagaagctgaagaagaagtccagcttctaccagtcctacctgcgccggacgcagagcatggggatccagctcgaccagcgcatcatcctgctgtacatgctcgagtggggcaaggagatggtcgaccacttccacctgggcgacgacatggaccccgagctgcggagcctcgcccaggccctgatcgaccagaaggtgaaggagatctccaaccaggagcccctgaagatctga

SEQ ID NO: 6459 - RNA, 1302 nt, synthetic construct
  misc_feature 1..1302: note = derived and/or modified CDS sequence (opt1) from PUUV(Fusong 200-05)__EF211820.1__N
  source 1..1302: mol_type = other RNA
atgagcgacctgaaggacatccaggaggacatcgcccgccacgagcagcagctcgtggtcgcccggcagaagctgcgcgacgcggagaaggccgtggagatggaccccgacgacgtgaacaagaacaccctgcaggcccggcagcagaccgtctccgccctcgaggacaagatcgccgacttcaagcgccggatggcggacatcgtgagccgcaagaagatggacacgaagccggccgaccccaccggcatcgagcccgacgaccacctgaaggagcggtccagcctgcgctacgggaacgtgctcgacgtcaacgccatcgacatcgaggagccctccggccagaccgccgactggtacaccatcggggtgtacatcatcggcttcacgctgccgatcatcctgaaggcgctctacatgctgagcacccgggggcgccagaccgtgaaggagaacaagggcacccggatccgcttcaaggacgacacgtccttcgaggacgtcaacggcatccggcgccccaagcacctgtacgtgagcatgcccaccgcccagtccaccatgaaggccgaggagctcacccccgggcggttccgcacgatcgtgtgcggcctgttcccgacccagatccaggtccggaacatcatgagccccgtgatgggggtgatcggcttctccttcttcgccaaggactggcccgaccgcatcaaggagttcatggagaaggagtgccccttcatcaagccggaggtcaagcccgggacccccgccaaggaggtggagatcctgaagcggaacaagatctacttcatgcagcgccaggacgtgctcgacaagaaccacgtccccgacatcgacaagctgatcgactacgcggccagcggcgacccgacctcccccgagaacatcgacagccccaacgccccctgggtgttcgcctgcgccccggaccggtgcccgcccacgtgcatctacgtggcgggcatggccgagctgggggccttcttctccatcctccaggacatgcgcaacaccatcatggccagcaagaccgtcggcaccgccgaggagaagctgaagaagaagtccagcttctaccagtcctacctgcgccggacgcagagcatggggatccagctcgaccagcgcatcatcctgctgtacatgctcgagtggggcaaggagatggtggaccacttccacctgggcgacgacatggaccccgagctgcggagcctcgcgcaggccctgatcgaccagaaggtgaaggagatctccaaccaggagcccctgaagatctga

SEQ ID NO: 6460 - RNA, 1302 nt, synthetic construct
  misc_feature 1..1302: note = derived and/or modified CDS sequence (opt1) from PUUV(Fusong 900-06)__EF488806.1__N
  source 1..1302: mol_type = other RNA
atgagcgacctgaaggacatccaggaggacatcgcccgccacgagcagcagctcgtggtcgcccggcagaagctgcgcgacgcggagaaggccgtggagatggaccccgacgacgtgaacaagaacaccctgcaggcccggcagcagaccgtctccgccctcgaggacaagatcgccgacttcaagcgccggatggcggacatcgtgagccgcaagaagatggacacgaagccggccgaccccaccggcatcgagcccgacgaccacctgaaggagcggtccagcctgcgctacgggaacgtgctcgacgtcaacgccatcgacatcgaggagccctccggccagaccgccgactggtacaccatcggggtgtacatcatcggcttcacgctgccgatcatcctgaaggcgctctacatgctgagcacccgggggcgccagaccgtgaaggagaacaagggcacccggatccgcttcaaggacgacacgtccttcgaggacgtcaacggcatccggcgccccaagcacctgtacgtgagcatgcccaccgcccagtccaccatgaaggccgaggagctcacccccgggcggttccgcacgatcgtgtgcggcctgttcccgacccagatccaggtccggaacatcatgagccccgtgatgggggtgatcggcttctccttcttcgccaaggactggcccgaccgcatcaaggagttcatggagaaggagtgccccttcatcaagccggaggtcaagcccgggacccccgccaaggaggtggagatcctgaagcggaacaagatctacttcatgcagcgccgggacgtgctcgacaagaaccacgtccccgacatcgacaagctgatcgactacgcggccagcggcgacccgacctcccccgagaacatcgacagccccaacgccccctgggtgttcgcctgcgccccggaccgctgcccgcccacgtgcatctacgtggcgggcatggccgagctgggggccttcttctccatcctccaggacatgcgcaacaccatcatggccagcaagaccgtcggcaccgccgaggagaagctgaagaagaagtccagcttctacaagtcctacctgcggcgcacgcagagcatggggatccagctcgaccagcggatcatcctgctgtacatgctcgagtggggcaaggagatggtggaccacttccacctgggcgacgacatggaccccgagctgcgcagcctcgcgcaggccctgatcgaccagaaggtgaaggagatctccaaccaggagcccctgaagatctga

SEQ ID NO: 6461 - RNA, 1302 nt, synthetic construct
  misc_feature 1..1302: note = derived and/or modified CDS sequence (opt1) from PUUV(Gumboda_98-2)__AM746316.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagccgaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgaccggatccgcgagttcatggagaaggagtgccccttcatcaagcccgaggtgaagccggggacccccacccaggagatcgagttcctcaagaagaacaaggtgtacttcatggaccggcagaacgtcctggagaagaaccacgtggccgacatcgacaagctgatcgactacgccgcgagcggcgaccccacctcccccgacaacatcgagagcccgaacgccccctgggtgttctcctgcgcccccgaccgctgcccgcccacgtgcatctacgtcgccggcatggccgagctcggggcgttcttcagcatcctgcaggacatgcggaacaccatcatggcctccaagaccgtgggcaccgccgaggagaagctgaagaagaagtccagcttctaccagagctacctccgccgcacgcagagcatggggatccagctggaccagcggatcatcctgctctacatgctggagtggggcaaggagatggtggaccacttccacctgggcgacgacatggaccccgagctccgcgggctggcccaggccctgatcgaccagaaggtcaaggagatctccaaccaggaccccctcaagatctga

SEQ ID NO: 6462 - RNA, 1302 nt, synthetic construct
  misc_feature 1..1302: note = derived and/or modified CDS sequence (opt1) from PUUV(Gumboda_98-4)__AM746318.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagccgaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgaccggatccgcgagttcatggagaaggagtgccccttcatcaagcccgaggtgaagccggggacccccacccaggagatcgagttcctcaagaagaacaaggtgtacttcatggaccggcagaacgtcctggacaagaaccacgtggccgacatcgacaagctgatcgactacgccgcgagcggcgaccccacctcccccgacaacatcgagagcccgaacgccccctgggtgttctcctgcgcccccgaccgctgcccgcccacgtgcatctacgtcgccggcatggccgagctcggggcgttcttcagcatcctgcaggacatgcggaacaccatcatggcctccaagaccgtgggcaccgccgaggagaagctgaagaagaagtccagcttctaccagagctacctccgccgcacgcagagcatggggatccagctggaccagcggatcatcctgctctacatgctggagtggggcaaggagatggtggaccacttccacctgggcgacgacatggaccccgagctccgcgggctggcccaggccctgatcgaccagaaggtcaaggagatctccaaccaggaccccctcaagatctga

SEQ ID NO: 6463 - RNA, 1302 nt, synthetic construct
  misc_feature 1..1302: note = derived and/or modified CDS sequence (opt1) from PUUV(Kamiiso-8Cr-95)__AB010730.1__N
  source 1..1302: mol_type = other RNA
atgagcgacctgaaggacatccaggaggacatcacccgccacgagcagcagctcgtggtcgcccggcagaagctgcgcgacgccgagaaggcggtggagatggaccccgacgacgtgaacaagaacaccctgcaggcccggcagcagacggtctccgccctcgaggacaagctggccgacttcaagcgccggatggccgacgtggtgagccgcaagaagatggacaccaagcccgcggaccccaccggcatcgagcccgacgaccacctgaaggagcggtccagcctccgctacgggaacgtcctggacgtgaacgccatcgacatcgaggagccctccggccagaccgccgactggtacacgatcggggtgtacatcatcggcttcaccctgccgatcatcctcaaggccctgtacatgctgagcacccgggggcgccagaccgtcaaggagaacaagggcacgcggatccgcttcaaggacgacacctccttcgaggacatcaacggcatccggcgccccaagcacctctacgtgagcatgcccaccgcgcagtccaccatgaaggccgaggagatcacgcccgggcggttccgcaccatcgtgtgcggcctgttcccgacccagatccaggtccggaacatcatgagccccgtgatgggggtgatcggcttctccttcttcgtcaaggactggcccgagcgcatcaaggagttcatggagaaggagtgccccttcatcaagccggaggtgaagcccgggacccccgccaaggaggtggagatcctgaagcggaacaaggtctacttcatgcagcgccaggacgtgctcgacaagaaccacgtgcccgacatcgacaagctgatcgactacgccgccagcggcgacccgacgtcccccgacaacatcgacagccccaacgcgccctgggtcttcgcctgcgccccggaccggtgcccgccgacctgcatctacgtggccggcatggccgagctgggggcgttcttctccatcctccaggacatgcgcaacaccatcatggccagcaagaccgtgggcacggccgaggagaagctgaagaagaagtccagcttctaccagtcctacctgcgccggacccagagcatggggatccagctcgaccagcgcatcatcctgctgtacatgctcgagtggggcaaggagatggtcgaccacttccacctgggcgacgacatggaccccgagctgcgggggctcgcccaggccctgatcgaccagaaggtgaaggagatcagcaaccaggagcccctgaagatctga

SEQ ID NO: 6464 - RNA, 1302 nt, synthetic construct
  misc_feature 1..1302: note = derived and/or modified CDS sequence (opt1) from PUUV(Mu/07/1219)__KJ994776.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgactacaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgagcggatccgcgagttcatggagaaggagtgccccttcatcaagcccgaggtgaagccggggacccccgcccaggaggccgagttcctcaagcggaacaaggtgtacttcatgcagcgccaggacgtcctggacaagaaccacgtggcggacatcgacaagctgatcgactacgccgccagcggcgaccccacctcccccgacaacatcgagagcccgaacgccccctgggtgttcgcctgcgcgcccgaccggtgcccgccgacctgcatctacgtcgccggcatggccgagctcggggccttcttctccatcctgcaggacatgcgcaacacgatcatggccagcaagaccgtgggcaccgcggaggagaagctgaagaagaagtccagcttctaccagtcctacctccgccggacccagagcatggggatccagctggaccagcgcatcatcctgctctacatgctggagtggggcaaggagatggtggaccacttccacctgggcgacgacatggaccccgagctccgggggctggcccaggccctgatcgaccagaaggtcaaggagatcagcaaccaggagcccctcaagatctga

SEQ ID NO: 6465 - RNA, 1302 nt, synthetic construct
  misc_feature 1..1302: note = derived and/or modified CDS sequence (opt1) from PUUV(Opina916)__AF294652.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagcccgtggaccccaccggcatcgagcccgacgaccacctgaaggagcgctccagcctccggtacgggaacgtcctggacgtgaacgccatcgacatcgaggagccctccggccagacggccgactggtacaccatcggggtgtacgtcatcggcttcaccctgccgatcatcctcaaggccctgtacatgctgagcacccgcgggcggcagacggtgaaggagaacaagggcacccgcatccggttcaaggacgacacctccttcgaggacatcaacggcatccgccggcccaagcacctctacgtgagcatgcccaccgcgcagtccacgatgaaggccgaggagctgacccccgggcgcttccggaccatcgtctgcggcctgttcccgacccagatccaggtgcgcaacatcatgagccccgtgatgggggtcatcggcttctccttcttcgtgaaggactgggccgagcggatccgcgagttcatggagaaggagtgccccttcatcaagcccgaggtgaagccggggacgcccgcccaggaggccgagttcctcaagaagaaccggatctacttcatgcagcgccaggaggtcctggacaagaaccacgtggcggacatcgacaagctgatcgactacgccgccagcggcgaccccacctcccccgacaacatcgagagcccgaacgccccctgggtgttcgcctgcgcgcccgaccggtgcccgccgacctgcatctacgtcgccggcatggccgagctcggggccttcttctccatcctgcaggacatgcgcaacaccatcatggccagcaagacggtgggcaccgcggaggagaagctgaagaagaagtccagcttctaccagtcctacctccgccggacccagagcatggggatccagctggaccagcgcatcatcctgctctacatgctggagtggggcaaggagatggtggaccacttccacctgggcgacgacatggaccccgagctccgggggctggcccaggccctgatcgaccagaaggtcaaggagatcagcaaccaggagcccctcaagatctga

SEQ ID NO: 6466 - RNA, 1302 nt, synthetic construct
  misc_feature 1..1302: note = derived and/or modified CDS sequence (opt1) from PUUV(Palbole_98-1)__AM746327.1__N
  source 1..1302: mol_type = other RNA
atgagcgacctgaccgacatccaggaggacatcacgtgccacgagcagcagctcgtggtcgcccgccagaagctgaaggacgccgagaaggcggtggagatggaccccgacgacgtgaacaagaacaccctgcaggcccggcagcagaccgtctccgccctcgaggacaagctggccgacttcaagcgccggatggccgacgcggtgagccgcaagaagatggacaccaagccgaccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgggggcgccagaccgtcaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtgtgcggcctgttcccgacgcagatccaggtccggaacatcatgagccccgtgatgggggtgatcggcttctccttcttcgtcaaggactgggccgaccgcatccgggagttcatggagaaggagtgccccttcatcaagcccgaggtgaagccggggacccccacccaggagatcgagttcctcaagaagaacaaggtgtacttcatggaccgccagaacgtcctggacaagaaccacgtggccgacatcgacaagctgatcgactacgccgcgagcggcgaccccacctcccccgacaacatcgagagcccgaacgccccctgggtgttcgcctgcgcccccgaccggtgcccgcccacgtgcatctacgtcgccggcatggcggagctcggggccttcttctccatcctgcaggacatgcgcaacaccatcatggccagcaagaccgtgggcaccgccgaggagaagctgaagaagaagtccagcttctaccagtcctacctccggcgcacgcagagcatggggatccagctggaccagcgcatcatcctgctctacatgctggagtggggcaaggagatggtggaccacttccacctgggcgacgacatggaccccgagctccgggggctggcccaggcgctgatcgaccagaaggtcaaggagatcagcaaccaggaccccctcaagatctga

SEQ ID NO: 6467 - RNA, 1302 nt, synthetic construct
  misc_feature 1..1302: note = derived and/or modified CDS sequence (opt1) from PUUV(Palbole_98-2)__AM746328.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagccgaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgaccggatccgcgagttcatggagaaggagtgccccttcatcaagcccgaggtgaagccggggacccccacccaggagatcgagttcctcaagaagaacaaggtgtacttcatggaccggcagaacgtcctggacaagaaccacgtggccgacatcgacaagctgatcgactacgccgcgagcggcgaccccacctcccccgacaacatcgagagcccgaacgccccctgggtgttcgcctgcgcccccgaccgctgcccgcccacgtgcatctacgtcgccggcatggcggagctcggggccttcttctccatcctgcaggacatgcggaacaccatcatggccagcaagaccgtgggcaccgccgaggagaagctgaagaagaagtccagcttctaccagtcctacctccgccgcacgcagagcatggggatccagctggaccagcggatcatcctgctctacatgctggagtggggcaaggagatggtggaccacttccacctgggcgacgacatggaccccgagctccgcgggttcgcccaggcgctgatcgaccagaaggtcaaggagatcagcaaccaggaccccctgaagatctga

SEQ ID NO: 6468 - RNA, 1302 nt, synthetic construct
  misc_feature 1..1302: note = derived and/or modified CDS sequence (opt1) from PUUV(Palbole_98-3)__AM746329.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagccgaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgaccggatccgcgagttcatggagaaggagtgccccttcatcaagcccgaggtgaagccggggacccccacccaggagatcgagttcctcaagaagaacaaggtgtacttcatggaccggcagaacgtcctggacaagaaccacgtggccgacatcgacaagctgatcgactacgccgcgagcggcgaccccacctcccccgacagcatcgagtccccgaacgccccctgggtgttcgcctgcgcccccgaccgctgcccgcccacgtgcatctacgtcgccggcatggcggagctcggggccttcttcagcatcctgcaggacatgcggaacaccatcatggcctccaagaccgtgggcaccgccgaggagaagctgaagaagaagtccagcttctaccagagctacctccgccgcacgcagagcatggggatccagctggaccagcggatcatcctgctctacatgctggagtggggcaaggagatggtggaccacttccacctgggcgacgacatggaccccgagctccgcgggctggcccaggcgctgatcgaccagaaggtcaaggagatctccaaccaggaccccctcaagatctga

SEQ ID NO: 6469 - RNA, 1302 nt, synthetic construct
  misc_feature 1..1302: note = derived and/or modified CDS sequence (opt1) from PUUV(PUUV/Ardennes/Mg156/2011)__KT247592.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcagatggccgacgcggtgagccgcaagaagatggacaccaagcccaccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgggggcgccagaccgtcaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtgtgcggcctgttcccgacgcagatccaggtccggaacatcatgagccccgtgatgggggtgatcggcttctccttcttcgtcaaggactgggccgaccgcatccgggagttcatggagaaggagtgccccttcatcaagcccgaggtgaagccggggacccccgcccaggaggtggagttcctcaagcgcaacaagatctacttcatgcagcggcaggacgtcctggacaagaaccacgtggccgacatcgacaagctgatcgactacgcggccagcggcgaccccacctcccccgacaacatcgaggccccgaacgccccctgggtgttcgcctgcgcgcccgaccgctgcccgccgacctgcatctacgtcgccggcatggccgagctcggggccttcttcagcatcctgcaggacatgcggaacacgatcatggcctccaagaccgtgggcaccgcggaggagaagctgaagaagaagtccagcttctaccagagctacctccgccgcacccagtccatggggatccagctggaccagcggatcatcctgctctacatgctggagtggggcaaggagatggtggaccacttccacctgggcgacgacatggaccccgagctccgcgggctggcccaggccctgatcgaccagaaggtcaaggagatcagcaaccaggagcccctcaagatctga

SEQ ID NO: 6470 - RNA, 1302 nt, synthetic construct
  misc_feature 1..1302: note = derived and/or modified CDS sequence (opt1) from PUUV(PUUV/Jelgava/Mg136/2008)__JN657230.1__N
  source 1..1302: mol_type = other RNA
atgagcgacctggccgacatccaggaggacatcacccgccacgagcagcagctcgtggtcgcccggcagaagctgaaggacgcggagcgcgccgtggaggtggaccccgacgacgtcaacaagaacaccctgcaggcccggcagcagacggtgtccgccctcgaggacaagctggccgactacaagcgccggatggcggacgccgtgagccgcaagaagatggacaccaagcccgccgaccccaccggcatcgagcccgacgaccacctgaaggagcggtccagcctccgctacgggaacgtcctggacgtgaacgccatcgacatcgaggagccctccggccagaccgcggactggtacacgatcggggtgtacgtcatcggcttcaccctgccgatcatcctcaaggccctgtacatgctgagcacccgggggcgccagaccgtgaaggagaacaagggcacgcggatccgcttcaaggacgacacctccttcgaggacatcaacggcatccggcgccccaagcacctctacgtgagcatgcccaccgcccagtccaccatgaaggccgaggagctgacgcccgggcggttccgcaccgtcgtgtgcggcctgttcccgacccagatccaggtgcggaacatcatgagccccgtcatgggggtgatcggcttctccttcttcgtgaaggactggcccgaccgcatcaaggagttcatggagaaggagagccccttcatcaagccggacgtcaagcccgggacccccgcccaggaggtggagttcctcaagcggaacaaggtgtacttcatgaaccgccaggacgtcctggacaagaaccacgtggcggacatcgacaagctgatcgactacgccgcctccggcgaccccacgagcccggacgacatcgagtcccccaacgccccctgggtgttcgcctgcgcgcccgaccggtgcccgccgacctgcatctacgtcgccggcatggccgagctcggggccttcttcagcatcctgcaggacatgcgcaacaccatcatggcctccaagaccgtgggcacggcggaggagaagctgaagaagaagtccagcttctaccagagctacctccgccggacccagagcatggggatccagctggaccagcgcatcatcctgctctacatgctggagtggggcaaggagatggtcgaccacttccacctgggcgacgacatggaccccgagctccgggggctggcccaggccctgatcgaccagaaggtgaaggagatctccaaccaggagcccctcaagatctga

SEQ ID NO: 6471 - RNA, 1302 nt, synthetic construct
  misc_feature 1..1302: note = derived and/or modified CDS sequence (opt1) from PUUV(PUUV/Jelgava/Mg140/2008)__JN657231.1__N
  source 1..1302: mol_type = other RNA
atgagcgacctggccgacatccaggaggacatcacccgccacgagcagcagctcgtggtcgcccggcagaagctgaaggacgcggagcgcgccgtggaggtggaccccgacgacgtcaacaagaacaccctgcaggcccggcagcagacggtgtccgccctcgaggacaagctggccgactacaagcgccggatggcggacgccgtgagccgcaagaagatggacaccaagcccgccgaccccaccggcatcgagcccgacgaccacctgaaggagcggtccagcctccgctacgggaacgtcctggacgtgaacgccatcgacatcgaggagccctccggccagaccgcggactggtacacgatcggggtgtacgtcatcggcttcaccctgccgatcatcctcaaggccctgtacatgctgagcacccgggggcgccagaccgtgaaggagaacaagggcacgcggatccgcttcaaggacgacacctccttcgaggacatcaacggcatccggcgccccaagcacctctacgtgagcatgcccaccgcccagtccaccatgaaggccgaggagctgacgcccgggcggttccgcaccgtcgtgtgcggcctgttccacacccagatccaggtgcggaacatcatgagcccggtcatgggggtgatcggcttctccttcttcgtgaaggactggcccgaccgcatcaaggagttcatggagaaggagtgccccttcatcaagcccgacgtcaagccggggacccccgcccaggaggtggagttcctcaagcggaacaaggtgtacttcatgaaccgccaggacgtcctggacaagaaccacgtggcggacatcgacaagctgatcgactacgccgccagcggcgaccccacgtcccccgacgacatcgagagcccgaacgccccctgggtgttcgcctgcgcgcccgaccggtgcccgccgacctgcatctacgtcgccggcatggccgagctcggggccttcttctccatcctgcaggacatgcgcaacaccatcatggccagcaagaccgtgggcacggcggaggagaagctgaagaagaagtccagcttctaccagtcctacctccgccggacccagagcatggggatccagctggaccagcgcatcatcctgctctacatgctggagtggggcaaggagatggtcgaccacttccacctgggcgacgacatggaccccgagctccgggggctggcccaggccctgatcgaccagaaggtgaaggagatcagcaaccaggagcccctcaagatctga

SEQ ID NO: 6472 - RNA, 1302 nt, synthetic construct
  misc_feature 1..1302: note = derived and/or modified CDS sequence (opt1) from PUUV(PUUV/Jura/Mg2/2010)__KT247596.2__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgaccggatccgcgagttcatggagaaggagtgccccttcatcaagcccgagatcaagccggggacccccgcccaggaggccgagttcctcaagcggaacaagatctacttcatgcagcgccaggacgtgctggacaagaaccacgtggcggacatcgacaagctgatcgactacgccgccagcggcgaccccacctcccccgacaacatcgagagcccgaacgccccctgggtcttcgcctgcgcgcccgaccggtgcccgccgacctgcatctacgtggccggcatggccgagctcggggccttcttctccatcctgcaggacatgcgcaacacgatcatggccagcaagaccgtgggcaccgcggaggagaagctgaagaagaagtccagcttctaccagtcctacctccgccggacccagagcatggggatccagctggaccagcgcatcatcctgctctacatgctggagtggggcaaggagatggtcgaccacttccacctgggcgacgacatggaccccgagctccgggggctggcccaggccctgatcgaccagaaggtgaaggagatcagcaaccaggagcccctcaagatctga

SEQ ID NO: 6473 - RNA, 1302 nt, synthetic construct
  misc_feature 1..1302: note = derived and/or modified CDS sequence (opt1) from PUUV(PUUV/Madona/Mg233/2008)__JN657232.1__N
  source 1..1302: mol_type = other RNA
atgagcgacctggccgacatccaggaggacatcacccgccacgagcagcagctcgtggtcgcccggcagaagctgaaggacgcggagcgcgccgtggaggtggaccccgacgacgtcaacaagaacaccctgcaggcccggcagcagacggtgtccgccctcgaggacaagctggccgactacaagcgccggatggcggacgccgtgagccgcaagaagatggacaccaagcccaccgaccccaccggcatcgagcccgacgaccacctgaaggagcggtccagcctccgctacgggaacgtcctggacgtgaacgccatcgacatcgaggagccctccggccagacggccgactggtacaccatcggggtgtacgtcatcagcttcaccctgccgatcatcctcaaggcgctgtacatgctgtccacccggggccgccagacggtgaaggagaacaaggggacccggatccgcttcaaggacgacaccagcttcgaggacatcaacggcatccggcgccccaagcacctctacgtgtccatgcccaccgcccagagcacgatgaaggccgaggagctgacccccggccggttccgcaccatcgtctgcgggctgttcccgacccagatccaggtgcggaacatcatgtcccccgtgatgggcgtcatcgggttcagcttcttcgtgaaggactggcccgaccgcatcaaggagttcatggagaaggagtgccccttcatcaagccggacgtgaagcccggcacgcccgcccaggagatcgagttcctcaagcggaacaaggtctacttcatgaaccgccaggacgtgctggacaagaaccacgtggccgacatcgacaagctgatcgactacgcggcctccggggaccccaccagcccggacgacatcgagtcccccaacgccccctgggtcttcgcctgcgcccccgaccggtgcccgccgacctgcatctacgtggcgggcatggccgagctcggcgccttcttcagcatcctgcaggacatgcgcaacaccatcatggcctccaagacggtggggaccgccgaggagaagctgaagaagaagtccagcttctaccagagctacctccgccggacccagagcatgggcatccagctggaccagcgcatcatcctgctctacatgctggagtgggggaaggagatggtcgaccacttccacctgggcgacgacatggaccccgagctccggggcctggcgcaggccctgatcgaccagaaggtgaaggagatctccaaccaggagcccctcaagatctga

SEQ ID NO: 6474 - RNA, 1302 nt, synthetic construct
  misc_feature 1..1302: note = derived and/or modified CDS sequence (opt1) from PUUV(PUUV/Orleans/Mg23/2010)__KT247594.1__N
  source 1..1302: mol_type = other RNA
atgagcgacctgaccgacatccaggaggtgatcacccgccacgagcagcagctcgtcgtggcccggcagaagctgaaggacgccgagaaggcggtggagatggaccccgacgacgtcaacaagaacacgctgcaggcccgccagcagaccgtgtccgccctcgaggacaagctggccgacttcaagcggcgcatggccgacgcggtgagccggaagaagatggacaccaagcccgccgaccccaccggcatcgagcccgacgaccacctgaaggagcgctccagcctccggtacgggaacgtcctggacgtgaacgccatcgacatcgaggagccctccggccagacggccgactggtacaccatcggggtgtacgtcatcggcttcaccctgccgatcatcctcaaggcgctgtacatgctgagcacccgcgggcggcagacggtgaaggagaacaagggcacccgcatccggttcaaggacgacacctccttcgaggacatcaacggcatccgccggcccaagcacctctacgtgagcatgcccaccgcccagtccacgatgaaggccgaggagctgacccccgggcgcttccggaccatcgtctgcggcctgttcccgacccagatccaggtgcgcaacatcatgagccccgtgatgggggtcatcggcttctccttcttcgtgaaggactgggccgaccggatcaaggagttcatggagaaggagtgccccttcatcaagcccgaggtgaagccggggacgcccgtcaaggaggccgagttcctcaagaagaaccgcgtgtacttcatgcagcggcaggacgtgctggacaagaaccacgtcgcggacatcgacaagctgatcgactacgccgccgccggcgaccccaccagccccgacaacatcgagtccccgaacgccccctgggtgttcgcgtgcgcccccgaccgctgcccgccgacctgcatctacgtggccggcatggccgagctcggggccttcttcagcatcctgcaggacatgcggaacaccatcatggcgtccaagacggtcggcaccgccgaggagaagctgaagaagaagtccagcttctaccagagctacctccgccgcacccagtccatggggatccagctggaccagcggatcatcctgctctacatgctggagtggggcaaggagatggtggaccacttccacctgggcgacgacatggaccccgagctccgcgggctggcccaggccctgatcgaccagaaggtcaaggagatcagcaaccaggagcccctcaagatctga

SEQ ID NO: 6475 - RNA, 1302 nt, synthetic construct
  misc_feature 1..1302: note = derived and/or modified CDS sequence (opt1) from PUUV(Tobetsu-60Cr-93)__AB010731.1__N
  source 1..1302: mol_type = other RNA
atgagcgacctgaaggacatccaggaggacatcacccgccacgagcagcagctcgtggtcgcccggcagaagctgcgcgacgccgagaaggcggtggagatggaccccgacgacgtgaacaagaacaccctgcaggcccggcagcagacggtctccgccctcgaggacaagctggccgacttcaagcgccggatggccgacgtggtgagccgcaagaagatggacaccaagcccgcggaccccaccggcatcgagcccgacgaccacctgaaggaccggtccagcctccgctacgggaacgtcctggacgtgaacgccatcgacatcgaggagccctccggccagaccgccgactggtacacgatcggggtgtacatcatcggcttcaccctgccgatcatcctcaaggccctgtacatgctgagcacccgggggcgccagaccgtcaaggagaacaagggcacgcggatccgcttcaaggacgacacctccttcgaggacatcaacggcatccggcgccccaagcacctctacgtgagcatgcccaccgcgcagtccaccatgaaggccgaggagatcacgcccgggcggttccgcaccatcgtgtgcggcctgttcccgacccagatccaggtccggaacatcatgagccccgtgatgggggtgatcggcttctccttcttcgtcaaggactggcccgagcgcatcaaggagttcatggagaaggagtgccccttcatcaagccggaggtgaagcccgggacccccgccaaggaggtggagatcctgaagcggaacaaggtctacttcatgcagcgccaggacgtgctcgacaagaaccacgtgcccgacatcgacaagctgatcgactacgccgccagcggcgacccgacgtcccccgacaacatcgacagccccaacgcgccctgggtcttcgcctgcgccccggaccggtgcccgccgacctgcatctacgtggccggcatggccgagctgggggcgttcttctccatcctccaggacatgcgcaacaccatcatggccagcaagaccgtgggcacggccgaggagaagctgaagaagaagtccagcttctaccagtcctacctgcgccggacccagagcatggggatccagctcgaccagcgcatcatcctgctgtacatgctcgagtggggcaaggagatggtcgaccacttccacctgggcgacgacatggaccccgagctgcgggggctcgcccaggccctgatcgaccagaaggtgaaggagatcagcaaccaggagcccctgaagatctga

SEQ ID NO: 6476 - RNA, 1302 nt, synthetic construct
  misc_feature 1..1302: note = derived and/or modified CDS sequence (opt1) from PUUV(Vranica)__U14137.1__N
  source 1..1302: mol_type = other RNA
atgagcgacctgaccgacatccaggaggacatcacccgccacgagcagcagctcgtggtcgcccggcagaagctgaaggacgccgagaaggcggtggagatgtaccccgacgacgtgaacaagaacacgctgcaggcccgccagcagaccgtctccgccctcgaggacaagctggccgacttcaagcggcgcatggccgacgcggtgagccggaagaagatggacaccaagccgaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgctaccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgaccggatccgcgagttcatggagaaggagtgccccttcatcaagcccgaggtgaagccggggacccccacccaggagatcgagttcctcaagaagaacaaggtgtacttcatggaccggcagaacgtcctggacaagaaccacgtggccgacatcgacaagctgatcgactacgccgcgagcggcgaccccacctcccccgacaacatcgagagcccgaacgccccctgggtgttcgcctgcgcccccgaccgctgcccgcccacgtgcatctacgtcgccggcatggcggagctcggggccttcttctccatcctgcaggacatgcggaacaccatcatggccagcaagaccgtgggcaccgccgaggagaagctgaagaagaagtccagcttctaccagtcctacctccgccgcacgcagagcatggggatccagctggaccagcggatcatcctgctctacatgctggagtggggcaaggagatggtggaccacttccacctgggcgacgacatggaccccgagctccgcgggctggcccaggcgctgatcgaccagaaggtcaaggagatcagcaaccaggaccccctcaagatctga

SEQ ID NO: 6477 - RNA, 1302 nt, synthetic construct
  misc_feature 1..1302: note = derived and/or modified CDS sequence (opt1) from PUUV(P360)__L11347.1__N
  source 1..1302: mol_type = other RNA
atgagcgacctgaccgacatccaggaggagatcacccgccacgagcagcagctcgtggtcgcccggcagaagctgaaggacgccgagcgcgcggtggaggtgtaccccgacgacgtcaacaagaacacgctgcaggcccggcagcagaccgtgtccgccctcgaggacaagctggccgactacaagcgccggatggccgacgcggtgagccgcaagaagatggacaccaagccgaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccatcccgatcatcctgaaggccctctacatgctgagcacgcgggggcgccagaccgtgaaggagaacaagggcacccggatccgcttcaaggacgacacctccttcgaggacatcaacggcatccggcgccccaagcacctgtacgtgagcatgcccacggcgcagtccaccatgaaggccgaggagctcacccccgggcggttccgcaccatcgtctgcggcctgttcccgacgcagatccaggtgcggaacatcatgagccccgtgatgggggtcatcggcttctccttcttcgtgaaggactggcccgagaagatccgcgagttcatggagaaggagtgccccttcatcaagccggaggtgaagcccgggacccccgcccaggaggtcgagttcctgaagcggaaccgcgtgtacttcatgacccggcaggacgtgctcgacaagaaccacgtcgccgacatcgacaagctgatcgactacgccgcgagcggcgaccccacctccccggacgacatcgagagccccaacgccccctgggtgttcgcctgcgcccccgaccgctgcccgcccacgtgcatctacgtggccggcatggcggagctgggggccttcttctccatcctccaggacatgcgcaacaccatcatggccagcaagaccgtcggcaccgccgaggagaagctgaagaagaagtccagcttctaccagtcctacctgcggcgcacgcagagcatggggatccagctcgaccagcggatcatcctgctgtacatgctcgagtggggcaaggagatggtggaccacttccacctgggcgacgacatggaccccgagctgcgcgggctcgcccagagcctgatcgaccagaaggtcaaggagatctccaaccaggagcccctgaagatctga

SEQ ID NO: 6478 - RNA, 1302 nt, synthetic construct
  misc_feature 1..1302: note = derived and/or modified CDS sequence (opt1) from PUUV(Aijajarvi/Mg7/05)__GQ339476.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcagatggccgacgcggtgagccgcaagaagatggacaccaagccgaccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgggggcgccagaccgtcaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtgtgcggcctgttcccgacgcagatccaggtccggaacatcatgagccccgtgatgggggtgatcggcttctccttcttcgtcaaggggtgggccgaccgcatccgggagttcatggagaaggagtgccccttcatcaagcccgaggtgaagccgggcacccccacccaggaggtggagttcctcaagaagaacaaggtctacttcctggaccgccagaacgtgctggacaagaaccacgtggccgacatcgacaagctcatcgactacgccgcgagcggcgaccccacctcccccgacaacatcgagagcccgaacgccccctgggtcttcgcctgcgcccccgaccggtgcccgcccacgtgcatctacgtggccgggatggcggagctgggcgccttcttctccatcctgcaggacatgcgcaacaccatcatggccagcaagaccgtggggaccgccgaggagaagctcaagaagaagtccagcttctaccagtcctacctgcggcgcacgcagagcatgggcatccagctggaccagcgcatcatcctcctgttcatgctggagtggggcaaggagatggtcgaccacttccacctcggggacgacatggaccccgagctgcggggcctggcccaggcgctcatcgaccagaaggtgaaggagatcagcaaccaggagcccctgaagatctga

SEQ ID NO: 6479 - RNA, 1302 nt, synthetic construct
  misc_feature 1..1302: note = derived and/or modified CDS sequence (opt1) from PUUV(Bavaria 151/05)__EU439968.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgactacaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgagcggatccgcgagttcatggagaaggagtgccccttcctcaagcccgagatcaagccggggacccccgcccaggaggccgagttcctgaagaagaacaaggtgtacttcatgcagcggcaggacgtgctggacaagaaccacgtcgcggacatcgacaagctcatcgactacgccgccagcggcgaccccacctcccccgacaacatcgagagcccgaacgccccctgggtgttcgcctgcgcgcccgaccgctgcccgccgacctgcatctacgtggccggcatggccgagctgggggccttcttctccatcctgcaggacatgcggaacacgatcatggccagcaagaccgtcggcaccgcggaggagaagctcaagaagaagtccagcttctaccagtcctacctgcgccgcacccagagcatggggatccagctggaccagcggatcatcctcctgtacatgctggagtggggcaaggagatggtggaccacttccacctcggcgacgacatggaccccgagctgcgcgggctggcccaggccctcatcgaccagaaggtgaaggagatcagcaaccaggagcccctgaagatctga

SEQ ID NO: 6480 - RNA, 1302 nt, synthetic construct
  misc_feature 1..1302: note = derived and/or modified CDS sequence (opt1) from PUUV(Bavaria 159/05)__EU439972.1__N
  source 1..1302: mol_type = other RNA
atgagcgacctgaccgacatccacgaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgactacaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgagcggatccgcgagttcatggagaaggagtgccccttcatcaagcccgagatcaagccggggacccccgcccaggaggccgagttcctcaagcggaacaaggtgtacttcatgcagcgccaggacgtgctggacaagaaccacgtcgcggacatcgacaagctgatcgactacgccgccagcggcgaccccacctcccccgacaacatcgagagcccgaacgccccctgggtgttcgcctgcgcgcccgaccggtgcccgccgacctgcatctacgtggccggcatggccgagctcggggccttcttctccatcctgcaggacatgcgcaacacgatcatggccagcaagaccgtcggcaccgcggaggagaagctgaagaagaagtccagcttctaccagtcctacctccgccggacccagagcatggggatccagctggaccagcgcatcatcctgctctacatgctggagtggggcaaggagatggtggaccacttccacctgggcgacgacatggaccccgagctccgggggctggcccaggccctgatcgaccagaaggtgaaggagatcagcaaccaggagcccctcaagatctga

SEQ ID NO: 6481 - RNA, 1299 nt, synthetic construct
  misc_feature 1..1299: note = derived and/or modified CDS sequence (opt1) from PUUV(Bavaria CG 33/04)__DQ016430.2__N
  source 1..1299: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgactacaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgagcggatccgcgagttcatggagaaggagtgccccttcatcaagcccgagatcaagccggggacccccgcccaggaggccgagttcctcaagcggaacaaggtgtacttcatgcagcgccaggacgtgctggacaagaaccacgtcgcggacatcgacaagctgatcgactacgccgccagcggcgaccccacctcccccgacaacatcgagagcccgaacgccccctgggtgttcgcctgcgcgcccgaccggtgcccgccgacctgcatctacgtggccggcatggccgagctcggggccttctccatcctgcaggacatgcgcaacacgatcatggccagcaagaccgtcggcaccgcggaggagaagctgaagaagaagtccagcttctaccagtcctacctccgccggacccagagcatggggatccagctggaccagcgcatcatcctgctctacatgctggagtggggcaaggagatggtggaccacttccacctgggcgacgacatggaccccgagctccgggggctggcccaggccctgatcgaccagaaggtgaaggagatcagcaaccaggagcccctcaagatctga

SEQ ID NO: 6482 - RNA, 1302 nt, synthetic construct
  misc_feature 1..1302: note = derived and/or modified CDS sequence (opt1) from PUUV(Bavaria CG 34/04)__AY954723.2__N
  source 1..1302: mol_type = other RNA
atgagcgacctgaccgacatccaggaggacatcacccgccacgagcagcagctcgtggtcgcccggcagaagctgaaggacgccggcaaggcggtggagatggaccccgacgacgtgaacaagaacacgctgcaggcccgccagcagaccgtctccgccctcgaggacaagctggccgactacaagcggcgcatggccgacgcggtgagccggaagaagatggacaccaagcccaccgaccccacggggatcgagcccgacgaccacctgaaggagcgctccagcctccggtacggcaacgtgctggacgtcaacgccatcgacatcgaggagccctccgggcagaccgccgactggtacaccatcggcgtgtacgtgatcgggttcaccctgccgatcatcctcaaggccctgtacatgctgagcacgcgcggccggcagaccgtcaaggagaacaagggcacccgcatccggttcaaggacgacacctccttcgaggacatcaacgggatccgccggcccaagcacctctacgtgagcatgcccacggcgcagtccaccatgaaggccgaggagctgacccccggccgcttccggaccatcgtgtgcgggctgttcccgacgcagatccaggtccgcaacatcatgagccccgtgatgggcgtgatcgggttctccttcttcgtcaaggactgggccgagcggatccgcgagttcatggagaaggagtgccccttcatcaagcccgagatgaagccgggcacccccgcccaggaggccgagttcctcaagcggaacaaggtgtacttcatgcagcgccaggacgtgctggacaagaaccacgtcgcggacatcgacaagctgatcgactacgccgccagcggcgaccccacctcccccgacaacatcgagagcccgaacgccccctgggtgttcgcctgcgcgcccgaccggtgcccgccgacctgcatctacgtggccgggatggccgagctcggcgccttcttctccatcctgcaggacatgcgcaacacgatcatggccagcaagaccgtcgggaccgcggaggagaagctgaagaagaagtccagcttctaccagtcctacctccgccggacccagagcatgggcatccagctggaccagcgcatcatcctgctctacatgctggagtggggcaaggagatggtggaccacttccacctgggggacgacatggaccccgagctccggggcctggcccaggccctgatcgaccagaaggtgaaggagatcagcaaccaggagcccctcaagatctga

SEQ ID NO: 6483 - RNA, 1302 nt, synthetic construct
  misc_feature 1..1302: note = derived and/or modified CDS sequence (opt1) from PUUV(Bavaria CG 41/04)__DQ016432.2__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaacctggccgactacaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgagcggatccgcgagttcatggagaaggagtgccccttcatcaagcccgagatgaagccggggacccccgcccaggaggccgagttcctcaagcggaacaaggtgtacttcatgcagcgccaggacgtgctggacaagaaccacgtcgcggacatcgacaagctgatcgactacgccgccagcggcgaccccacctcccccgacaacatcgagagcccgaacgccccctgggtgttcgcctgcgcgcccgaccggtgcccgccgacctgcatctacgtggccggcatggccgagctcggggccttcttctccatcctgcaggacatgcgcaacacgatcatggccagcaagaccgtcggcaccgcggaggagaagctgaagaagaagtccagcttctaccagtcctacctccgccggacccagagcatggggatccagctggaccagcgcatcatcctgctctacatgctggagtggggcaaggagatggtggaccacttccacctgggcgacgacatggaccccgagctccgggggctggcccaggccctgatcgaccagaaggtgaaggagatcagcaaccaggagcccctcaagatctga

SEQ ID NO: 6484 - RNA, 1302 nt, synthetic construct
  misc_feature 1..1302: note = derived and/or modified CDS sequence (opt1) from PUUV(Bavaria CG 9/04)__AY954722.2__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgactacaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgagcggatccgcgagttcatggagaaggagtgccccttcatcaagcccgagatgaagccggggatccccgcccaggaggccgagttcctcaagcggaacaaggtgtacttcatgcagcgccaggacgtgctggacaagaaccacgtcgcggacatcgacaagctgatcgactacgccgccagcggcgaccccacctcccccgacaacatcgagagcccgaacgccccctgggtgttcgcctgcgcgcccgaccggtgcccgccgacctgcatctacgtggccggcatggccgagctcggggccttcttctccatcctgcaggacatgcgcaacaccatcatggccagcaagacggtcggcaccgcggaggagaagctgaagaagaagtccagcttctaccagtcctacctccgccggacccagagcatggggatccagctggaccagcgcatcatcctgctctacatgctggagtggggcaaggagatggtggaccacttccacctgggcgacgacatggaccccgagctccgggggctggcccaggccctgatcgaccagaaggtgaaggagatcagcaaccaggagcccctcaagatctga

SEQ ID NO: 6485 - RNA, 1302 nt, synthetic construct
  misc_feature 1..1302: note = derived and/or modified CDS sequence (opt1) from PUUV(Bergsjobo/Mg25/05)__GQ339483.1__N
  source 1..1302: mol_type = other RNA
atgagcgacctggccgacatccaggacgagatcacccgccacgagcagcagctcgtggccgcgcggcagaagctgaaggacgccgagcgcgccgtcgaggtggaccccgacgacgtgaacaagaacaccctgcaggcccggcagcagacggtctccgccctcgaggacaagctggcggacttcaagcgccggatggccgacgccgtgagccgcaagaagatggacaccaagcccaccgaccccaccggcatcgagcccgacgaccacctgaaggagcggtccagcctccgctacgggaacgtgctggacgtcaacgccatcgacatcgaggagccctccggccagacggcggactggtacaccatcggggtgtacgtgatcggcttcaccctgccgatcatcctcaaggccctgtacatgctgagcacccgggggcgccagacggtcaaggagaacaagggcacccggatccgcttcaaggacgacacctccttcgaggacatcaacggcatccggcgccccaagcacctctacgtgagcatgcccaccgcccagtccacgatgaaggccgaggagctgacccccgggcggttccgcaccatcgtgtgcggcctgttcccgacccagatccaggtccggaacatcatgagccccgtgatgggggtgatcggcttctccttcttcgtcaaggactgggccgagcgcatccgggagttcatggagaaggagtgccccttcatcaagcccgaggtgaagccggggacgcccgcgcaggaggtggagttcctcaagaagaacaagatctacttcatgcagcgccaggacgtcctggacaagaaccacgtggccgacatcgacaagctgatcgactacgccgccagcggcgaccccacctcccccgacaacatcgagagcccgaacgccccctgggtgttcgcgtgcgcccccgaccggtgcccgccgacctgcatctacgtcgccggcatggccgagctcggggccttcttctccatcctgcaggacatgcgcaacaccatcatggcgagcaagacggtgggcaccgccgaggagaagctgaagaagaagtccagcttctaccagtcctacctccgccggacccagagcatggggatccagctggaccagcgcatcatcctgctctacatgctggagtggggcaaggagatggtggaccacttccacctgggcgacgacatggaccccgagctccgggggctggcccaggccctgatcgaccagaaggtcaaggagatcagcaaccaggagcccctcaagatctga

SEQ ID NO: 6486 - RNA, 1302 nt, synthetic construct
  misc_feature 1..1302: note = derived and/or modified CDS sequence (opt1) from PUUV(CG14444)__AJ277075.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcagatggccgacgcggtgagccgcaagaagatggacaccaagcccaccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgggggcgccagaccgtcaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtgtgcggcctgttcccgacgcagatccaggtccggaacatcatgagccccgtgatgggggtgatcggcttctccttcttcgtcaaggactgggccgaccgcatccgggagttcatggagaaggagtgccccttcatcaagcccgaggtgaagccggggacccccgcccaggaggccgagttcctcaagcgcaacaagatctacttcatgcagcggcaggaggtgctggacaagaaccacgtcgcggacatcgacaagctgatcgactacgccgccagcggcgaccccacctcccccgacaacatcgaggccccgaacgccccctgggtgttcgcgtgcgcccccgaccgctgcccgccgacctgcatctacgtggccggcatggccgagctcggggccttcttcagcatcctgcaggacatgcggaacacgatcatggcgtccaagaccgtcggcaccgccgaggagaagctgaagaagaagtccagcttctaccagagctacctccgccgcacccagtccatggggatccagctggaccagcggatcatcctgctctacatgctggagtggggcaaggagatggtggaccacttccacctgggcgacgacatggaccccgagctccgcgggctggcccaggccctgatcgaccagaaggtgaaggagatcagcaaccaggagcccctcaagatctga

SEQ ID NO: 6487 - RNA, 1302 nt, synthetic construct
  misc_feature 1..1302: note = derived and/or modified CDS sequence (opt1) from PUUV(CG14445)__AJ277076.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcagatggccgacgcggtgagccgcaagaagatggacaccaagcccaccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgggggcgccagaccgtcaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtgtgcggcctgttcccgacgcagatccaggtccggaacatcatgagccccgtgatgggggtgatcggcttctccttcttcgtcaaggactgggccgaccgcatccgggagttcatggagaaggagtgccccttcatcaagcccgaggtgaagccggggacccccgcccaggaggccgagttcctcaagcgcaacatcatctacttcatgcagcggcaggaggtgctggacaagaaccacgtcgcggacatcgacaagctgatcgactacgccgccagcggcgaccccacctcccccgacaacatcgaggccccgaacgccccctgggtgttcgcgtgcgcccccgaccgctgcccgccgacctgcatctacgtggccggcatggccgagctcggggccttcttcagcatcctgcaggacatgcggaacacgatcatggcgtccaagaccgtcggcaccgccgaggagaagctgaagaagaagtccagcttctaccagagctacctccgccgcacccagtccatggggatccagctggaccagcggatcatcctgctctacatgctggagtggggcaaggagatggtggaccacttccacctgggcgacgacatggaccccgagctccgcgggctggcccaggccctgatcgaccagaaggtgaaggagatcagcaaccaggagcccctcaagatctga

SEQ ID NO: 6488 - RNA, 1302 nt, synthetic construct
  misc_feature 1..1302: note = derived and/or modified CDS sequence (opt1) from PUUV(CG1820/POR)__KT885052.1__N
  source 1..1302: mol_type = other RNA
atgagcgacctgaccgacatccaggaggagatcacccgccacgagcagcagctcgtggtcgcccggcagaagctgaaggacgccgagcgcgcggtggaggtggaccccgacgacgtcaacaagtccacgctgcaggcccggcagcagaccgtgagcgccctcgaggacaagctggccgactacaagcgccggatggccgacgcggtgtcccgcaagaagatggacaccaagccgaccgaccccacgggcatcgagcccgacgaccacctgaaggagcggagctccctccgctacgggaacgtcctggacgtgaacgccatcgacatcgaggagcccagcggccagaccgccgactggtacaccatcggggtgtacgtcatcggcttcaccatcccgatcatcctgaaggccctctacatgctgtccacgcgggggcgccagaccgtgaaggagaacaagggcacccggatccgcttcaaggacgacaccagcttcgaggacatcaacggcatccggcgccccaagcacctgtacgtgtccatgcccacggcgcagagcaccatgaaggccgaggagctcacccccgggcggttccgcaccatcgtctgcggcctgttcccgacgcagatccaggtgcggaacatcatgtcccccgtgatgggggtcatcggcttcagcttcttcgtgaaggactggcccgagaagatccgcgagttcatggagaaggagtgccccttcatcaagccggaggtgaagcccgggacccccgcccaggaggtcgagttcctgaagcggaaccgcgtgtacttcatgacccggcaggacgtgctcgacaagaaccacgtcgccgacatcgacaagctgatcgactacgccgcgtccggcgaccccaccagcccggacgacatcgagtcccccaacgccccctgggtgttcgcctgcgcccccgaccgctgcccgcccacgtgcatctacgtggccggcatggcggagctgggggccttcttcagcatcctccaggacatgcgcaacaccatcatggcctccaagaccgtcggcaccgccgaggagaagctgaagaagaagtccagcttctaccagagctacctgcggcgcacgcagagcatggggatccagctcgaccagcggatcatcctgctgtacatgctcgagtggggcaaggagatggtggaccacttccacctgggcgacgacatggaccccgagctgcgcgggctcgcccagtccctgatcgaccagaaggtcaaggagatcagcaaccaggagcccctgaagatctga

SEQ ID NO: 6489 - RNA, 1302 nt, synthetic construct
  misc_feature 1..1302: note = derived and/or modified CDS sequence (opt1) from PUUV(Couvin/59Cg/97)__AJ277034.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcagatggccgacgcggtgagccgcaagaagatggacaccaagcccaccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgggggcgccagaccgtcaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtgtgcggcctgttcccgacgcagatccaggtccggaacatcatgagccccgtgatgggggtgatcggcttctccttcttcgtcaaggactgggccgaccgcatccgggagttcatggagaaggagtgccccttcatcaagcccgaggtgaagccggggacccccgcccaggaggccgagttcctcaagcgcaacaagatctacttcatgcagcggcaggacgtgctggacaagaaccacgtcgcggacatcgacaagctgatcgactacgccgccagcggcgaccccacctcccccgacaacatcgaggccccgaacgccccctgggtgttcgcgtgcgcccccgaccgctgcccgccgacctgcatctacgtggccggcatggccgagctcggggccttcttcagcatcctgcaggacatgcggaacacgatcatggcgtccaagaccgtcggcaccgccgaggagaagctgaagaagaagtccagcttctaccagagctacctccgccgcacccagtccatggggatccagctggaccagcggatcatcctgctctacatgctggagtggggcaaggagatggtggaccacttccacctgggcgacgacatggaccccgagctccgcgggctggcccaggccctgatcgaccagaaggtgaaggagatcagcaaccaggagcccctcaagatctga

SEQ ID NO: 6490 - RNA, 1302 nt, synthetic construct
  misc_feature 1..1302: note = derived and/or modified CDS sequence (opt1) from PUUV(Evo/12Cg/93)__Z30702.1__N
  source 1..1302: mol_type = other RNA
atgagcgacctgaccgacatccaggaggacatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacgcggtgagccgcaagaagatggacaccaagcccaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccatcccgatcatcctgaaggccctctacatgctgagcacgcgggggcgccagaccgtgaaggagaacaagggcacccggatccgcttcaaggacgacacctccttcgaggacatcaacggcatccggcgccccaagcacctgtacgtgagcatgcccacggcgcagtccaccatgaaggccgaggagctcacccccgggcggttccgcaccatcgtctgcggcctgttcccgacgcagatccaggtgcggaacatcatgagccccgtgatgggggtcatcggcttctccttcttcgtgaaggactggcccgagcgcatccgggagttcatggagaaggagtgccccttcatcaagccggagatcaagcccgggacccccgcccaggagatggagatgctgaagcgcaacaagatctacttcatgcagcggcaggacgtgctcgacaagaaccacgtcgccgacatcgacaagctgatcgactacgccgcgagcggcgaccccacctccccggacaacatcgacagccccaacgccccctgggtgttcgcctgcgcccccgaccgctgcccgccgacctgcatctacgtggccggcatggcggagctgggggccttcttctccatcctccaggacatgcgcaacacgatcatggccagcaagaccgtcggcaccgccgaggagaagctgcggaagaagtccagcttctaccagtcctacctgcgccggacccagagcatggggatccagctcgaccagcgcatcatcctgctgttcatgctcgagtggggcaaggagatggtggaccacttccacctgggcgacgacatggaccccgagctgcgggggctcgcccaggcgctgatcgaccagaaggtgaaggagatcagcaaccaggagcccctgaagatctga

SEQ ID NO: 6491 - RNA, 1302 nt, synthetic construct
  misc_feature 1..1302: note = derived and/or modified CDS sequence (opt1) from PUUV(Evo/14Cg/93)__Z30704.1__N
  source 1..1302: mol_type = other RNA
atgagcgacctgaccgacatccaggaggacatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccaactacaagcgccggatggccgacgcggtgagccgcaagaagatggacaccaagcccaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccatcccgatcatcctgaaggccctctacatgctgagcacgcgggggcgccagaccgtgaaggagaacaagggcacccggatccgcttcaaggacgacacctccttcgaggacatcaacggcatccggcgccccaagcacctgtacgtgagcatgcccacggcgcagtccaccatgaaggccgaggagctcacccccgggcggttccgcaccatcgtctgcggcctgttcccgacgcagatccaggtgcggaacatcatgagccccgtgatgggggtcatcggcttctccttcttcgtgaaggactggcccgagcgcatccgggagttcatggagaaggagtgccccttcatcaagccggagatcaagcccgggacccccgcccaggagatggagatgctgaagcgcaacaagatctacttcatgcagcggcaggacgtgctcgacaagaaccacgtcgccgacatcgacaagctgatcgactacgccgcgagcggcggccccacctccccggacaacatcgacagccccaacgccccctgggtgttcgcctgcgcccccgaccgctgcccgccgacctgcatctacgtggccgggatggcggagctgggcgccttcttctccatcctccaggacatgcgcaacacgatcatggccagcaagaccgtcgggaccgccgaggagaagctgaagaagaagtccagcttctaccagtcctacctgcggcgcacccagagcatgggcatccagctcgaccagcggatcatcctgctgttcatgctcgagtggggcaaggagatggtggaccacttccacctgggggacgacatggaccccgagctgcgcggcctcgcccaggcgctgatcgaccagaaggtgaaggagatcagcaaccaggagcccctgaagatctga

SEQ ID NO: 6492 - RNA, 1302 nt, synthetic construct
  misc_feature 1..1302: note = derived and/or modified CDS sequence (opt1) from PUUV(Evo/15Cg/93)__Z30705.1__N
  source 1..1302: mol_type = other RNA
atgagcgacctgaccgacatccaggaggacatcacccgccacgagcagcagctcgtggtcgcccggcagggcctgaaggacgccgagcgcgcggtggaggtggaccccgacgacgtcaacaagaacgccctgcaggcccggcagcagacggtgtccgccctcgaggacaagctggccgactacaagcgccggatggcggacgccgtgagccgcaagaagatggacaccaagcccaccgaccccaccgggatcgagcccgacgaccacctgaaggagcggtccagcctccgctacggcaacgtcttcgacgtgaacgccatcgacatcgaggagccctccgggcagacggccgactggtacaccatcggcgtgtacgtcatcgggttcaccatcccgatcatcctgaaggcgctgtacatgctcagcacccggggccgccagacggtgaaggagaacaagggcacccggatccgcttcaaggacgacacctccttcgaggacatcaacgggatccggcgccccaagcacctgtacgtgagcatgcccaccgcccagtccacgatgaaggccgaggagctgacccccggccggttccgcaccatcgtctgcggcctcttcccgacccagatccaggtgcggaacatcatgagccccgtgatgggggtcatcgggttctccttcttcgtgaaggactggcccgagcgcatccgggagttcatggagaaggagtgccccttcatcaagccggagatcaagcccggcacgcccgcccaggagatggagatgctgaagcgcaacaagatctacttcatgcagcggcaggacgtgctggacaagaaccacgtcgccgacatcgacaagctcatcgactacgcggccagcggcgaccccacctccccggacaacatcgacagccccaacgccccctgggtgttcgcctgcgcccccgaccgctgcccgccgacctgcatctacgtggcggggatggccgagctgggcgccttcttctccatcctgcaggacatgcgcaacaccatcatggccagcaagacggtcgggaccgccgaggagaagctcaagaagaagtccagcttctaccagtcctacctgcggcgcacccagagcatgggcatccagctggaccagcggatcatcctcctgttcatgctggagtggggcaaggagatggtggaccacttccacctcggggacgacatggaccccgagctgcgcggcctggcgcaggccctcatcgaccagaaggtgaaggagatcagcaaccaggagcccctgaagatctga

SEQ ID NO: 6493 - RNA, 1302 nt, synthetic construct
  misc_feature 1..1302: note = derived and/or modified CDS sequence (opt1) from PUUV(Faboviken/Mg26/05)__GQ339484.1__N
  source 1..1302: mol_type = other RNA
atgagcgacctggccgacatccaggacgagatcacccgccacgagcagcagctcgtggccgcgcggcagaagctgaaggacgccgagcgcgccgtcgagatggaccccgacgacgtgaacaagaacaccctgcaggcccggcagcagacggtgtccgccctcgaggacaagctggcggacttcaagcgccggatggccgacgccgtcagccgcaagaagatggacaccaagcccaccgaccccaccggcatcgagcccgacgaccacctgaaggagatctccagcctccggtacgggaacgtgctggacgtgaacgccatcgacatcgaggagccctccggccagacggcggactggtacaccatcggggtctacgtgatcggcttcaccctgccgatcatcctcaaggccctgtacatgctgagcacccgcgggcggcagacggtgaaggagaacaagggcacccgcatccggttcaaggacgacacctccttcgaggacatcaacggcatccgccggcccaagcacctctacgtcagcatgcccaccgcccagtccacgatgaaggccgaggagctgacccccgggcgcttccggaccatcgtgtgcggcctgttcccgacccagatccaggtgcgcaacatcatgagccccgtcatgggggtgatcggcttctccttcttcgtgaaggactgggccgagcggatccgcgagttcatggagaaggagtgccccttcatcaagcccgaggtcaagccggggacgcccgcgcaggaggtggagttcctcaagaagaacaagatctacttcatgcagcggcaggacgtgctggacaagaaccacgtcgccgacatcgacaagctgatcgactacgccgccagcggcgaccccacctcccccgacaacatcgagagcccgaacgccccctgggtgttcgcgtgcgcccccgaccgctgcccgccgacctgcatctacgtggccggcatggccgagctcggggccttcttctccatcctgcaggacatgcggaacaccatcatggcgagcaagacggtcggcaccgccgaggagaagctgaagaagaagtccagcttctaccagtcctacctccgccgcacccagagcatggggatccagctggaccagcggatcatcctgctctacatgctggagtggggcaaggagatggtggaccacttccacctgggcgacgacatggaccccgagctccgcgggctggcccaggccctgatcgaccagaaggtgaaggagatcagcaaccaggagcccctcaagatctga

SEQ ID NO: 6494 - RNA, 1302 nt, synthetic construct
  misc_feature 1..1302: note = derived and/or modified CDS sequence (opt1) from PUUV(Fyn)__AJ238791.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgagcggatccgcgagttcatggagaaggagtgccccttcatcaagcccgagctcaagccggggaccaacgcccaggaggccgagttcctgaagaagaaccgggtgtacttcctgaaccgccaggacgtgctcgacaagaaccacgtcgcggacatcgacaagctgatcgactacgccgccagcggcgaccccacctcccccgacaacatcgaggcccccaacgccccgtgggtgttcagctgcgcgcccgaccggtgcccgccgacctgcatctacgtggccggcatggccgagctgggggccttcttctccatcctccaggacatgcgcaacacgatcatggccagcaagaccgtcggcaccgcggaggagaagctgaagaagaagtccagcttctaccagtcctacctgcgccggacccagagcatggggatccagctcgaccagcgcatcatcctgctgtacatgctcgagtggggcaaggagatggtggaccacttccacctgggcgacgacatggaccccgagctgcgggggctcgcccaggccctgatcgaccagaaggtgaaggagatcagcaaccaggagcccctgaagatctga

SEQ ID NO: 6495 - RNA, 1302 nt, synthetic construct
  misc_feature 1..1302: note = derived and/or modified CDS sequence (opt1) from PUUV(Fyn131)__AJ278093.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctggaggcccgccagcagaccgtctccgccctcgaggacaagctggccgacttcaagcggcgcatgaccgacgccgtgagccggaagaagatggacaccaagccgacggaccccaccggcatcgagcccgacgaccacctgaaggagcgctccagcctccggtacgggaacgtgctggacgtcaacgcgatcgacatcgaggagccctccggccagaccgccgactggtacaccatcggggtgtacgtgatcggcttcacgctgccgatcatcctcaaggccctgtacatgctgagcacccgcgggcggcagaccgtcaaggagaacaagggcacccgcatccggttcaaggacgacacgtccttcgaggacatcaacggcatccgccggcccaagcacctctacgtgagcatgcccaccgccccctccaccatgaaggcggaggagctgaccccggggcgcttccggacgatcgtgtgcggcctgttccccacccagatccaggtccgcaacatcatgagccccgtgatgggggtgatcggctccagcttcttcgtcaaggactgggccgaccggatccgcgagttcatggagaaggagtgccccttcgtgaagccggagctcaagcccgggaccaacgcccaggaggccgagttcctgaagaagaaccgggtgtacttcatgaaccgccaggacgtcctggacaagaaccacgtggccgacatcgacaagctcatcgactacgcggcctccggcgacccgacctgccccgacaacatcgaggcccccaacgccccctggggcttcgcctgcgcgccccaccggtgcccgcccacgtgcatctacgtggccgggatggccgagctgggcgccttcttcagcatcctgcaggacatgcgcaacaccatcatggcctccaagaccgtcgggaccgcggaggagaagctcaagaagaagtccagcttctaccagagctacctgcgccggacgcagtccatgggcatccagctggaccagcgcatcatcctcctgtacatgctggagtggggccgggagatggtggaccacttccacctcggggacgacatggaccccgagctgcgcggcctggcccaggccctcatcaaccagaaggtgaaggagatcagcaaccaggagcccctgaagatctga

SEQ ID NO: 6496 - RNA, 1302 nt, synthetic construct
  misc_feature 1..1302: note = derived and/or modified CDS sequence (opt1) from PUUV(Fyn47)__AJ278092.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgccctccaccatgaaggccgaggagctgaccccggggcgcttccggaccatcgtgtgcggcctgttccccacgcagatccaggtccgcaagatcatgagccccgtgatgggggtgatcggcttctccttcttcgtcaaggactgggtggagcggatccgcgagttcatggagaaggagtgccccttcgtgaagccggagctcaagcccgggaccaacgcccaggaggccgagttcctgaagaagaaccgggtctacttcatgaaccgccaggacgtgctggacaagaaccacgtggccgacatcgacaagctcatcgactacgcggccagcggcgaccccacctcccccgacaacatcgaggccccgaacgccccctgggtcttcgcctgcgcgccccaccggtgcccgccgacctgcatctacgtggccggcatggccgagctgggggccttcttcagcatcctgcaggacatgcgcaacgccatcatggcgtccaagacggtgggcaccgccgaggagaagctcaagaagaagtccagcttctaccagagctacctgcgccggacccagtccgtcgggatccagctggaccagcgcatcatcctcctgtacatgctggagtggggccgggagatggtggaccacttccacctcggcgacgacatggaccccgagctgcgcgggctggcccaggccctcatcgaccagaaggtcaaggagatcagcaaccaggagcccctgaagatctga

SEQ ID NO: 6497 - RNA, 1302 nt, synthetic construct
  misc_feature 1..1302: note = derived and/or modified CDS sequence (opt1) from PUUV(Gomselga)__AJ238790.1__N
  source 1..1302: mol_type = other RNA
atgagcgacctgaccgacatccaggaggacatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgcaagatggccgacgcggtgagccggaagaagatggacaccaagccgaccgaccccacgggcatcgagcccgacgaccacctgaaggagcgctccagcctccggtacgggaacgtcctggacgtgaacgccatcgacatcgaggacccctccggccagaccgccgactggtacaccatcggggtgtacgtcatcggcttcaccctgccgatcatcctcaaggccctgtacatgctgagcacgcgcgggcggcagaccgtgaaggagaacaagggcacccgcatccggttcaaggacgacacctccttcgaggagatcaacggcatccgccggcccaagcacctctacgtgagcatgcccacggcgcagtccaccatgaaggccgaggagctgacccccgggcgcttccggaccatcgtctgcggcctgttcccgacgcagatccaggtgcgcaacatcgtgagccccgtcatgggggtgatcggcttctccttcttcgtgaaggactggagccagcggatcaccgagttcatggagaaggagtgccccttcatcaagcccgaggtcaagccggggacccccgcccaggagatcgagatgttcaagcgcaacaagatctacttcatgcagcggcaggacgtgctcgacaagaaccacgtggccgacatcgacaagtccatcgactacgccgcgagcgaggaccccacctcccccgacaacatcgacagcccgaacgccccctgggtcttcgcctgcgcccccgaccgctgcccgcccacgtgcatctacgtggccggcatggcggagctgggcgccttcttctccatcctgcaggacatgcggaacaccatcatggccagcaagaccgtggggaccgccgaggagaagctcaagaagaagtccagcttctaccagagctacctgcgccgcacgcagtccatgggcatccagctggaccagcggatcatcctcctgttcatgctggagtgggggaaggagatggtcgaccacttccacctcggcgacgacatggaccccgagctgcgcggcctggcccaggcgctcatcgaccagaaggtgaaggagatcagcaaccaggagcccctgaagatctga

SEQ ID NO: 6498 - RNA, 1302 nt, synthetic construct
  misc_feature 1..1302: note = derived and/or modified CDS sequence (opt1) from PUUV(Gyttjea/Mg19/05)__GQ339480.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcagatggccgacgcggtgagccgcaagaagatggacaccaagcccaccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgggggcgccagaccgtcaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtgtgcggcctgttcccgacgcagatccaggtccggaacatcatgagccccgtgatgggggtgatcggcttcgccttcttcgtcaaggggtgggccgaccgcatccgggagttcatggagaaggagtgccccttcatcaagcccgaggtgaagccgggcacccccacccaggagatcgagttcctcaagaagaacaaggtgtacttcctggaccgccagaccgtcctggacaagaaccacgtggccgacatcgacaagctcatcgactacgcggcctccggcgaccccacgagccccgacaacatcgagtccccgaacgccccctgggtgttcgcctgcgcccccgaccggtgcccgccgacctgcatctacgtcgcggggatggccgagctgggcgccttcttcagcatcctgcaggacatgcgcaacaccatcatggcctccaagaccgtggggacggccgaggagaagctcaagaagaagtccagcttctaccagagctacctgcggcgcacccagtccatgggcatccagctggaccagcgcatcatcctcctgttcatgctggagtggggcaaggagatggtggaccacttccacctcggggacgacatggaccccgagctgcggggcctggcgcaggccctcatcgaccagaaggtcaaggagatcagcaaccaggagcccctgaagatctga

SEQ ID NO: 6499 - RNA, 1302 nt, synthetic construct
  misc_feature 1..1302: note = derived and/or modified CDS sequence (opt1) from PUUV(Karhumaki)__AJ238788.1__N
  source 1..1302: mol_type = other RNA
atgagcgacctgaccgacatccaggaggacatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgcaagatggccgacgcggtgagccggaagaagatggacaccaagcccaccgaccccacgggcatgaagcccgacgtccacctgaaggagcgctccagcctcgagtacgggaacgtgctggacgtgaacgccatcgacatcgaggagccctccggccagaccgccgactggtacaccatcggggtctacgtgatcggcttcaccctgccgatcatcctcaaggccctgtacatgctgagcacgcgggggcgccagaccgtgaaggagaacaagggcacccggatccgcttcaaggacgacacctccttcgaggacatcaacggcatccggcgccccaagcacctctacgtcagcatgcccacggcgcagtccaccatgaaggccgaggagctgacccccgggcggttccgcaccatcgtgtgcggcctgttcccgacgcagatccaggtgcggaacatcatgagccccgtcatgggggtgatcggcttctccttcttcgtgaaggactggagcgagcgcatccgggagttcatggagaaggagtgccccttcatcaagcccgaggtcaagccggggacccccgcccaggagatcgagatgctccgccggaacaagatctacttcatgcagcgccaggacgtgctggacaagaaccacgtggccgacatcgacaagctgatcgacctcgccgcgtccggcgaccccaccagccccgacaacatcgactccccgaacgccccctgggtcttcgcctgcgcccccgtgcggtgcccgccgacctgcatctacgtggccggcatggcggagctgggggccttcttcagcatcctgcaggacatgcgcaacacgatcatggcctccaagaccgtcggcaccgccgaggagaagctcaagaagaagtccagcttctaccagagctacctgcgccggacccagagcatggggatccagctggaccagcgcatcatcctcctgttcatgctggagtggggcaaggagatggtggaccacttccacctcggcgacgacatggaccccgagctgcgggggctggcccaggcgctcatcgaccagaaggtcaaggagatctccaaccaggagcccctgaagatctga

SEQ ID NO: 6500 - RNA, 1302 nt, synthetic construct
  misc_feature 1..1302: note = derived and/or modified CDS sequence (opt1) from PUUV(Kolodozero)__AJ238789.1__N
  source 1..1302: mol_type = other RNA
atgagcgacctgaccgacatccaggaggacatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacgcggtgagccgcaagaagatggacaccaagcccaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccctgccgatcatcctcaaggccctgtacatgctgagcacgcgggggcgccagaccgtgaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtctgcggcctgatcccgacgcagatccaggtgcggaacatcatgagccccgtgatgggggtcatcggcttctccttcttcgtgaaggactggagcgagcgcatccgggagttcatggagaaggagtgccccttcatcaagcccgaggtgaagccggggacctccgcccaggagatcgagatgctcaagcgcaacaagatctacttcatgcagcggcaggacgtcctggacaagaaccacgtggccgacatcgacaagctgatcgactacgccgcgagcggcgaccccacctcccccgacaacatcgacagccccaacgccccgtgggtgttcgcctgcgcccccgaccgctgcccgccgacctgcatctacgtcgccggcatggcggagctcggggccttcttctccatcctgcaggacatgcgcaacacgatcatggccagcaagaccgtgggcaccgccgaggagaagctgaagaagaagtccagcttctaccagagctacctccggcgcacccagtccatggggatccccctggaccagcggatcatcctcctgttcatgctggagtggggccaggagatggtggaccacttccacctgggcgacgacatggaccccgagctccgcgggctggcccaggcgctgatcgaccagaaggtcaaggagatcagcaaccaggagcccctcaagatctga

SEQ ID NO: 6501 - RNA, 1302 nt, synthetic construct
  misc_feature 1..1302: note = derived and/or modified CDS sequence (opt1) from PUUV(Kuhmo/X11)__GU808825.1__N
  source 1..1302: mol_type = other RNA
atgagcgacctgaccgacatccaggaggacatcacccgccacgagcagcagctcgtggtcgcccggcagaagctgaaggacgccgagcgcgcggtgggcgtggaccccgacgacgtcaacaagaacacgctgcaggcccggcagcagaccgtgtccgccctcgaggacaagctggccgactacaagcgccggatggccgacgcggtgagccgcaagaagatggacaccaagcccaccgaccccacggggatcgagcccgacgaccacctgaaggagcggtccagcctccgctacggcaacgtcctggacgtgaacgccatcgacatcgaggagccctccgggcagaccgccgactggtacaccatcggcgtgtacgtcatcgggttcaccctgccgatcatcctcaaggccctgtacatgctgagcacgcggggccgccagaccgtgaaggagaacaagggcacccggatccgcttcaaggacgacacctccttcgaggacatcaacgggatccggcgccccaagcacctctacgtgagcatgcccacggcgcagtccaccatgaaggccgaggagctgacccccggccggttccgcaccatcgtctgcgggctgttcccgacgcagatccaggtgcggaacatcatgagccccgtgatgggcgtcatcgggttctccttcttcgtgaaggactggagcgagcgcatccgggagttcatggagaaggagtgccccttcatcaagcccgaggtgaagccgggcacccccgcccaggagatcgagatgctcaagcgcaaccggatctacttcatgcagcgccaggacgtcctggacaagaaccacgtggccgacatcgacaagctgatcgactacgccgcgtccggcgaccccaccagccccgacaacatcgactccccgaacgccccctgggtgttcgcctgcgcccccgaccgctgcccgccgacctgcatctacgtcgccgggatggcggagctcggcgccttcttcagcatcctgcaggacatgcggaacacgatcatggcctccaagaccgtggggaccagcgaggagaagctgaagaagaagtccagcttctaccagagctacctccgccggacccagtccatgggcatccagctggaccagcgcatcatcctcctgttcatgctggagtggggcaaggagatggtggaccacttccacctgggggacgacatggaccccgagctccggggcctggcccaggccctgatcgaccagaaggtcaaggagatcagcaaccaggagcccctcaagatctga

SEQ ID NO: 6502 - RNA, 1302 nt, synthetic construct
  misc_feature 1..1302: note = derived and/or modified CDS sequence (opt1) from PUUV(Kuhmo/X5)__GU808824.1__N
  source 1..1302: mol_type = other RNA
atgagcgacctgaccgacatccaggaggacatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacgcggtgagccgcaagaagatggacaccaagcccaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccctgccgatcatcctcaaggccctgtacatgctgagcacgcgggggcgccagaccgtgaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtctgcggcctgttcccgacgcagatccaggtgcggaacatcatgagccccgtgatgggggtcatcggcttctccttcttcgtgaaggactggagcgagcgcatccgggagttcatggagaaggagtgccccttcatcaagcccgaggtgaagccggggacccccgcccaggagatcgagatgctcaagcgcaaccggatctacttcatgcagcgccaggacgtcctggacaagaaccacgtggccgacatcgacaagctgatcgactacgccgcgtccggcgaccccaccagccccgacaacatcgactccccgaacgccccctgggtgttcgcctgcgcccccgaccgctgcccgccgacctgcatctacgtcgccggcatggcggagctcggggccttcttcagcatcctgcaggacatgcggaacacgatcatggcctccaagaccgtgggcaccgccgaggagaagctgaagaagaagtccagcttctaccagagctacctccgccggacccagagcatggggatccagctggaccagcgcatcatcctcctgttcatgctggagtggggcaaggagatggtggaccacttccacctgggcgacgacatggaccccgagctccgggggctggcccaggcgctgatcgaccagaaggtcaaggagatctccaaccaggagcccctcaagatctga

SEQ ID NO: 6503 - RNA, 1302 nt, synthetic construct
  misc_feature 1..1302: note = derived and/or modified CDS sequence (opt1) from PUUV(Ljustrask/Mg20/05)__GQ339481.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcagatggccgacgcggtgagccgcaagaagatggacaccaagccgaccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgggggcgccagaccgtcaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtgtgcggcctgttcccgacgcagatccaggtccggaacatcatgagccccgtgatgggggtgatcggcttcgccttcttcgtcaaggggtgggccgaccgcatccgggagttcatggagaaggagtgccccttcatcaagcccgaggtgaagccgggcacccccacccaggagatcgagttcctcaagaagaacaaggtgtacttcctggaccgccagaacgtcctggacaagaaccacgtggccgacatcgacaagctcatcgactacgcggcctccggcgaccccaccagccccgacaacatcgagtccccgaacgccccctgggtgttcgcctgcgcccccgaccggtgcccgcccacgtgcatctacgtcgcggggatggccgagctgggcgccttcttcagcatcctgcaggacatgcgcaacaccatcatggcctccaagaccgtggggaccgccgaggagaagctcaagaagaagtccagcttctaccagagctacctgcggcgcacgcagtccatgggcatccagctggaccagcgcatcatcctcctgttcatgctggagtggggcaaggagatggtggaccacttccacctcggggacgacatggaccccgagctgcggggcctggcgcaggccctcatcgaccagaaggtcaaggagatcagcaaccaggagcccctgaagatctga

SEQ ID NO: 6504 - RNA, 1302 nt, synthetic construct
  misc_feature 1..1302: note = derived and/or modified CDS sequence (opt1) from PUUV(Mangelbo/Mg1/05)__GQ339485.1__N
  source 1..1302: mol_type = other RNA
atgagcgacctgaccgacatccaggacgagatcacccgccacgagcagcagctcgtggccgcccggcagaagctgaaggacgcggagcgcgccgtcgagatggaccccgacgacgtgaacaagaacacgctgcaggcccggcagcagaccgtgtccgccctcgaggacaagctggccgacttcaagcgccggatggcggacgccgtcagccgcaagaagatggacaccaagcccaccgaccccacgggcatcgagcccgacgaccacctgaaggagcggtccagcctccgctacggggacgtgctggacgtgaacgccatcgacatcgaggagccctccggccagaccgccgactggtacaccatcggggtctacgtgatcggcttcaccctgccgatcatcctcaaggcgctgtacatgctgagcacgcgggggcgccagaccgtgaaggagaacaagggcacccggatccgcttcaaggacgacacctccttcgaggacatcaacggcatccggcgccccaagcacctctacgtcagcatgcccacggcccagtccaccatgaaggccgaggagctgacccccgggcggttccgcaccatcgtgtgcggcctgttcccgacgcagatccaggtgcggaacatcatgagccccgtcatgggggtgatcggcttctccttcttcgtgaaggactgggccgagcgcatccgggagttcatggacaaggagtgccccttcatcaagcccgaggtcaagccggggacccccgcccaggagatcgagttcctcaagaagaacaagatctacttcatgcagcgccaggacgtgctggacaagaaccacgtggcggacatcgacaagctgatcgactacgccgccagcggcgaccccacctcccccgacaacatcgagagcccgaacgccccctgggtcttcgcctgcgcgcccgaccggtgcccgccgacctgcatctacgtggccggcatggccgagctcggggccttcttctccatcctgcaggacatgcgcaacacgatcatggccagcaagaccgtgggcaccgcggaggagaagctgaagaagaagtccagcttctaccagtcctacctccgccggacccagagcatggggatccagctggaccagcgcatcatcctgctctacatgctggagtggggcaaggagatggtcgaccacttccacctgggcgacgacatggaccccgagctccgggggctgacgcaggccctgatcgaccagaaggtgaaggagatcagcaaccccgagcccctcaagatctga

SEQ ID NO: 6505 - RNA, 1302 nt, synthetic construct
  misc_feature 1..1302: note = derived and/or modified CDS sequence (opt1) from PUUV(Momignies/55Cg/96)__AJ277033.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcagatggccgacgcggtgagccgcaagaagatggacaccaagcccaccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgggggcgccagaccgtcaaggagaacaagggcacccggatccgcttcaaggacgacacctccttcgaggacatcaacggcatccggcgcagcaagcacctctacgtgtccatgcccacggcgcagagcaccatgaaggccgaggagctgacccccgggcggttccgcaccatcgtgtgcggcctgttccccacgcagatccaggtccggaacatcatgtccccggtgatgggggtgatcggcttcagcttcttcgtcaaggactgggccgaccgcatccgggagttcatggagaaggagtgccccttcatcaagcccgaggtgaagcccgggaccccggcccaggaggccgagttcctcaagcgcaacaagatctacttcatgcagcggcaggacgtgctggacaagaaccacgtcgcggacatcgacaagctgatcgactacgccgcctccggcgaccccaccagccccgacaacatcgaggcccccaacgccccgtgggtgttcgcgtgcgcccccgaccgctgcccgccgacctgcatctacgtggccggcatggccgagctcggggccttcttctccatcctgcaggacatgcggaacacgatcatggcgagcaagaccgtcggcaccgccgaggagaagctgaagaagaagtccagcttctaccagtcctacctccgccgcacccagagcatggggatccagctggaccagcggatcatcctgctctacatgctggagtggggcaaggagatggtggaccacttccacctgagcgacgacatggaccccgagctccgcggcctggcccaggccctgatcgaccagaaggtgaaggagatctccaaccaggagcccctcaagatctga

SEQ ID NO: 6506 - RNA, 1302 nt, synthetic construct
  misc_feature 1..1302: note = derived and/or modified CDS sequence (opt1) from PUUV(Montbliart/23Cg/96)__AJ277031.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcagatggccgacgcggtgagccgcaagaagatggacaccaagcccaccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgggggcgccagaccgtcaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtgtgcggcctgttcccgacgcagatccaggtccggaacatcatgagccccgtgatgggggtgatcggcttctccttcttcgtcaaggactgggccgaccgcatccgggagttcatggagaaggagtgccccttcatcaagcccgaggtgaagccggggacccccgcccaggaggccgagttcctccgccggaacaagatctacttcatgcagcgccaggaggtgctggacaagaaccacgtcgcggacatcgacaagctgatcgactacgccgccagcggcgaccccacctcccccgacaacatcgaggccccgaacgccccctgggtgttcgcgtgcgcccccgaccggtgcccgccgacctgcatctacatcgccggcatggccgagctcggggccttcttcagcatcctgcaggacatgcgcaacacgatcatggcgtccaagaccgtgggcaccgccgaggagaagctgaagaagaagtccagcttctaccagagctacctccgccggacccagtccatggggatccagctggaccagcgcatcatcctgctctacatgctggagtggggcaaggagatggtcgaccacttccacctgggcgacgacatggaccccgagctccgggggctggcccaggccctgatcgaccagaaggtgaaggagatcagcaaccaggagcccctcaagatctga

SEQ ID NO: 6507 - RNA, 1302 nt, synthetic construct
  misc_feature 1..1302: note = derived and/or modified CDS sequence (opt1) from PUUV(MuEb10Karlstadt/10)__JN696373.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgactacaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgagcggatccgcgagttcatggagaaggagtgccccttcatcaagcccgagatcaagccggggacccccgtgcaggaggccgagttcctcaagcggaacaaggtgtacttcatgcagcgccaggaggtcctggacaagaaccacgtggccgacatcgacaagctgatcgactacgcggccagcggcgaccccacctcccccgacaacatcgagagcccgaacgccccctgggtgttcgcctgcgcccccgaccggtgcccgccgacctgcatctacgtcgcgggcatggccgagctcggggccttcttctccatcctgcaggacatgcgcaacacgatcatggccagcaagaccgtgggcaccgccgaggagaagctgaagaagaagtccagcttctaccagtcctacctccgccggacccagagcatggggatccagctggaccagcgcatcatcctgctctacatgctggagtggggcaaggagatggtggaccacttccacctgggcgacgacatggaccccgagctccgggggctggcgcaggccctgatcgaccagaaggtcaaggagatcagcaaccaggagcccctcaagatctga

SEQ ID NO: 6508 - RNA, 1302 nt, synthetic construct
  misc_feature 1..1302: note = derived and/or modified CDS sequence (opt1) from PUUV(MuEb12Lackenberg/10)__JN696374.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgactacaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactgggccgagcggatccgcgagttcatggagaaggagtgccccttcatcaagcccgagatgaagccggggacccccgcccaggaggccgagttcctcaagcggaacaaggtgtacttcatgcagcgccaggacgtgctggacaagaaccacgtcgcggacatcgacaagctgatcgactacgccgccagcggcgaccccacctcccccgacaacatcgagagcccgaacgccccctgggtgttcgcctgcgcgcccgaccggtgcccgccgacctgcatctacgtggccggcatggccgagctcggggccttcttctccatcctgcaggacatgcgcaacacgatcatggccagcaagaccgtcggcaccgcggaggagaagctgaagaagaagtccagcttctaccagtcctacctccgccggacccagagcatggggatccagctggaccagcgcatcatcctgctctacatgctggagtggggcaaggagatggtggaccacttccacctgggcgacgacatggaccccgagctccgggggctggcccaggccctgatcgaccagaaggtgaaggagatcagcaaccaggagcccctcaagatctga

SEQ ID NO: 6509 - RNA, 1302 nt, synthetic construct
  misc_feature 1..1302: note = derived and/or modified CDS sequence (opt1) from PUUV(Munga/Mg16/05)__GQ339487.1__N
  source 1..1302: mol_type = other RNA
atgagcgacctgaccgacatccaggacgagatcacccgccacgagcagcagctcgtggccgcccggcagaagctgaaggacgcggagcgcgccgtcgagatggaccccgacgacgtgaacaagaacacgctgcaggcccggcagcagaccgtgtccgccctcgaggacaagctggccgacttcaagcgccggatggcggacgccgtcagccgcaagaagatggacaccaagcccaccgaccccacgggcatcgagcccgacgaccacctgaaggagcggtccagcctccgctacgggaacgtgctggacgtgaacgccatcgacatcgaggagccctccggccagaccgccgactggtacaccatcggggtctacgtgatcggcttcaccctgccgatcatcctcaaggcgctgtacatgctgagcacgcgggggcgccagaccgtgaaggagaacaagggcacccggatccgcttcaaggacgacacctccttcgaggacatcaacggcatccggcgccccaagcacctctacgtcagcatgcccacggcccagtccaccatgaaggccgaggagctgacccccgggcggttccgcaccatcgtgtgcggcctgttcccgacgcagatccaggtgcggaacatcatgagccccgtcatgggggtgatcggcttctccttcttcgtgaaggactgggccgagcgcatccgggagttcatggagaaggagtgccccttcatcaagcccgaggtcaagccggggacccccgcccaggagatcgagttcctcaagaagaacaagatctacttcatgcagcgccaggacgtgctggacaagaaccacgtggcggacatcgacaagctgatcgactacgccgccagcggcgaccccacctcccccgacaacatcgagagcccgaacgccccctgggtcttcgcctgcgcgcccgaccggtgcccgccgacctgcatctacgtggccggcatggccgagctcggggccttcttctccatcctgcaggacatgcgcaacacgatcatggccagcaagaccgtgggcaccgcggaggagaagctgaagaagaagtccagcttctaccagtcctacctccgccggacccagagcatggggatccagctggaccagcgcatcatcctgctctacatgctggagtggggcaaggagatggtcgaccacttccacctgggcgacgacatggaccccgagctccgggggctggcccaggccctgatcgaccagaaggtgaaggagatcagcaaccaggagcccctcaagatctga

SEQ ID NO: 6510 - RNA, 1302 nt, synthetic construct
  misc_feature 1..1302: note = derived and/or modified CDS sequence (opt1) from PUUV(Munga/Mg2/05)__GQ339486.1__N
  source 1..1302: mol_type = other RNA
atgagcgacctgaccgacatccaggacgagatcacccgccacgagcagcagctcgtggccgcccggcagaagctgaaggacgcggagcgcgccgtcgagatggaccccgacgacgtgaacaagaacacgctgcaggcccggcagcagaccgtgtccgccctcgaggacaagctggccgacttcaagcgccggatggcggacgccgtcagccgcaagaagatggacaccaagcccaccgaccccacgggcatcgagcccgacgaccacctgaaggagcggtccagcctccgctacgggaacgtgctggacatgaacgccatcgacatcgaggagccctccggccagaccgccgactggtacaccatcggggtgtacgtcatcggcttcaccctgccgatcatcctcaaggcgctgtacatgctgagcacgcgggggcgccagaccgtgaaggagaacaagggcacccggatccgcttcaaggacgacacctccttcgaggacatcaacggcatccggcgccccaagcacctctacgtgagcatgcccacggcccagtccaccatgaaggccgaggagctgacccccgggcggttccgcaccatcgtctgcggcctgttcccgacgcagatccaggtgcggaacatcatgagccccgtgatgggggtcatcggcttctccttcttcgtgaaggactgggccgagcgcatccgggagttcatggagaaggagtgccccttcatcaagcccgaggtgaagccggggacccccgcccaggagatcgagttcctcaagaagaacaagatctacttcatgcagcgccaggacgtcctggacaagaaccacgtggcggacatcgacaagctgatcgactacgccgccagcggcgaccccacctcccccgacaacatcgagagcccgaacgccccctgggtgttcgcctgcgcgcccgaccggtgcccgccgacctgcatctacgtcgccggcatggccgagctcggggccttcttctccatcctgcaggacatgcgcaacacgatcatggccagcaagaccgtgggcaccgcggaggagaagctgaagaagaagtccagcttctaccagtcctacctccgccggacccagagcatggggatccagctggaccagcgcatcatcctgctctacatgctggagtggggcaaggagatggtggaccacttccacctgggcgacgacatggaccccgagctccgggggctggcccaggccctgatcgaccagaaggtcaaggagatcagcaaccaggagcccctcaagatctga

SEQ ID NO: 6511 - RNA, 1302 nt, synthetic construct
  misc_feature 1..1302: note = derived and/or modified CDS sequence (opt1) from PUUV(PUU/Cg-Erft)__AJ238779.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcagatggccgacgcggtgagccgcaagaagatggacaccaagcccaccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgggggcgccagaccgtcaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtgtgcggcctgttcccgacgcagatccaggtccggaacatcatgagccccgtgatgggggtgatcggcttctccttcttcgtcaaggactgggccgaccgcatcaagaagttcatggagaaggagtgccccttcatcaagcccgaggtgaagccggggacccccagccaggaggccgagttcctcaagatgaaccggatctacttcatgcagcgccaggaggtgctggacaagaaccacgtcgccgacatcgacaagctgatcgactacgcggcctccggcgaccccaccagccccgacaacatcgaggccccgaacgccccctgggtgttcgcctgcgcgcccgaccggtgcccgccgacctgcatctacgtggccggcatggccgagctcggggccttcttctccatcctgcaggacatgcgcaacacgatcatggccagcaagaccgtcggcaccgcggaggagaagctgaagaagaagtccagcttctaccagtcctacctccggcgcacccagagcatggggatccagctggaccagcgcatcatcctgctctacatgctggagtggggcaaggagatggtggaccacttccacctgggcgacgacatggaccccgagctccgggggctggcccaggccctgatcgaccagaaggtgaaggagatcagcaaccaggagcccctcaagatctga

SEQ ID NO: 6512 - RNA, 1302 nt, synthetic construct
  misc_feature 1..1302: note = derived and/or modified CDS sequence (opt1) from PUUV(Puu/Kazan)__Z84204.1__N
  source 1..1302: mol_type = other RNA
atgagcgacctgaccgacatccaggaggagatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacgcggtgagccgcaagaagatggacaccaagccgaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccatcccgatcatcctgaaggccctctacatgctgagcacgcgggggcgccagaccgtgaaggagaacaagggcacccggatccgcttcaaggacgacacctccttcgaggacatcaacggcatccggcgccccaagcacctgtacgtgagcatgcccacggcgcagtccaccatgaaggccgaggagctcacccccgggcggttccgcaccatcgtctgcggcctgttcccgacgcagatccaggtgcggaacatcatgagccccgtgatgggggtcatcggcttctccttcttcgtgaaggactggcccgagcgcatccgggacttcatggagaaggagagccccttcatcaagccggaggtgaagcccgggacccccgcccaggagatcgagttcctgaagcgcaaccgggtctacttcatgacccgccaggacgtgctcgacaagaaccacgtggccgacatcgacaagctgatcgactacgccgcgtccggcgaccccaccagcccggacgacatcgagtcccccaacgccccctgggtcttcgcctgcgcccccgaccgctgcccgcccacgtgcatctacgtggccggcatggcggagctgggggccttcttcagcatcctccaggacatgcggaacaccatcatggcctccaagaccgtgggcaccgccgaggagaagctgaagaagaagtccagcttctaccagagctacctgcgccggacgcagagcatggggatccagctcgaccagcgcatcatcctgctgtacatgctcgagtggggcaaggagatggtcgaccacttccacctgggcgacgacatggaccccgagctgcgggggctcgcccagtccctgatcgaccagaaggtgaaggagatcagcaaccaggagcccctgaagatctga

SEQ ID NO: 6513 - RNA, 1302 nt, synthetic construct
  misc_feature 1..1302: note = derived and/or modified CDS sequence (opt1) from PUUV(PUU/Mignovillard/CgY02/2005)__AM695638.1__N
  source 1..1302: mol_type = other RNA
atgggcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtcagcgccctcgaggacaagctggccgacttcaagcggcgcatggccgacgcggtgtcccggaagaagatggacaccaagccgaccgaccccacggggatcgagcccgacgaccacctgaaggagcgcagctccctccggtacggcaacgtgctggacgtcaacgccatcgacatcgaggagcccagcgggcagaccgccgactggtacaccatcggcgtgtacgtgatcgggttcaccctgccgatcatcctcaaggccctgtacatgctgtccacgcgcggccggcagaccgtcaaggagaacaagggcacccgcatccggttcaaggacgacaccagcttcgaggacatcaacgggatccgccggcccaagcacctctacgtgtccatgcccacggcgcagagcaccatgaaggccgaggagctgacccccggccgcttccggaccatcgtgtgcgggctgttcccgacgcagatccaggtccgcaacatcatgtcccccgtgatgggcgtgatcgggttcagcttcttcgtcaaggactggaccgaccggatccgcgagttcatggagaaggagtgccccttcatcaagcccgagatgaagccgggcacccccgcccaggaggccgagttcctcaagcggaacaagatctacttcatgcagcgccaggacgtgctggacaagaaccacgtggccgacatcgacaagctgatcgactacgcggcctccggcgaccccaccagccccgacaacatcgagtccccgaacgccccctgggtcttcgcctgcgcccccgaccggtgcccgcccacgtgcatctacgtggcggggatggccgagctcggcgccttcttcagcatcctgcaggacatgcgcaacaccatcatggcctccaagaccgtggggaccgccgaggagaagctgaagaagaagtccagcttctaccagagctacctccgccggacgcagtccatgggcatccagctggaccagcgcatcatcctgctctacatgctggagtggggcaaggagatggtcgaccacttccacctgggggacgacatggaccccgagctccggggcctggcgcaggccctgatcgaccagaaggtgaaggagatcagcaaccaggagcccctcaagatctga

SEQ ID NO: 6514 - RNA, 1302 nt, synthetic construct
  misc_feature 1..1302: note = derived and/or modified CDS sequence (opt1) from PUUV(PUUV/Croatia_Gerovo/Mg938/2008)__KC676609.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatgggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactggagcgagcgggtgcgcgacttcatggagaaggagtgccccttcatcaagcccgagatcaagccggggacgccccagcaggaggccgagttcctcaagcggaacaaggtgtacttcatgcagcgccaggacgtcctggacaagaaccacgtggccgacatcgacaagctgatcgactacgccgcgtccggcgaccccaccagccccgacaacatcgagtccccgaacgccccctgggtgttcgcctgcgcccccgaccggtgcccgccgacctgcatctacgtcgccggcatggcggagctcggggccttcttcagcatcctgcaggacatgcgcaacaccatcatggcctccaagaccgtgggcaccgccgaggagaagctgaagaagaagtccagcttctaccagagctacctccgccggacccagagcatggggatccagctggaccagcgcatcatcctgctctacatgctggagtggggcaaggagatggtggaccacttccacctgggcgacgacatggaccccgagctccgggggctggcccaggcgctgatcgaccagaaggtcaaggagatctccaaccaggagcccctcaagatctga

SEQ ID NO: 6515 - RNA, 1302 nt, synthetic construct
  misc_feature 1..1302: note = derived and/or modified CDS sequence (opt1) from PUUV(PUUV/Croatia_Gerovo/Mg979/2008)__KC676613.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactggagcgagcgggtgcgcgacttcatggagaaggagtgccccttcatcaagcccgagatcaagccggggaccccgccccaggaggccgagttcctcaagcggaacaaggtgtacttcatgcagcgccaggacgtcctggacaagaaccacgtggccgacatcgacaagctgatcgactacgccgcgtccggcgaccccaccagccccgacaacatcgagtcccccaacgccccctgggtgttcgcctgcgcccccgaccggtgcccgccgacctgcatctacgtcgccggcatggcggagctcggggccttcttcagcatcctgcaggacatgcgcaacacgatcatggcctccaagaccgtgggcaccgccgaggagaagctgaagaagaagtccagcttctaccagagctacctccgccggacccagagcatggggatccagctggaccagcgcatcatcctgctctacatgctggagtggggcaaggagatggtggaccacttccacctgggcgacgacatggaccccgagctccgggggctggcccaggcgctgatcgaccagaaggtcaaggagatctccaaccaggagcccctcaagatctga

SEQ ID NO: 6516 - RNA, 1302 nt, synthetic construct
  misc_feature 1..1302: note = derived and/or modified CDS sequence (opt1) from PUUV(PUUV/Konnevesi/Mg_M114B/2005)__JQ319171.1__N
  source 1..1302: mol_type = other RNA
atgagcgacctgaccgacatccaggaggacatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacgcggtgagccgcaagaagatggacaccaagcccaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccctgccgatcatcctcaaggccctgtacatgctgagcacgcgggggcgccagaccgtgaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtctgcggcctgttcccgacgcagatccaggtgcggaacatcatgagccccgtgatgggggtcatcggcttctccttcttcgtgaaggactggcccgagcgcatccgggagttcatggagaaggagtgccccttcatcaagccggaggtgaagcccgggacccccgcccaggagatcgagatgctcaagcgcaacaagatctacttcatgcagcggcaggacgtcctggacaagaaccacgtggccgacatcgacaagctgatcgactacgccgcgagcggcgaccccacctccccggacaacatcgacagccccaacgccccctgggtgttcgcctgcgcccccgaccgctgcccgccgacctgcatctacgtcgccggcatggcggagctcggggccttcttctccatcctgcaggacatgcgcaacacgatcatggccagcaagaccgtgggcaccgccgaggagaagctgaagaagaagtccagcttctaccagtcctacctccggcgcacccagagcatggggatccagctggaccagcggatcatcctcctgttcatgctggagtggggcaaggagatggtggaccacttccacttcggcgacgacatggaccccgagctgcgcgggctcgcccaggcgctgatcgaccagaaggtcaaggagatcagcaaccaggagcccctgaagatctga

SEQ ID NO: 6517 - RNA, 1302 nt, synthetic construct
  misc_feature 1..1302: note = derived and/or modified CDS sequence (opt1) from PUUV(PUUV/Konnevesi/Mg_M94A/2005)__JQ319163.2__N
  source 1..1302: mol_type = other RNA
atgagcgacctgaccgacatccaggaggacatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacgcggtgagccgcaagaagatggacaccaagcccaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccctgccgatcatcctcaaggccctgtacatgctgagcacgcgggggcgccagaccgtgaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtctgcggcctgttcccgacgcagatccaggtgcggaacatcatgagccccgtgatgggggtcatcggcttctccttcttcgtgaaggactggcccgagcgcatcaaggagttcatggagaaggagtgccccttcatcaagccggaggtgaagcccgggacccccgcccaggagatcgagatgctcaagcggaacaagatctacttcatgcagcgccaggacgtcctggacaagaaccacgtggccgacatcgacaagctgatcgactacgccgcgagcggcgaccccacctccccggacaacatcgacagccccaacgccccctgggtgttcgcctgcgcccccgaccggtgcccgccgacctgcatctacgtcgccggcatggcggagctcggggccttcttctccatcctgcaggacatgcgcaacacgatcatggccagcaagaccgtgggcaccgccgaggaggaggtgaagaagaagtccagcttctaccagtcctacctgcgccggacccagagcatggggatccagctcgaccagcgcatcatcctgctgttcatgctcgagtggggcaaggagatggtcgaccacttccacctgggcgacgacatggaccccgagctgcgggggctcgcccaggcgatgatcgaccagaaggtgaaggagatcagcaaccaggagcccctgaagatctga

SEQ ID NO: 6518 - RNA, 1302 nt, synthetic construct
  misc_feature 1..1302: note = derived and/or modified CDS sequence (opt1) from PUUV(PUUV/Konnevesi/Mg_O14B/2005)__JQ319166.1__N
  source 1..1302: mol_type = other RNA
atgagcgacctgaccgacatccaggaggacatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacgcggtgagccgcaagaagatggacaccaagcccaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccctgccgatcatcctcaaggccctgtacatgctgagcacgcgggggcgccagaccgtgaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtctgcggcctgttcccgacgcagatccaggtgcggaacatcatgagccccgtgatgggggtcatcggcttctccttcttcgtgaaggactggcccgagcgcatccgggagttcatggagaaggagtgccccttcatcaagccggaggtgaagcccgggacccccgcccaggagatcgagatgctcaagcgcaacaagatctacttcatgcagcggcaggacgtcctggacaagaaccacgtggccgacatcgacaagctgatcgactacgccgcgagcggcgaccccacctccccggacaacatcgacagccccaacgccccctgggtgttcgcctgcgcccccgaccgctgcccgccgacctgcatctacgtcgccggcatggcggagctcggggccttcttctccatcctgcaggacatgcgcaacacgatcatggccagcaagaccgtgggcaccgccgaggagaagctgaagaagaagtccagcttctaccagtcctacctccggcgcacccagagcatggggatccagctggaccagcggatcatcctcctgttcatgctggagtggggcaaggagatggtggaccacttccacctgggcgacgacatggaccccgagctccgcgggctggcccaggcgctgatcgaccagaaggtcaaggagatcagcaaccaggagcccctcaagatctga

SEQ ID NO: 6519 - RNA, 1302 nt, synthetic construct
  misc_feature 1..1302: note = derived and/or modified CDS sequence (opt1) from PUUV(PUUV/Konnevesi/Mg_O22B/2005)__JQ319168.2__N
  source 1..1302: mol_type = other RNA
atgagcgacctgaccgacatccaggaggacatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacgcggtgagccgcaagaagatggacaccaagcccaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccctgccgatcatcctcaaggccctgtacatgctgagcacgcgggggcgccagaccgtgaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtctgcggcctgttcccgacgcagatccaggtgcggaacatcatgagccccgtgatgggggtcatcggcttctccttcttcgtgaaggactggcccgagcgcatccgggagttcatggagaaggagtgccccttcatcaagccggaggtgaagcccgggacccccgcccaggagatcgagatgctcaagcgcaacaagatctacttcatgcagcggcaggacgtcctggacaagaaccacgtggccgacatcgacaagctgatcgactacgccgcgagcggcgaccccacctccccggagaacatcgacagccccaacgccccctgggtgttcgcctgcgcccccgaccgctgcccgccgacctgcatctacgtcgccggcatggcggagctcggggccttcttctccatcctgcaggacatgcgcaacacgatcatggccagcaagaccgtgggcaccgccgaggagaagctgaagaagaagtccagcttctaccagtcctacctccggcgcacccagagcatggggatccagctggaccagcggatcatcctcctgttcatgctggagtggggcaaggagatggtggaccacttccacctgggcgacgacatggaccccgagctccgcgggcacgcccaggcgctgatcgaccagaaggtcaaggagatcagcaaccaggagcccctgaagatctga

SEQ ID NO: 6520 - RNA, 1302 nt, synthetic construct
  misc_feature 1..1302: note = derived and/or modified CDS sequence (opt1) from PUUV(PUUV/Konnevesi/Mg_O57A/2005)__JQ319161.2__N
  source 1..1302: mol_type = other RNA
atgagcgacctgaccgacatccaggaggacatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacgcggtgagccgcaagaagatggacaccaagcccaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccctgccgatcatcctcaaggccctgtacatgctgagcacgcgggggcgccagaccgtgaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtctgcggcctgttcccgacgcggatccaggtgcgcaacatcatgagccccgtgatgggggtcatcggcttctccttcttcgtgaaggactggcccgagcggatcaaggagttcatggagaaggagtgcagcttcatcaagcccgaggtgaagccggggacccccgcccaggagatcgagatgctcaagcgcaacaagatctacttcatgcagcggcaggacgtcctggacaagaaccacgtggccgacatcgacaagctgatcgactacgccgcgtccggcgaccccaccagccccgacaacatcgactccccgaacgccccctgggtgttcgcctgcgcccccgaccgctgcccgccgacctgcatctacgtcgccggcatggcggagctcggggccttcttcagcatcctgcaggacatgcgcaacacgatcatggcctccaagaccgtgggcaccgccgaggaggaggtgaagaagaagtccagcttctaccagagctacctgcggcgcacccagagcatggggatccagctcgaccagcggatcatcctgctgttcatgctcgagtggggcaaggagatggtcgaccacttccacctgggcgacgacatggaccccgagctgcgcgggctcgcccaggcgctgatcgaccagaacgtgaaggagatctccaaccaggagcccctgaagatctga

SEQ ID NO: 6521 - RNA, 1302 nt, synthetic construct
  misc_feature 1..1302: note = derived and/or modified CDS sequence (opt1) from PUUV(PUUV/Konnevesi/Mg_O6B/2005)__JQ319164.1__N
  source 1..1302: mol_type = other RNA
atgagcgacctgaccgacatccaggaggacatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacgcggtgagccgcaagaagatggacaccaagcccaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccctgccgatcatcctcaaggccctgtacatgctgagcacgcgggggcgccagaccgtgaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcgccatcgtctgcggcctgttcccgacccagatccaggtgcggaacatcatgagccccgtgatgggggtcatcggcttctccttcttcgtgaaggactggcccgagcgcatccgggagttcatggggaaggagtgccccttcatcaagccggaggtgaagcccggcacgcccgcccaggagatcgagatgctcaagcgcaacaagatctacttcatgcagcggcaggacgtcctggacaagaaccacgtggccgacatcgacaagctgatcgactacgcggccagcggcgaccccacctccccggacaacatcgacagccccaacgccccctgggtgttcgcctgcgcccccgaccgctgcccgccgacctgcatctacgtcgcggggatggccgagctcggcgccttcttctccatcctgcaggacatgcgcaacaccatcatggccagcaagacggtggggaccgccgaggagaagctgaagaagaagtccagcttctaccagtcctacctccggcgcacccagagcatgggcatccagctggaccagcggatcatcctcctgttcatgctggagtggggcaaggagatggtggaccacttccacctgggggacgacatggaccccgagctccgcggcctggcgcaggccctgatcgaccagaaggtcaaggagatcagcaaccaggagcccctcaagatctga

SEQ ID NO: 6522 - RNA, 1302 nt, synthetic construct
  misc_feature 1..1302: note = derived and/or modified CDS sequence (opt1) from PUUV(PUUV/Konnevesi/Mg_O74B/2005)__JQ319170.1__N
  source 1..1302: mol_type = other RNA
atgagcgacctgaccgacatccaggaggacatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacgcggtgagccgcaagaagatggacaccaagcccaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccctgccgatcatcctcaaggccctgtacatgctgagcacgcgggggcgccagaccgtgaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtctgcggcctgttcccgacgcagatccaggtgcggaacatcatgagccccgtgatgggggtcatcggcttctccttcttcgtgaaggactggcccgagcgcatccgggagttcatggagaaggagtgccccttcatcaagccggaggtgaagcccgggacccccgcccaggagatcgagatgctcaagcgcaacaagatctacttcatgcagcggcaggacgtcctggacaagaaccacgtggccgacatcgacaagctgatcgactacgccgcgagcggcgaccccacctccccggacaacatcgacagccccaacgccccctgggtgttcgcctgcgcccccgaccgctgcccgccgacctgcatctacgtcgccggcatggcggagctcggggccttcttctccatcctgcaggacatgcgcaacacgatcatggccagcaagaccgtgggcaccgtggaggagaagctgaagaagaagtccagcttctaccagtcctacctccggcgcacccagagcatggggatccagctggaccagcggatcatcctcctgttcatgctggagtggggcaaggagatggtcgaccacttccacctgggcgacgacatggaccccgagctccgcgggctggcccaggccctgatcgaccagaaggtgaaggagatcagcaaccaggagcccctcaagatctga

SEQ ID NO: 6523 - RNA, 1302 nt, synthetic construct
  misc_feature 1..1302: note = derived and/or modified CDS sequence (opt1) from PUUV(PUUV/Konnevesi/Mg_O78A/2005)__JQ319162.2__N
  source 1..1302: mol_type = other RNA
atgagcgacctgaccgacatccaggaggacatcacccgccacgagcagcagctcgtggtcgcccggcagaagctgaaggacgccgagaaggcggtggaggtggaccccgacgacgtcaacaagaacacgctgcaggcccgccagcagaccgtgtccgccctcgaggacaagctggccgactacaagcggcgcatggccgacgcggtgagccggaagaagatggacaccaagcccaccgaccccacgggcatcgagcccgacgaccacctgaaggagcgctccagcctccggtacgggaacgtcctggacgtgaacgccatcgacatcgaggagccctccggccagaccgccgactggtacaccatcggggtgtacgtcatcggcttcaccctgccgatcatcctcaaggccctgtacatgctgagcacgcgcgggcggcagaccgtgaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtctgcggcctgttcccgacgcagatccaggtgcgcaacatcatgagccccgtgatgggggtcatcggcttctccttcttcgtgaaggactggcccgagcggatccgcgagttcatggagaaggagtgccccttcatcaagccggaggtgaagcccgggacccccgcccaggagatcgagatgctcaagcggaacaagatctacttcatgcagcgccaggacgtcctggacaagaaccacgtggccgacatcgacaagctgatcgactacgccgcgagcggcgaccccacctccccggacaacatcgacagccccaacgccccctgggtgctcgcctgcggccccgagcggtgcccgccgacctgcatctacgtcgccgggatggccgagctgggcgcgttcttctccatcctgcaggacatgcgcaacacgatcatggccagcaagaccgtggggtccgacgaggtgaagctcaagaagaagtccttcttctaccagtactacctgcgccggacccacagcatgggcatccagctggaccagcgcatcatcctcctgtgcatgctggagtggggcatcgagatggtcgaccacttccacctcggggacgacatggaccccgagctgcggggcctggcccaggccatgatcgaccagaaggtgaaggagatcagcaaccaggagcccctcatcatctga

SEQ ID NO: 6524 - RNA, 1302 nt, synthetic construct
  misc_feature 1..1302: note = derived and/or modified CDS sequence (opt1) from PUUV(PUUV/Mg23/HungaryTR17/00)__FN377822.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactggagcgagcgggtgcgcgagttcatggagaaggagtgccccttcatcaagcccgagatcaagccggggaccccgccccaggaggccgagttcctcaagcggaacaaggtgtacttcatgcagcgccaggacgtcctggacaagaaccacgtggccgacatcgacaagctgatcgactacgccgcgtccggcgaccccaccagccccgacaacatcgagtcccccaacgccccctgggtgttcgcctgcgcccccgaccggtgcccgccgacctgcatctacgtcgccggcatggcggagctcggggccttcttcagcatcctgcaggacatgcgcaacacgatcatggcctccaagaccgtgggcaccgccgaggagaagctgaagaagaagtccagcttctaccagagctacctccgccggacccagagcatggggatccagctggaccagcgcatcatcctgctctacatgctggagtggggcaaggagatggtggaccacttccacctgggcgacgacatggaccccgagctccgggggctggcccaggcgctgatcgaccagaaggtcaaggagatctccaaccaggagcccctcaagatctga

SEQ ID NO: 6525 - RNA, 1302 nt, synthetic construct
  misc_feature 1..1302: note = derived and/or modified CDS sequence (opt1) from PUUV(PUUV/Mg9/HungaryTR17/00)__FN377821.1__N
  source 1..1302: mol_type = other RNA
atgagcgacctggccgacatccaggaggacatcacccgccacgagcagcagctcgtggtcgcccggcagaagctgaaggacgcggagaaggccgtggagatggaccccgacgacgtgaacaagaacaccctgcaggcccgccagcagacggtctccgccctcgaggacaagctggccgacttcaagcggcgcatggcggacgccgtgagccggaagaagatggacaccaagcccaccgaccccaccggcatcgagcccgacgaccacctgaaggagcgctccagcctccggtacgggaacgtgctggacgtcaacgccatcgacatcgaggagccctccggccagacggccgactggtacaccatcggggtgtacgtgatcggcttcaccctgccgatcatcctcaaggcgctgtacatgctgagcacccgcgggcggcagacggtcaaggagaacaagggcacccgcatccggttcaaggacgacacctccttcgaggacatcaacggcatccgccggcccaagcacctctacgtgagcatgcccaccgcccagtccacgatgaaggccgaggagctgacccccgggcgcttccggaccatcgtgtgcggcctgttcccgacccagatccaggtccgcaacatcatgagccccgtgatgggggtgatcggcttctccttcttcgtcaaggactggagcgagcgggtgcgcgagttcatggagaaggagtgccccttcatcaagcccgagatcaagccggggacgccgccccaggaggccgagttcctcaagcggaacaaggtgtacttcatgcagcgccaggacgtcctggacaagaaccacgtggccgacatcgacaagctgatcgactacgcggcctccggcgaccccaccagccccgacaacatcgagtcccccaacgccccctgggtgttcgcctgcgcccccgaccggtgcccgccgacctgcatctacgtcgcgggcatggccgagctcggggccttcttcagcatcctgcaggacatgcgcaacaccatcatggcctccaagacggtgggcaccgccgaggagaagctgaagaagaagtccagcttctaccagagctacctccgccggacccagagcatggggatccagctggaccagcgcatcatcctgctctacatgctggagtggggcaaggagatggtggaccacttccacctgggcgacgacatggaccccgagctccgggggctggcgcaggccctgatcgaccagaaggtcaaggagatctccaaccaggagcccctcaagatctga

SEQ ID NO: 6526 - RNA, 1302 nt, synthetic construct
  misc_feature 1..1302: note = derived and/or modified CDS sequence (opt1) from PUUV(PUUV/NL/Mg1012/2010)__KU314900.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgactacaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactggcccgaccggatccgcgagttcatggagaaggagtgccccttcatcaagccggaggtgaagcccgggacccccgcccaggaggccgagttcctcaagcggaacaaggtgtacttcatgcagcgccaggacgtcctggacaagaaccacgtggccgacatcgacaagctgatcgactacgcggccagcggcgaccccacctccccggacaacatcgagagccccaacgccccctgggtgttcgcctgcgcccccgaccggtgcccgccgacctgcatctacgtcgcgggcatggccgagctcggggccttcttctccatcctgcaggacatgcgcaacacgatcatggccagcaagaccgtgggcgccgcggaggagaagctgaagaagaagtccagcttctaccagtcctacctccgccggacccagagcatggggatccagctggaccagcgcatcatcctgctctacatgctggagtggggcaaggagatggtggaccacttccacctgggcgacgacatggaccccgagctccgggggctggcccaggccctgatcgaccagaaggtcaaggagatcagcaaccaggagcccctcaagatctga

SEQ ID NO: 6527 - RNA, 1302 nt, synthetic construct
  misc_feature 1..1302: note = derived and/or modified CDS sequence (opt1) from PUUV(PUUV/NL/Mg1439/2011)__KU314901.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgactacaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcgcgcgcatccggttcaaggacgacacctccttcgaggacatcaacggcatccgccggcccaagcacctctacgtgagcatgcccaccgcccagtccacgatgaaggccgaggagctgacccccgggcgcttccggaccatcgtgtgcggcctgttcccgacccagatccaggtccgcaacatcatgagccccgtgatgggggtgatcggcttctccttcttcgtcaaggactggcccgaccggatccgcgagttcatggagcgggagtgccccttcatcaagccggaggtgaagcccgggacgcccgcccaggaggccgagttcctcaagcgcaacaaggtgtacttcatgcagcggcaggacgtcctggacaagaaccacgtggcggacatcgacgagctgatcgactacgccgccagcggcgaccccacctccccggacaacatcgagagccccaacgccccctgggtgttcgcctgcgcgcccgaccgctgcccgccgacctgcatctacgtcgccggcatggccgagctcggggccttcttctccatcctgcaggacatgcgcaacaccatcatggccagcaagacggtgggcaccgcggaggagaagctgaagaagaagtccagcttctaccagtcctacctccggcgcacccagagcatggggatccagctggaccagcggatcatcctgctctacatgctggagtggggcaaggagatggtggaccacttccacctgggcgacgacatggaccccgagctccgcgggctggcccaggccctgatcgaccagaaggtcaaggagatcagcaaccaggagcccctcaagatctga

SEQ ID NO: 6528 - RNA, 1302 nt, synthetic construct
  misc_feature 1..1302: note = derived and/or modified CDS sequence (opt1) from PUUV(PUUV/NL/Mg2/2008)__KU314902.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagacgaccctgcaggcccgccagcagaccgtctccgccctcgaggacaagctggccgacttcaagcggcagatggccgacgcggtgagccgcaagaagatggacaccaagcccgccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggcgctgtacatgctgagcacgcgggggcgccagaccgtcaaggagaacaagggcacccggatccgcttcaaggacgacacctccttcgaggacatcaacggcatccggcgccccaagcacctctacgtgagcatgcccacggcccagtccaccatgaaggccgaggagctgacccccgggcggttccgcaccatcgtgtgcggcctgttcccgacgcagatccaggtccggaacatcatgagccccgtgatgggggtgatcggcttctccttcttcgtcaaggactgggccgaccgcatccgggagttcatggagaaggagtgccccttcatcaagcccgacgtgaagccggggacccccgcccaggaggcggagttcctcaagcgcaacaagatctacttcatgcagcggcaggaggtgctggacaagaaccacgtcgccgacatcgacaagctgatcgactacgccgccagcggcgaccccacctcccccgacaacatcgagagcccgaactccccctgggtgttcgcctgcgcgcccgaccgctgcccgccgacctgcatctacgtggccggcatggccgagctcggggccttcttcagcatcctgcaggacatgcggaacacgatcatggcctccaagaccgtcggcaccgcggaggagaagctgaagaagaagtccagcttctaccagagctacctccgccgcacccagagcatggggatccagctggaccagcggatcatcctgctctacatgctggagtggggcaaggagatggtggaccacttccacctgggcgacgacatggaccccgagctccgcgggctggcccaggccctgatcgaccagaaggtggaggagatctccaaccaggagcccctcaagatctga

SEQ ID NO: 6529 - RNA, 1302 nt, synthetic construct
  misc_feature 1..1302: note = derived and/or modified CDS sequence (opt1) from PUUV(PUUV/NL/Mg25/2007)__KU314897.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgactacaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactggcccgaccggatccgcgagttcatggagaaggagtgccccttcatcaagccggaggtgaagcccgggacccccgcccaggaggccgagttcctcaagcggaacaaggtgtacttcatgcagcgccaggacgtcctggacaagaaccacgtggccgacatcgacaagctgatcgactacgcggccagcggcgaccccacctccccggacaacatcgagagccccaacgccccctgggtgttcgcctgcgcccccgaccggtgcccgccgacctgcatctacgtcgcgggcatggccgagctcggggccttcttctccatcctgcaggacatgcgcaacacgatcatggccagcaagaccgtgggcaccgccgaggagaagctgaagaagaagtccagcttctaccagtcctacctccgccggacccagagcatggggatccagctggaccagcgcatcatcctgctctacatgctggagtggggcaaggagatggtggaccacttccacctgggcgacgacatggaccccgagctccgggggctggcgcaggccctgatcgaccagaaggtcaaggagatcagcaaccaggagcccctcaagatctga

SEQ ID NO: 6530 - RNA, 1302 nt, synthetic construct
  misc_feature 1..1302: note = derived and/or modified CDS sequence (opt1) from PUUV(PUUV/NL/Mg31/2007)__KU314896.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgactacaagcggcgcatggccgacgcggtgagccggaagaagatggacaccaagcccaccgaccccacgggcatcgagcccgacgaccacctgaaggagcgctccagcctccggtacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgcgggcggcagaccgtcaaggagaacaagggcacccgcatccggttcaaggacgacacctccttcgaggacatcaacggcatccgccggcccaagcacctctacgtgagcatgcccacggcgcagtccaccatgaaggccgaggagctgacccccgggcgcttccggaccatcgtgtgcggcctgttcccgacgcagatccaggtccgcaacatcatgagccccgtgatgggggtgatcggcttctccttcttcgtcaaggactggcccgaccggatccgcgagttcatggagaaggagtgccccttcatcaagccggaggtgaagcccgggacccccgcccaggaggccgagttcctcaagcggaacaaggtgtacttcatgcagcgccaggacgtccccgacaagaaccacgtggccgacatcgacaagctgatcgactacgcggccagcggcgacccgacctcccccgacaacatcgagagccccaacgccccctgggtgttcgcctgcgccccggaccggtgcccgccgacctgcatctacgtcgcgggcatggccgagctgggggccttcttctccatcctccaggacatgcgcaacacgatcatggccagcaagaccgtgggcaccgccgaggagaagctgaagaagaagtccagcttctaccagtcctacctgcgccggacccagagcatggggatccagctcgaccagcgcatcatcctgctgtacatgctcgagtggggcaaggagatggtggaccacttccacctgggcgacgacatggaccccgagctgcgggggctcgcgcaggccctgatcgaccagaaggtcaaggagatcagcaaccaggagcccctgaagatctga

SEQ ID NO: 6531 - RNA, 1302 nt, synthetic construct
  misc_feature 1..1302: note = derived and/or modified CDS sequence (opt1) from PUUV(PUUV/NL/Mg502/2008)__KU314904.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcagatggccgacgcggtgagccgcaagaagatggacaccaagcccgccgaccccaccggcatcgagcccgacgaccacctgaaggagcggtccagcctccgctacgggaacgtgctggacgtcaacgccatcgacatcgaggagccctccggccagacggccgactggtacaccatcggggtgtacgtgatcggcttcaccctgccgatcatcctcaaggcgctgtacatgctgagcacccgggggcgccagacggtcaaggagaacaagggcacccggatccgcttcaaggacgacacctccttcgaggacatcaacggcatccggcgccccaagcacctctacgtgagcatgcccaccgcccagtccacgatgaaggccgaggagctgacccccgggcggttccgcaccatcgtgtgcggcctgttcccgacccagatccaggtccggaacatcatgagccccgtgatgggggtgatcggcttctccttcttcgtcaaggactgggccgaccgcatccgggagttcatggagaaggagtgccccttcatcaagcccgacgtgaagccggggacgcccgcccaggaggcggagttcctcaagcgcaacaagatctacttcatgcagcggcaggaggtgctggacaagaaccacgtcgccgacatcgacaagctgatcgactacgccgccagcggcgaccccacctcccccgacaacatcgagagcccggactccccctgggtgttcgcctgcgcgcccgaccgctgcccgccgacctgcatctacgtggccggcatggccgagctcggggccttcttcagcatcctgcaggacatgcggaacaccatcatggcctccaagacggtcggcaccgcggaggagaagctgaagaagaagtccagcttctaccagagctacctccgccgcacccagagcatggggatccagctggaccagcggatcatcctgctctacatgctggagtggggcaaggagatggtggaccacttccacctgggcgacgacatggaccccgagctccgcgggctggcccaggccctgatcgaccagaaggtgaaggagatctccaaccaggagcccctcaagatctga

SEQ ID NO: 6532 - RNA, 1302 nt, synthetic construct
  misc_feature 1..1302: note = derived and/or modified CDS sequence (opt1) from PUUV(PUUV/NL/Mg591/2008)__KU314905.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcagatggccgacgcggtgagccgcaagaagatggacaccaagcccaccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgggggcgccagaccgtcaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtgtgcggcctgttcccgacgcagatccaggtccggaacatcatgagccccgtgatgggggtgatcggcttctccttcttcgtcaaggactgggccgaccgcatccgggagttcatggagaaggagtgccccttcatcaagcccgacgtgaagccggggacccccgcccaggaggccgagttcctcaagcgcaacaagatctacttcatgcagcggcaggaggtgctggacaagaaccacgtcgcggacatcgacaagctgatcgactacgccgccagcggcgaccccacctcccccgacaacatcgagagcccgaactccccctgggtgttcgcctgcgcccccgaccgctgcccgccgacctgcatctacgtggcgggcatggccgagctcggggccttcttcagcatcctgcaggacatgcggaacacgatcatggcctccaagaccgtcggcaccgccgaggagaagctgaagaagaagtccagcttctaccagagctacctccgccgcacccagagcatggggatccagctggaccagcggatcatcctgctctacatgctggagtggggcaaggagatggtggaccacttccacctgggcgacgacatggaccccgagctccgctccctggcgcaggccctgatcgaccagaaggtgaaggagatcagcaaccaggagcccctcaagatctga

SEQ ID NO: 6533 - RNA, 1302 nt, synthetic construct
  misc_feature 1..1302: note = derived and/or modified CDS sequence (opt1) from PUUV(Samara_49/CG/2005)__AB433843.2__N
  source 1..1302: mol_type = other RNA
atgagcgacctgaccgacatccaggaggagatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacgcggtgagccgcaagaagatggacaccaagccgaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccatcccgatcatcctgaaggccctctacatgctgagcacgcgggggcgccagaccgtgaaggagaacaagggcacccggatccgcttcaaggacgacacctccttcgaggacatcaacggcatccggcgccccaagcacctgtacgtgagcatgcccacggcgcagtccaccatgaaggccgaggagctcacccccgggcggttccgcaccatcgtctgcggcctgttcccgacgcagatccaggtgcggaacatcatgagccccgtgatgggggtcatcggcttctccttcttcgtgaaggactggcccgagcgcatccgggagttcatggagcgcgagtgccccttcatcaagccggaggtgaagcccgggacccccgcccaggaggtcgagttcctgaagcggaaccgcgtgtacttcatgacccgccaggacgtgctcgacaagaaccacgtcgccgacatcgacaagctgatcgactacgccgcgagcggcgaccccacctccccggacgacatcgagagccccaacgccccctgggtgttcgcctgcgcccccgaccggtgcccgcccacgtgcatctacgtggccggcatggcggagctgggggccttcttctccatcctccaggacatgcgcaacaccatcatggccagcaagaccgtcggcaccgccgaggagaagctgaagaagaagtccagcttctaccagtcctacctgcggcgcacgcagagcatggggatccagctcgaccagcggatcatcctgctgtacatgctcgagtggggcaaggagatggtggaccacttccacctgggcgacgacatggaccccgagctgcgcgggctcgcccagagcctgatcgaccagaaggtcaaggagatctccaaccaggagcccctgaagatctga

SEQ ID NO: 6534 - RNA, 1302 nt, synthetic construct
  misc_feature 1..1302: note = derived and/or modified CDS sequence (opt1) from PUUV(Thuin/33Cg/96)__AJ277030.1__N
  source 1..1302: mol_type = other RNA
atgagcgacctgaccgacatccaggaggacatcacccgccacgagcagcagctcgtggtcgcccggcagaagctgaaggacgccgagaaggcggtggagatggaccccgacgacgtgaacaagaacacgctgcaggcccgccagcagaccgtctccgccctcgaggacaagctggccgacttcaagcggcagatggccgacgcggtgagccgcaagaagatggacaccaagcccaccgaccccacgggcatcgagcccgacgaccacctgaaggagcggtccagcctccgctacgggaacgtgctggacgtcaacgccatcgacatcgaggagccctccggccagaccgccgactggtacaccatcggggtgtacgtgatcggcttcaccctgccgatcatcctcaaggccctgtacatgctgagcacgcgggggcgccagaccgtcaaggagaacaagggcacccggatccgcttcaaggacgacacctccttcgaggacatcaacggcatccggcgccccaagcacctctacgtgagcatgcccacggcgcagtccaccatgaaggccgaggagctgacccccgggcggttccgcaccatcgtgtgcggcctgttcccgacgcagatccaggtccggaacatcatgagccccgtgatgggggtgatcggcttctccttcttcgtcaaggactgggccgaccgcatccgggagttcatggagaaggagtgccccttcatcaagcccgaggtgaagccggggacccccgtgcaggaggccgagttcctcaagcgcaacaagatctacttcatgcagcggcaggaggtcctggacaagaaccacgtggccgacatcgacaagctgatcgactacgcggccagcggcgaccccacctcccccgacaacatcgaggccccgaacgccccctgggtgttcgcctgcgcgcccgaccgctgcccgccgacctgcatctacgtcgccggcatggccgagctcggggccttcttcagcatcctgcaggacatgcggaacacgatcatggcctccaagaccgtgggcaccgcggaggagaagctgaagaagaagtccagcttctaccagagctacctccgccgcacccagtccatggggatccagctggaccagcggatcatcctgctctacatgctggagtggggcaaggagatggtggaccacttccacctgggcgacgacatggaccccgagctccgcgggctggcccaggccctgatcgaccagaaggtcaaggagatcagcaaccaggagcccctcaagatctga

SEQ ID NO: 6535 - RNA, 1302 nt, synthetic construct
  misc_feature 1..1302: note = derived and/or modified CDS sequence (opt1) from PUUV(Udmurtia/338Cg/92)__Z30708.1__N
  source 1..1302: mol_type = other RNA
atgagcgacctgaccgacatccaggaggagatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacagcgtgtcccgcaagaagatggacaccaagccgaccgaccccacgggcatcgagcccgacgaccacctgaaggagcggagcagcccccgctacgggaacgtcctcgacgtgaacgcgatcgacatcgaggagccgagcggccagaccgccgactggtacaccatcggggtgtacgtcatcggcttcaccatccccatcatcctgaaggccctgtacatgctctccacgcgggggcgccagaccatcaaggagaacaagggcacccggatccgcttcaaggacgacaccagcttcgaggacatcaacggcatccggcgccccaagcacctgtacgtgtccatgcccacggcccagagcaccatgaaggcggaggagctgaccccggggcggttccgcaccatcgtgtgcggcctcttccccacgcagatccaggtccggaacatcatgtcccccgtgatgggggtgatcggcttcagcttcttcgtcaaggactggcccgagcgcatccgggacttcatggagaaggagtgcccgttcatcaagcccgaggtgaagcccgggacccccgcccaggagatcgagttcctgaagcgcaaccgggtgtacttcatgacccgccaggacgtcctggacaagaaccacgtggccgacatcgacaagctcatcgactacgccgcctccggcgacccgaccagccccgacgacatcgagtcccccaacgcgccctgggtgttcgcctgcgccccggaccgctgcccgcccacgtgcatctacgtcgccggcatggccgagctgggggcgttcttcagcatcctgcaggacatgcggaacaccatcatggcctccaagaccgtgggcaccgccgaggagaagctcaagaagaagtcctccttctaccagagctacctgcgccggacgcagagcatggggatccagctggaccagcgcatcatcctcctgtacatgctggagtggggcaaggagatggtggaccacttccacctcggcgacgacatggaccccgagctgcgggggctggcccagtccctcatcgaccagaaggtcaaggagatcagcaaccaggagcccctgaagatctga

SEQ ID NO: 6536 - RNA, 1302 nt, synthetic construct
  misc_feature 1..1302: note = derived and/or modified CDS sequence (opt1) from PUUV(Udmurtia/444Cg/88)__Z30706.1__N
  source 1..1302: mol_type = other RNA
atgagcgacctgaccgacatccaggaggagatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacgcggtgagccgcaagaagatggacaccaagccgaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccatcccgatcatcctgaaggccctctacatgctgagcacgcgggggcgccagaccgtgaaggagaacaagggcacccggatccgcttcaaggacgacacctccttcgaggacatcaacggcatccggcgccccaagcacctgtacgtgagcatgcccacggcgcagtccaccatgaaggccgaggagctcacccccgggcggttccgcaccatcgtctgcggcctgttcccgacgcagatccaggtgcggaacatcatgagccccgtgatgggggtcatcggcttctccttcttcgtgaaggactggcccgagcgcatccgggacttcatggagaaggagtgccccttcatcaagccggaggtgaagcccgggacccccgcccaggagatcgagttcctgaagcgcaaccgggtctacttcatgacccgccaggacgtgctcgacaagaaccacgtggccgacatcgacaagctgatcgactacgccgcgagcggcgaccccacctccccggacgacatcgagagccccaacgccccctgggtcttcgcctgcgcccccgaccgctgcccgcccacgtgcatctacgtggccggcatggcggagctgggggccttcttctccatcctccaggacatgcggaacaccatcatggccagcaagaccgtgggcaccgccgaggagaagctgaagaagaagtccagcttctaccagtcctacctgcgccggacgcagagcatggggatccagctcgaccagcgcatcatcctgctgtacatgctcgagtggggcaaggagatggtcgaccacttccacctgggcgacgacatggaccccgagctgcgggggctcgcccagagcctgatcgaccagaaggtgaaggagatctccaaccaggagcccctgaagatctga

SEQ ID NO: 6537 - RNA, 1302 nt, synthetic construct
  misc_feature 1..1302: note = derived and/or modified CDS sequence (opt1) from PUUV(Udmurtia/894Cg/91)__Z21497.1__N
  source 1..1302: mol_type = other RNA
atgagcgacctgaccgacatccaggaggagatcacccgccacgagcagcagctcgtggtcgcccggcagaagctgaaggacgccgagcgcgcggtggaggtggaccccgacgacgtcaacaagaacacgctgcaggcccggcagcagaccgtgtccgccctcgaggacaagctggccgactacaagcgccggatggccgacgcggtgagccgcaagaagatggacaccaagccgaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccatcccgatcatcctgaaggccctctacatgctgagcacgcgggggcgccagaccgtgaaggagaacaagggcacccggatccgcttcaaggacgacacctccttcgaggacatcaacggcatccggcgccccaagcacctgtacgtgagcatgcccacggcgcagtccaccatgaaggccgaggagctcacccccgggcggttccgcaccatcgtctgcggcctgttcccgacgcagatccaggtgcggaacatcatgagccccgtgatgggggtcatcggcttctccttcttcgtgaaggactggcccgagcgcatccgggacttcatggagaaggagtgccccttcatcaagccggaggtgaagcccgggacccccgcccaggagatcgagttcctgaagcgcaaccgggtctacttcatgacccgccaggacgtgctcgacaagaaccacgtggccgacatcgacaagctgatcgactacgccgcgagcggcgaccccacctccccggacgacatcgagagccccaacgccccctgggtcttcgcctgcgcccccgaccgctgcccgcccacgtgcatctacgtggtgggcatggccgagctgggggcgttcttctccatcctccaggacatgcggaacaccatcatggccagcaagaccgtcggcaccgccgaggagaagctgaagaagaagtccagcttctaccagtcctacctgcgccggacgcagagcatggggatccagctcgaccagcgcatcatcctgctgtacatgctcgagtggggcaaggagatggtggaccacttccacctgggcgacgacatggaccccgagctgcgggggctcgcccagagcctgatcgaccagaaggtcaaggagatctccaaccaggagcccctgaagatctga

SEQ ID NO: 6538 - RNA, 1302 nt, synthetic construct
  misc_feature 1..1302: note = derived and/or modified CDS sequence (opt1) from PUUV(Fusong-Cr-247)__EF442087.1__N
  source 1..1302: mol_type = other RNA
atgagcgacctgaaggacatccaggaggacatcgcccgccacgagcagcagctcgtggtcgcccggcagaagctgcgcgacgcggagaaggccgtggagatggaccccgacgacgtgaacaacaacaccctgcaggcccggcagcagaccgtctccgccctcgaggacaagatcgccgacttcaagcgccggatggcggacatcgtgagccgcaagaagatggacacgaagcccgccgaccccaccggcatcgagcccgacgaccacctgaaggagcggtccagcctgcgctacgggaacgtgctcgacgtcaacgccatcgacatcgaggagccctccggccagaccgccgactggtacaccatcggggtgtacatcatcggcttcacgctgccgatcatcctgaaggcgctctacatgctgagcacccgggggcgccagaccgtgaaggagaacaagggcacccggatccgcttcaaggacgacacgtccttcgaggacgtcaacggcatccggcgccccaagcacctgtacgtgagcatgcccaccgcccagtccaccatgaaggccgaggagctcacccccgggcggttccgcacgatcgtgtgcggcctgttcccgacccagatccaggtccggaacaccatgagccccgtgatgggggtgatcggcttctccttcttcgccaaggactggcccgaccgcatcaaggagttcatggagaaggagtgccccttcatcaagccggaggtcaagcccgggacccccgccaaggaggtggagatcctgaagcggaacaagatctacttcatgcagcgccaggacgtgctcgacaagaaccacgtccccgacatcgacaagctgatcgactacgcggccagcggcgacccgacgtcccccgagaacatcgacagccccaacgccccctgggtgttcgcctgcgccccggaccggtgcccgccgacctgcatctacgtggcgggcatggccgagctgggggccttcttctccatcctccaggacatgcgcaacaccatcatggccagcaagaccgtcggcacggccgaggagaagctgaagaagaagtccagcttctaccagtcctacctgcgccggacccagagcatggggatccagctcgaccagcgcatcatcctgctgtacatgctcgagtggggcaaggagatggtggaccacttccacctgggcgacgacatggaccccgagctgcggagcctcgcgcaggccctgatcgaccagaaggtgaaggagatctccaaccaggagcccctgaagatctga

SEQ ID NO: 6539 - RNA, 1302 nt, synthetic construct
  misc_feature 1..1302: note = derived and/or modified CDS sequence (opt1) from MUV(11-4)__JX046484.1__N
  source 1..1302: mol_type = other RNA
atgagcgacctgaaggagatccaggaggacatcgcccgccacgagcagcagctcgtggtcgcccggcagaagctgcgcgacgcggagaaggccgtggaggtggaccccgacgacgtcaacaagaacaccctgcaggcccggcagcagaccgtgtccgccctcgaggacaagctggccgacttcaagcgccagatggcggacttcgtgagccggaagaagatggacacgaagcccaccgaccccaccggcatcgagcccgacgaccacctgaaggagcgctccagcctccggtacgggaacgtcctggacgtgaacgccatcgacatcgaggagccctccggccagaccgccgactggtacacgatcggggtgtacatcatcggcttcaccctgccgatcgtcctcaaggccctgtacatgctgagcacccgcgggcggcagaccgtgaaggagaacaagggcacgcgcatccggttcaaggacgacacctccttcgaggacatcaacggcatccgccggcccaagcacctctacgtgagcatgcccaccgcgcagtccaccatgaaggccgaggagctgacgcccgggcgcttccggaccatcgtctgcggcctgttcccgacccagatccaggtgcgcaacatcatgagccccgtgatgggggtcatcggcttctccttcttcgtgaaggactgggccgaccggatcaaggagttcatggagaaggagtgccccttcatcaagcccgagccgaagcccgggacccccgccagcgaggtggagttcctcaagcgcaacaagatctacttcatgtcccggcaggacgtcctggacaagaaccacgtgcccgacatcgacaagctgatcgactacgccgcgagcggcgacccgacgtcccccgacaacatcgaggaccccaacgccccctgggtgttcagctgcgccccggaccgctgcccgccgacctgcctctacgtcgccggcatggccgagctgggggcgttcttctccatcctgcaggacatgcggaacaccatcatggccagcaagaccgtgggcacggccgaggagaagctcaagaagaagtccagcttctaccagagctacctgcgccgcacccagtccatggggatccagctggaccagcggatcatcctcctgtacatgctggagtggggcaaggagatggtggaccacttccacctcggcgacgacatggaccccgagctgcgcaccctggcccaggccctcatcgaccagaaggtcaaggagatcagcaaccaggagcccctgaagatctga

SEQ ID NO: 6540 - RNA, 1302 nt, synthetic construct
  misc_feature 1..1302: note = derived and/or modified CDS sequence (opt1) from MUV(00-18)__DQ138128.1__N
  source 1..1302: mol_type = other RNA
atgagcgacctgaaggagatccaggaggacatcgcccgccacgagcagcagctcgtggtcgcccggcagaagctgcgcgacgcggagaaggccgtggaggtggaccccgacgacgtcaacaagaacaccctgcaggcccggcagcagaccgtgtccgccctcgaggacaagctggccgacttcaagcgccagatggcggacttcgtgagccggaagaagatggacacgaagcccaccgaccccaccggcatcgagcccgacgaccacctgaaggagcgctccagcctccggtacgggaacgtcctggacgtgaacgccatcgacatcgaggagccctccggccagaccgccgactggtacacgatcggggtgtacgtcatcggcttcaccctgccgatcgtgctcaaggccctgtacatgctgagcacccgcgggcggcagaccgtgaaggagaacaagggcacgcgcatccggttcaaggacgacacctccttcgaggacatcaacggcatccgccggcccaagcacctctacgtcagcatgcccaccgcgcagtccaccatgaaggccgaggagctgacgcccgggcgcttccggaccatcgtgtgcggcctgttcccgacccagatccaggtgcgcaacatcatgagccccgtcatgggggtgatcggcttctccttcttcgtgaaggactgggtcgagcggatcaaggagttcatggagaaggagtgccccttcatcaagcccgagccgaagcccgggacccccgccagcgaggtggagttcctcaagcgcaacaagatctacttcatgaaccggcaggacgtgctggacaagaaccacgtccccgacatcgacaagctgatcgactacgccgcctccggcgacccgacgagccccgacaacatcgaggaccccaacgcgccctgggtgttctcctgcgccccggaccgctgcccgccgacctgcctctacgtggccggcatggccgagctgggggccttcttcagcatcctgcaggacatgcggaacaccatcatggcgtccaagaccgtcggcacggccgaggagaagctcaagaagaagtccagcttctaccagagctacctgcgccgcacccagagcatggggatccagctggaccagcggatcatcctcctgtacatgctggagtggggcaaggagatggtggaccacttccacctcggcgacgacatggaccccgagctgcgcaccctggcccaggccctcatcgaccagaaggtcaaggagatctccaaccaggagcccctgaagatctga

SEQ ID NO: 6541 - RNA, 1302 nt, synthetic construct
  misc_feature 1..1302: note = derived and/or modified CDS sequence (opt1) from MUV(11-1)__JX028273.1__N
  source 1..1302: mol_type = other RNA
atgagcgacctgaaggagatccaggaggacatcgcccgccacgagcagcagctcgtggtcgcccggcagaagctgcgcgacgcggagaaggccgtggaggtggaccccgacgacgtcaacaagaacaccctgcaggcccggcagcagaccgtgtccgccctcgaggacaagctggccgacttcaagcgccagatggcggacttcgtgagccggaagaagatggacacgaagcccaccgaccccaccggcatcgagcccgacgaccacctgaaggagcgctccagcctccggtacgggaacgtcctggacgtgaacgccatcgacatcgaggagccctccggccagaccgccgactggtacacgatcggggtgtacatcatcggcttcaccctgccgatcgtcctcaaggccctgtacatgctgagcacccgcgggcggcagaccgtgaaggagaacaagggcacgcgcatccggttcaaggacgacacctccttcgaggacatcaacggcatccgccggcccaagcacctctacgtgagcatgcccaccgcgcagtccaccatgaaggccgaggagctgacgcccgggcgcttccggaccatcgtctgcggcctgttcccgacccagatccaggtgcgcaacatcatgagccccgtgatgggggtcatcggcttctccttcttcgtgaaggactgggccgaccggatcaaggagttcatggagaaggagtgccccttcatcaagcccgagccgaagcccgggacccccgccagcgagatcgagttcctcaagcgcaacaagatctacttcatgtcccggcaggacgtgctggacaagaaccacgtccccgacatcgacaagctgatcgactacgccgcgagcggcgacccgacgtcccccgacaacatcgaggaccccaacgccccctgggtgttcagctgcgccccggaccgctgcccgccgacctgcctctacgtggccggcatggccgagctgggggcgttcttctccatcctgcaggacatgcggaacaccatcatggccagcaagaccgtcggcacggccgaggagaagctcaagaagaagtccagcttctaccagagctacctgcgccgcacccagtccatggggatccagctggaccagcggatcatcctcctgtacatgctggagtggggcaaggagatggtggaccacttccacctcggcgacgacatggaccccgagctgcgcaccctggcccaggccctcatcgaccagaaggtgaaggagatcagcaaccaggagcccctgaagatctga

SEQ ID NO: 6542 - RNA, 1302 nt, synthetic construct
  misc_feature 1..1302: note = derived and/or modified CDS sequence (opt1) from MUV(96-1)__DQ138133.1__N
  source 1..1302: mol_type = other RNA
atgagcgacctgaaggagatccaggaggacatcgcccgccacgagcagcagctcgtggtcgcccggcagaagctgcgcgacgcggagaaggccgtggaggtggaccccgacgacgtcaacaagaacaccctgcaggcccggcagcagaccgtgtccgccctcgaggacaagctggccgacttcaagcgccagatggcggacttcgtgagccggaagaagatggacacgaagcccaccgaccccaccggcatcgagcccgacgaccacctgaaggagcgctccagcctccggtacgggaacgtcctggacgtgaacgccatcgacatcgaggagccctccggccagaccgccgactggtacacgatcggggtgtacgtcatcggcttcaccctgccgatcgtgctcaaggccctgtacatgctgagcacccgcgggcggcagaccgtgaaggagaacaagggcacgcgcatccggttcaaggacgacacctccttcgaggacatcaacggcatccgccggcccaagcacctctacgtcagcatgcccaccgcgcagtccaccatgaaggccgaggagctgacgcccgggcgcttccggaccatcgtgtgcggcctgttcccgacccagatccaggtgcgcaacatcatgagccccgtcatgggggtgatccggttctccttcctcgtgaaggactggagcgagaagatcaaggagttcatggagaaggagtgccccttcatcaagcccgagccgaagcccggcacccccgcctccgagatcgagttcctgaagcgcaacaagatctacttcatgaaccggcaggacgtcctggacaagaaccacgtgcccgacatcgacaagctcatcgactacgccgccagcggggacccgacgtcccccgacaacatcgaggcgcccaacgccccctgggtgttcagctgcgccccggaccgctgcccgccgacctgcctgtacgtcgccggcatggccgagctgggcgcgttcttctccatcctccaggacatgcggaacaccatcatggccagcaagaccgtggggacggccgaggagaagctgaagaagaagtccagcttctaccagagctacctgcgccgcacccagtccatgggcatccagctcgaccagcggatcatcctgctgtacatgctcgagtgggggaaggagatggtggaccacttccacctgggcgacgacatggaccccgagctgcgcaccctcgcccaggccctgatcgaccagaaggtcaaggagatcagcaaccaggagcccctgaagatctga

SEQ ID NO: 6543 - RNA, 1302 nt, synthetic construct
  misc_feature 1..1302: note = derived and/or modified CDS sequence (opt1) from MUV(99-28)__DQ138142.1__N
  source 1..1302: mol_type = other RNA
atgagcgacctgaaggagatccaggaggacatcgcccgccacgagcagcagctcgtggtcgcccggcagaagctgcgcgacgcggagaaggccgtggaggtggaccccgacgacgtcaacaagaacaccctgcaggcccggcagcagaccgtgtccgccctcgaggacaagctggccgacttcaagcgccagatggcggacttcgtgagccggaagaagatggacacgaagcccaccgaccccaccggcatcgagcccgacgaccacctgaaggagcgctccagcctccggtacgggaacgtcctggacgtgaacgccatcgacatcgaggagccctccggccagaccgccgactggtacacgatcggggtgtacgtcatcggcttcaccctgccgatcgtgctcaaggccctgtacatgctgagcacccgcgggcggcagaccgtgaaggagaacaagggcacgcgcatccggttcaaggacgacacctccttcgaggacatcaacggcatccgcagccccaagcacctctacgtctccatgcccaccgcgcagagcaccatgaaggccgaggagctgacgcccgggcggttccgcaccatcgtgtgcggcctgttcccgacccagatccaggtgcggaacatcatgtcccccgtcatgggggtgatcggcttcagcttcttcgtgaaggactgggtcgagcgcatcaaggagttcatggagaaggagtgccccttcatcaagcccgagccgaagcccgggacccccgcctccgaggtggagttcctcaagcggaacaagatctacttcatgaaccgccaggacgtgctggacaagaaccacgtccccgacatcgacaagctgatcgactacgccgccagcggcgacccgacgtcccccgacaacatcgaggaccccaacgcgccctgggtgttcagctgcgccccggaccggtgcccgccgacctgcctctacgtggccggcatggccgagctgggggccttcttctccatcctgcaggacatgcgcaacaccatcatggcgagcaagaccgtcggcacggccgaggagaagctcaagaagaagtccagcttctaccagagctacctgcggcgcacccagtccatggggatccagctggaccagcgcatcatcctcctgtacatgctggagtggggcaaggagatggtggaccacttccacctcggcgacgacatggaccccgagctgcggaccctggcccaggccctcatcgaccagaaggtcaaggagatcagcaaccaggagcccctgaagatctga

SEQ ID NO: 6544 - RNA, 1290 nt, synthetic construct
  misc_feature 1..1290: note = derived and/or modified CDS sequence (opt1) from SANGV(SA14)__NC_034526.1__N
  source 1..1290: mol_type = other RNA
atggccaccctggaggagatccagaaggagatcaacatccacgagggccagctcatcatcgccaagcagaaggtgaaggacgcggagaagcagtacgagaaggaccccgacgacctgaacaagcgcgccctgagcgaccgggaggggatcgcccactccatccagagcaagatcgacgagctccgccggcagctggccgaccgcgtcgccgcgggccggaacctggggcaggagcgcgaccccaccggcgtggagcccggggaccacctccgggagaagtccatgctgagctacggcaacgtgatcgacctgaaccacctcgacatcgacgagcccacgggccagaccgccgactggctgtccatcgtcatctacctgaccagcttcgtggtgcccatcctcctgaaggccctgtacatgctcaccacgcgcgggcggcagaccaccaaggacaacaagggcatgcgcatccggttcaaggacgactccagcttcgaggacgtcaacgggatccgcaagccgaagcacctgttcctgtccatgcccaacgcccagagctccatgaaggcggaggagatcacccccggccggttccgcacggccgtgtgcgggctctaccccgcccagatcaaggcccggaacatggtgagcccggtcatgtccgtgatcggcttcatcaccctggcccgcgactggaccgagcggatcgagaactggctggaccagccctgcaagttcatgagcgagccctcccagaccagcctccagaagggccccgcgacgaaccgcgactacctgaaccagcggcaggcctccctggcccagatggagaccaaggaggcccaggccgtgcgccagcaggcggtcgacgccgggtgcaacctcgtggaccacatcgacagcccgtccagcatctgggtgttcgccggcgcccccgaccggtgcccgccgacctgcctgttcatcagcgggatggccgagctgggcgcgttcttctccatcctccaggacatgcgcaacaccatcatggccagcaagacggtcggcacctccgaggagaagctgcgcaagaagtccagcttctaccagagctacctgcggcgcacccagtccatggggatccagctcgaccagcggatcatcatcatgttcatggtggagtggggcaaggaggccgtggacgggttccacctgggcgacgacatggaccccgagctgcgcagcttcgcccaggccctcatcgaccagaaggtcaaggagatctccaaccaggagcccctgaagatctga

SEQ ID NO: 6545 - RNA, 1290 nt, synthetic construct
  misc_feature 1..1290: note = derived and/or modified CDS sequence (opt1) from SANGV(SA22)__JQ082303.1__N
  source 1..1290: mol_type = other RNA
atggccaccctggaggagatccagaaggagatcaacatccacgagggccagctcatcatcgccaagcagaaggtgaaggacgcggagaagcagtacgagaaggaccccgacgacctgaacaagcgcgccctgagcgaccgggaggggatcgcccactccatccagagcaagatcgacgagctccgccggcagctggccgaccgcgtcgccgcgggccggaacctggggcaggagcgcgaccccaccggcgtggagcccggggaccacctccgggagaagtccatgctgagctacggcaacgtgatcgacctgaaccacctcgacatcgacgagcccacgggccagaccgccgactggctgtccatcgtcatctacctgaccagcttcgtggtgcccatcctcctgaaggccctgtacatgctcaccacgcgcgggcggcagaccaccaaggacaacaagggcatgcgcatccggttcaaggacgactccagcttcgaggacgtcaacgggatccgcaagccgaagcacctgttcctgtccatgcccaacgcccagagctccatgaaggcggaggagatcacccccggccggttccgcacggccgtgtgcgggctctaccccgcccagatcaaggcccggaacatggtgagcccggtcatgtccgtgatcggcttcatcaccctggcccgcgactggaccgagcggatcgagaactggctggaccagccctgcaagttcatgagcgagccctcccagaccagcctccagaagggccccgcgacgaaccgcgactacctgaaccagcggcaggcctccctggcccagatggagaccaaggaggcccaggccgtgcgccagcaggcggtcgacgccgggtgcaacctcgtggaccacatcgacagcccgtccagcatctgggtgttcgccggcgcccccgaccggtgcccgccgacctgcctgttcatcagcgggatggccgagctgggcgcgttcttctccatcctccaggacatgcgcaacaccatcatggccagcaagacggtcggcacctccgaggagaagctgcgcaagaagtccagcttctaccagagctacctgcggcgcacccagtccatggggatccagctcgaccagcggatcatcatcatgttcatggtggagtggggcaaggaggtggtcgacgggttccacctgggcgacgacatggaccccgagctgcgcagcttcgcccaggccctcatcgaccagaaggtgaaggagatctccaaccaggagcccctgaagatctga

SEQ ID NO: 6546 - RNA, 1290 nt, synthetic construct
  misc_feature 1..1290: note = derived and/or modified CDS sequence (opt1) from SEOV(L99)__AF288299.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcaccctgcacgaccgggagtccgtggccgccagcatccagtccaagatcgacgagctgaagcgccagctcgccgaccggatcgcggccgggaagaacatcggccaggaccgcgaccccacgggggtggagcccggcgaccacctgaaggagcggagcgccctgtcctacgggaacaccctcgacctgaacagcctggacatcgacgagcccaccggccagaccgccgactggctcacgatcatcgtctacctgacctccttcgtggtgcccatcatcctgaaggcgctctacatgctgaccacccgcggccggcagacgagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacccccgggcggttccgcaccgccgtgtgcggcctctaccccgcccagatcaaggcgcggaacatggtcagcccggtgatgtccgtggtcgggttcctggccctggccaaggactggaccagccgcatcgaggagtggctcggcgccccctgcaagttcatggccgagtcccccatcgcgggcagcctgtccgggaaccccgtgaaccgggactacatccgccagcggcagggcgccctggccgggatggagccgaaggagttccaggccctccgccagcacgccaaggacgcgggctgcacgctggtggagcacatcgagagccccagctccatctgggtcttcgccggcgcccccgaccggtgcccgccgacctgcctgttcgtcgggggcatggccgagctcggggccttcttcagcatcctgcaggacatgcgcaacaccatcatggcgtccaagaccgtgggcacggccgacgagaagctgcgcaagaagtccagcttctaccagagctacctccggcgcacccagtccatggggatccagctggaccagcggatcatcgtgatgttcatggtggcctggggcaaggaggccgtgtacaacttccacctgggcgacgacatggaccccgagctccgcagcctggcgcagatcctgatcgaccagaaggtcaaggagatctccaaccaggagcccatgaagctctga

SEQ ID NO: 6547 - RNA, 1290 nt, synthetic construct
  misc_feature 1..1290: note = derived and/or modified CDS sequence (opt1) from SEOV(SG42/2011)__KY807171.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgaccccaccggggtggagcccggcgaccacctgaaggagcggagcgccctgtcctacgggaacacgctcgacctgaacagcctggacatcgacgagcccaccggccagaccgcggactggtccaccatcatcgtctacctcacgagcttcgtggtgcccatcatcctgaaggccctgtacatgctcaccacccgcggccggcagacctccaaggacaacaaggggatgcgcatccggttcaaggacgacagctcctacgaggacgtcaacggcatccgcaagccgaagcacctgtacgtgagcatgcccaacgcccagtccagcatgaaggccgaggagatcacgcccgggcggttccgcaccgccgtgtgcggcctgtaccccgcgcagatcaaggcccggaacatggtctccccggtgatgagcgtggtcgggttcctcgccctggccaaggactggtccagccgcatcgaggagtggctgggcgccccctgcaagttcatggcggagtcccccatcgccggcagcctcagcgggaaccccgtgaaccgggactacatccgccagcggcagggcgccctggccgggatggagccgaaggagttccaggccctgcgccagcactccaaggacgcgggctgcaccctcgtggagcacatcgagagcccctccagcatctgggtcttcgccggcgcccccgaccggtgcccgccgacctgcctgttcgtcgggggcatggccgagctgggggccttcttctccatcctccaggacatgcgcaacacgatcatggcgagcaagaccgtgggcaccgccgacgagaagctgcgcaagaagtccagcttctaccagtcctacctgcggcgcacccagagcatggggatccagctcgaccagcggatcatcgtgatgttcatggtggcctggggcaaggaggccgtggacaacttccacctgggcgacgacatggaccccgagctgcgctccctcgcgcagatcctgatcgaccagaaggtcaaggagatcagcaaccaggagcccatgaagctgtga

SEQ ID NO: 6548 - RNA, 1290 nt, synthetic construct
  misc_feature 1..1290: note = derived and/or modified CDS sequence (opt1) from SEOV(XJ2/2011)__KY807169.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcagccggcagacctccaaggacaacaagggcatgcgcatccggttcaaggacgacagctcctacgaggacgtcaacgggatccgcaagccgaagcacctgtacgtgagcatgcccaacgcccagtccagcatgcgggccgaggagatcacgcccggccgcttccggaccgccgtgtgcgggctctaccccgcgcagatcaaggcccgcaacatggtctccccggtgatgagcgtggtcggcttcctggccctggccaaggactggacctcccggatcgaggagtggctcggggccccctgcaagttcatggcggagagccccatcgccggctccctgagcggcaaccccgtgaaccgcgactacatccggcagcgccagggggccctggccggctgggagccgaaggagttccaggccctccggcagcacagcaaggacgcggggtgcaccctggtggagcacatcgagtcccccagctccatctgggtcttcgccggcgcccccgaccgctgcccgcccacgtgcctgttcgtgggcgggatggccgagctcggcgccttcttcagcatcctgcaggacatgcgcaacaccatcatggcgtccaagaccgtggggaccgccgacgagaagctgcggaagaagtccagcttctaccagagctacctccgccggacgcagtccatgggcatccagctggaccagcgcatcatcgtcatgttcatggtggcctgggggaaggaggccgtggacaacttccacctgggcgacgacatggaccccgagctccggagcctggcgcagatcctgatcgaccagaaggtcaaggagatctccaaccaggagcccatgaagctctga

SEQ ID NO: 6549 - RNA, 1290 nt, synthetic construct
  misc_feature 1..1290: note = derived and/or modified CDS sequence (opt1) from SEOV(XJ5/2011)__KY807170.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagcggcagggcgccctggccgggatggagccgaaggagttccaggccctccgccagcaccccaaggacgcgggctgcaccctggtggagcacatcgagagccccagctccatctgggtcttcgccggcgcccccgaccggtgcccgcccacgtgcctgttcgtcgggggcatggccgagctcggggccttcttcagcatcctgcaggacatgcgcaacaccatcatggcgtccaagaccgtgagcaccgccgacgagaagctgcgcaagaagtccagcttctaccagtcctacctccggcgcacgcagagcatgggcatccagctggaccagcggatcatcgtgatgttcatggtggcctgggggaaggaggccgtggacaacttccacctgggcgacgacatggaccccgagctccgctccctggcgcagatcctgatcgaccagaaggtcaaggagatcagcaaccaggagcccatgaagctctga

SEQ ID NO: 6550 - RNA, 1290 nt, synthetic construct
  misc_feature 1..1290: note = derived and/or modified CDS sequence (opt1) from SEOV(10-134)__JF693882.2__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtgctgcccatcatcctcaaggccctgtacatgctgaccacccgcggccggcagaccagcaaggacaacaaggggatgcgcatccggttcaaggacgactccagctacgaggacgtgaacggcatccgcaagccgaagcacctctacgtctccatgcccaacgcccagagctccatgaaggccgaggagatcacgcccgggcggttccgcaccgccgtgtgcggcctgtaccccgcgcagatcaaggcccggaacatggtgagcccggtcatgtccgtggtggggttcctggccctcgccaaggactggaccagccgcatcgaggagtggctgggcgccccctgcaagttcatggcggagtcccccatcgccggcagcctgtccgggaaccccgtcaaccgggactacatccgccagcggcagggcgccctcgccgggatggagccgaaggagttccaggccctgcgccagcacagcaaggacgcgggctgcaccctggtggagcacatcgagagcccctccagcatctgggtgttcgccggcgcccccgaccggtgcccgcccacgtgcctcttcgtcgggggcatggccgagctgggggccttcttctccatcctgcaggacatgcgcaacaccatcatggcgagcaagaccgtgggcaccgccgacgagaagctccgcaagaagtccagcttctaccagtcctacctgcggcgcacgcagagcatggggatccagctggaccagcggatcatcgtgatgttcatggtcgcctggggcaaggaggccgtggacaacttccacctcggcgacgacatggaccccgagctgcgctccctggcgcagatcctcatcgaccagaaggtgaaggagatcagcaaccaggagcccatgaagctgtga

SEQ ID NO: 6551 - RNA, 1290 nt, synthetic construct
  misc_feature 1..1290: note = derived and/or modified CDS sequence (opt1) from SEOV(DPRK08)__JX853575.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagcggcagggcgccctggccgggatggagccgaaggagttccaggccctccgccagcacgcgaaggacgccggctgcaccctggtggagcacatcgagagccccagctccatctgggtcttcgccggcgcccccgaccggtgcccgcccacgtgcctgttcgtcgggggcatggccgagctcggggcgttcttcagcatcctgcaggacatgcgcaacaccatcatggcctccaagaccgtgggcaccgccgacgagaagctgcgcaagaagtccagcttctaccagagctacctccggcgcacgcagtccatggggatccagctggaccagcggatcatcgtgatgttcatggtggcctggggcaaggaggcggtggacaacttccacctgggcgacgacatggaccccgagctccgcagcctggcccagatcctgatcgaccagaaggtcaaggagatctccaaccaggagcccatgaagctctga

SEQ ID NO: 6552 - RNA, 1290 nt, synthetic construct
  misc_feature 1..1290: note = derived and/or modified CDS sequence (opt1) from SEOV(Fj372/2013)__KP645198.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggagccccgtgaaccgggactacatccgccagcggcagggcgccctggccgggatggagccgaaggagttccaggccctccgccagcacgcgaaggacgccggctgcaccctggtggagcacatcgagagcccctccagcatctgggtcttcgccggcgcccccgaccggtgcccgcccacgtgcctgttcgtcgggggcatggccgagctcggggcgttcttctccatcctgcaggacatgcgcaacaccatcatggccagcaagaccgtgggcaccgccgacgagaagctgcgcaagaagtccagcttctaccagtcctacctccggcgcacgcagagcatggggatccagctggaccagcggatcatcgtgatgttcatggtggcctggggcaaggaggcggtggacaacttccacctgggcgacgacatggaccccgagctccgctccctggcccagatcctgatcgaccagaaggtcaaggagatcagcaaccaggagcccatgaagctctga

SEQ ID NO: 6553 - RNA, 1290 nt, synthetic construct
  misc_feature 1..1290: note = derived and/or modified CDS sequence (opt1) from SEOV(HeB38)__JN377553.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgaagatccgcttcaaggacgactccagctacgaggacgtcaacggcatccggaagccgaagcacctgtacgtgtccatgcccaacgcccagagctccatgaaggccgaggagatcacgcccgggcgcttccggaccgccgtgtgcggcctctaccccgcgcagatcaaggcccgcaacatggtcagcccggtgatgtccgtggtcgggttcctggccctggccaaggactggaccagccggatcgaggagtggctcggcgccccctgcaagttcatggcggagtcccccatcgccggcagcctgtccgggaaccccgtgaaccgcgactacatccggcagcgccagggcgccctggccgggatggagccgaaggagttccaggccctccggcagcacagcaaggacgcgggctgcaccctggtggagcacatcgagagcccctccagcatctgggtcttcgccggcgcccccgaccgctgcccgcccacgtgcctgttcgtcgggggcatggccgagctcggggccttcttctccatcctgcaggacatgcggaacaccatcatggcgagcaagaccgtgggcaccgccgacgagaagctgcgcaagaagtcccccttctaccagagctacctccgccggacgcagtccatggggatccagctggaccagcgcatcatcgtgatgttcatggtggcctggggcaaggaggccgtggacaacttccacctgggcgacgacatggaccccgagctccgggggctggcgcagatcctgatcgaccagaaggtcaaggagatcagcaaccaggagcccatgaagctctga

SEQ ID NO: 6554 - RNA, 1290 nt, synthetic construct
  misc_feature 1..1290: note = derived and/or modified CDS sequence (opt1) from SEOV(JiangxiXinjianRn-07-2011)__KP859511.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagcggcagggcgccctggccgggatggagccgaaggagttccaggccctccgccagcacagcaaggacgcgggctgcaccctggtggagcacatcgagagcccctccagcatctgggtcttcgccggcgcccccgaccggtgcccgcccacgtgcctgttcgtcgggggcatggccgagctcggggccttcttctccatcctgcaggacatgcgcaacaccatcatggcgagcaagaccgtgggcaccgccgacgagaagctgcgcaagaagtccagcttctaccagtcctacctccggcgcacgcagagcatggggatccagctggaccagcggatcatcgtgatgttcatggtggcctggggcaaggaggccgtggacaacttccacctgggcgacgacatggaccccgagctccgctccctggcgcagatcctgatcgaccagaaggtcaaggagatcagcaaccaggagcccatgaagctctga

SEQ ID NO: 6555 - RNA, 1290 nt, synthetic construct
  misc_feature 1..1290: note = derived and/or modified CDS sequence (opt1) from SEOV(JiangxiXinjianRn-09-2011)__KP859512.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagttcagcatgaaggccgaggagatcacgcccgggcggttccgcaccgccgtgtgcggcctctaccccgcgcagatcaaggcccggaacatggtctccccggtgatgagcgtggtcgggttcctggccctggccaaggactggacctcccgcatcgaggagtggctcggcgccccctgcaagttcatggcggagagccccatcgccggctccctgagcgggaaccccgtgaaccgggactacatccgccagcggcagggcgccctggccgggatggagccgaaggagttccaggccctccgccagcactccaaggacgcgggctgcaccctggtggagcacatcgagagccccagctccatctgggtcttcgccggcgcccccgaccggtgcccgcccacgtgcctgttcgtcgggggcatggccgagctcggggccttcttcagcatcctgcaggacatgcgcaacaccatcatggcgtccaagaccgtgggcaccgccgacgagaagctgcgcaagaagtccagcttctaccagagctacctccggcgcacgcagtccatggggatccagctggaccagcggatcatcgtgatgttcatggtggcctggggcaaggaggccgtggacaacttccacctgggcgacgacatggaccccgagctccgcagcctggcgcagatcctgatcgaccagaaggtcaaggagatctccaaccaggagcccatgaagctctga

SEQ ID NO: 6556 - RNA, 1290 nt, synthetic construct
  misc_feature 1..1290: note = derived and/or modified CDS sequence (opt1) from SEOV(Singapore/06(RN41))__GQ274944.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagcggcagggcgccctggccgggatggagccgaaggagttccaggccctccgccagcacagcaaggacgcgggctgcaccctggtggagcacatcgagagcccctccagcatctgggtcttcgccggcgcccccgaccggtgcccgcccacgtgcctgttcgtcgggggcatggccgagctcggggccttcttctccatcctgcaggacatgcgcaacaccatcatggcgagcaagaccgtgggcaccgccgacgagaagctgcgcaagaagtccagcttctaccagtcctacctccggcgcacgcagagcatggggatccagctggaccagcggatcatcgtgatgttcatggtggcctggggcaaggaggccgtggacaacttccacctgggcgacgacatggaccccgagctccgcgggctggcgcagatcctgatcgaccagaaggtcaaggagatctccaaccaggagcccatgaagctctga

SEQ ID NO: 6557 - RNA, 1290 nt, synthetic construct
  misc_feature 1..1290: note = derived and/or modified CDS sequence (opt1) from SEOV(YaluRiver12)__HQ611980.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccggggacctcaacaagcgcgccctgcacgaccgggagtccgtggccgccagcatccagtccaagatcgacgagctgaagcgccagctcgcggaccggatcgccgccggcaagaacatcgggcaggaccgcgaccccaccggcgtggagcccggggaccacctgaaggagcggagcgccctgtcctacggcaacacgctcgacctgaacagcctggacatcgacgagcccaccggccagaccgcggactggctcaccatcatcgtctacctgacgtccttcgtggtgcccatcatcctgaaggccctctacatgctgaccacccgcgggcggcagaccagcaaggactccaagggcatgcgcatccggttcaaggacgacagctcctacgaggacgtcaacgggatccgcaagccgaagcacctgtacgtgagcatgcccaacgcccagtccagcatgaagacggaggagatcacccccggccggttccgcaccgccgtgtgcgggctctaccccgcccagatcaaggcgcggaacatggtctccccggtgatgagcgtggtcggcttcctggccctggccaaggactggacctcccgcatcgaggagtggctcggcgccccctgcaagttcatggccgagagccccatcgcggggtccctgagcgagaaccccgtgaaccgggactacatccgccagcggcagggcgccctggccgggatggagccgaaggagttccaggccctccgccagcacgccaaggacgcgggctgcacgctggtggagcacatcgagagcccctccagcatctgggtcttcgccggcgcccccgaccggtgcccgccgacctgcctgttcgtcgggggcatggccgagctcggggccttcttctccatcctgcaggacatgcgcaacaccatcatggcgagcaagaccgtgggcacggccgacgagaagctgcgcaagaagtccagcttctaccagtcctacctccggcgcacccagagcatggggatccagctggaccagcggatcatcgtgatgttcatggtggcctggggcaaggaggccgtggacaacttccacctgggcgacgacatggaccccgagctccgctccctggcgcagatcctgatcgaccagaaggtcaaggagatcagcaaccaggagcccatgaagctctga

SEQ ID NO: 6558 - RNA, 1290 nt, synthetic construct
  misc_feature 1..1290: note = derived and/or modified CDS sequence (opt1) from SEOV(14D12)__AB618124.1__N
  source 1..1290: mol_type = other RNA
atggccaccatggaggagatccagaaggagatcagcgcccacgagggccagctggtgatcgcgcgccagaaggtcaaggacgccgagaagcagtacgagaaggaccccgacgacctcaacaagcgggccctgcacgaccgcgagtccgtggccgccagcatccagtccaagatcgacgagctgaagcggcagctcgcggaccgcatcgccgccgggaagaacatcggccaggaccgggacccgaccggggtggagcccggcgaccacctgaaggagcgcagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccggggccgccagaccagcaaggacaacaaggggatgcggatccgcttcaaggacgactccagctacgaggacgtcaacggcatccggaagccgaagcacctgtacgtgtccatgcccaacgcccagagctccatgaaggccgaggagatcacgcccgggcgcttccggaccgccgtgtgcggcctctaccccgcgcagatcaaggcccgcaacatggtcagcccggtgatgtccgtggtcgggttcctggccctggccaaggactggaccagccggatcgaggagtggctcggcgccccctgcaagttcatggcggagtcccccatcgccggcagcctgtccgggaaccccgtgaaccgcgactacatccggcagcgccagggcgccctggccgggatggagccgaaggagttccaggccctccggcagcacagcaaggacgcgggctgcaccctggtggagcacatcgagagcccctccagcatctgggtcttcgccggcgcccccgaccgctgcccgcccacgtgcctgttcgtcgggggcatggccgagctcggggccttcttctccatcctgcaggacatgcggaacaccatcatggcgagcaagaccgtgggcaccgccgacgagaagctgcgcaagaagtccagcttctaccagtcctacctccgccggacgcagagcatggggatccagctggaccagcgcatcatcgtgatgttcatggtggcctggggcaaggaggccgtggacaacttccacctgggcgacgacatggaccccgagctccggtccctggcgcagatcctgatcgaccagaaggtcaaggagatcagcaaccaggagcccatgaagctctga

SEQ ID NO: 6559 - RNA, 1281 nt, synthetic construct
  misc_feature 1..1281: note = derived and/or modified CDS sequence (opt1) from SEOV(19CSG)__AB618114.1__N
  source 1..1281: mol_type = other RNA
atggaggagatccagcgcgagatcagcgcccacgagggccagctggtgatcgcccggcagaaggtcaaggacgcggagaagcagtacgagaaggaccccgacgacctcaacaagcgcgccctgcacgaccgggagtccgtggccgccagcatccagtccaagatcgacgagctgaagcgccagctcgccgaccggatcgcggccgggaagaacatcggccaggaccgcgaccccaccggggtggagcccggcgaccacctgaaggagcggagcgccctgtcctacgggaacaccctcgacctgaacagcctggacatcgacgagcccacgggccagaccgccgactggctcaccatcatcgtctacctgacctccttcgtggtgcccatcatcctgaaggcgctctacatgctgacgacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacccccgggcggttccgcacggccgtgtgcggcctctaccccgcccagatcaaggcgcggaacatggtcagcccggtgatgtccgtggtcgggttcctggccctggccaaggactggaccagccgcatcgaggagtggctcggcgccccctgcaagttcatggccgagtcccccatcgcgggcagcctgtccgggaaccccgtgaaccgggactacatccgccagcggcagggcgccctggccgggatggagccgaaggagttccaggccctccgccagcacagcaaggacgccggctgcaccctggtggagcacatcgagagcccctccagcatctgggtcttcgcgggcgcccccgaccggtgcccgccgacctgcctgttcgtcgggggcatggccgagctcggggccttcttctccatcctgcaggacatgcgcaacacgatcatggccagcaagaccgtgggcaccgcggacgagaagctgcgcaagaagtccagcttctaccagtcctacctccggcgcacccagagcatggggatccagctggaccagcggatcatcgtgatgttcatggtggcctggggcaaggaggccgtggacaacttccacctgggcgacgacatggaccccgagctccgctccctggcccagatcctgatcgaccagaaggtcaaggagatcagcaaccaggagcccatgaagctctga

SEQ ID NO: 6560 - RNA, 1290 nt, synthetic construct
  misc_feature 1..1290: note = derived and/or modified CDS sequence (opt1) from SEOV(93HBX12)__EF192308.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatcgggaagccgaagcacctgtacgtgtccatgcccaacgcccagagctccatgaaggccgaggagatcacgcccggccgcttccggaccgccgtgtgcgggctctaccccgcgcagatcaaggcccgcaacatggtcagcccggtgatgtccgtggtcggcttcctggccctggccaaggactggaccagccggatcgaggagtggctcggcgccccctgcaagttcatggcggagtcccccatcgccgggagcctgtccggcaaccccgtgaaccgcgactacatccggcagcgccagggggccctggccggcatggagccgaaggagttccaggccctccggcagcacagcaaggacgcgggctgcaccctggtggagcacatcgagagcccctccagcatctgggtcttcgccggggcccccgaccgctgcccgcccacgtgcctgttcgtgggcgggatggccgagctcggcgccttcttctccatcctgcaggacatgcggaacaccatcatggcgagcaagaccgtggggaccgccgacgagaagctgcgcaagaagtccagcttctaccagtcctacctccgccggacgcagagcatgggcatccagctggaccagcgcatcatcgtcatgttcatggtggcctggggcaaggaggccgtggacaacttccacctgggggacgacatggaccccgagctccggggcctggcgcagatcctgatcgaccagaaggtcaaggagatctccaaccaggagcccatgaagctctga

SEQ ID NO: 6561 - RNA, 1290 nt, synthetic construct
  misc_feature 1..1290: note = derived and/or modified CDS sequence (opt1) from SEOV(Cherwell)__KC626089.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatcgcggagtcccccatcgccggcagcctgtccgggaaccccgtgaaccgggactacatccgccagcggcagggcgccctggccgggatggagccgaaggagttccaggccctccgccagcacagcaaggacgcgggctgcaccctggtggagcacatcgagagcccctccagcatctgggtcttcgccggcgcccccgaccggtgcccgcccacgtgcctgttcgtcgggggcatggccgagctcggggccttcttctccatcctgcaggacatgcgcaacaccatcatggcgagcaagaccgtgggcaccgccgacgagaagctgcgcaagaagtccagcttctaccagtcctacctccggcgcacgcagagcatggggatccagctggaccagcggatcatcgtgatgttcatggtggcctggggcaaggaggccgtggacaacttccacctgggcgacgacatggaccccgagctccgctccctggcgcagatcctgatcgaccagaaggtcaaggagatcagcaaccaggagcccatgaagctctga

SEQ ID NO: 6562 - RNA, 1290 nt, synthetic construct
  misc_feature 1..1290: note = derived and/or modified CDS sequence (opt1) from SEOV(CixiRf23)__FJ803201.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagcggcagggcgccctggccgggatggagccgaaggagttccaggccctccgccagcacgcgaaggacgccggccggaccctggtggagcacatcgagagccccagctccatctgggtcttcgccggcgcccccgaccgctgcccgcccacgtgcctgttcgtcgggggcatggccgagctcggggcgttcttcagcatcctgcaggacatgcgcaacaccatcatggcctccaagaccgtgggcaccgccgacgagaagctgcggaagaagtccagcttctaccagagctacctccgccggacgcagtccatggggatccagctggaccagcgcatcatcgtgatgttcatggtggcctggggcaaggaggcggtggacaacttccacctgggcgacgacatggaccccgagctccggagcctggcccagatcctgatcgaccagaaggtcaaggagatctccaaccaggagcccatgaagctctga

SEQ ID NO: 6563 - RNA, 1290 nt, synthetic construct
  misc_feature 1..1290: note = derived and/or modified CDS sequence (opt1) from SEOV(CixiRf56)__FJ803202.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagggccagggggccctggccggcatggagccgaaggagttccaggccctccggcagcacgcgaaggacgccggctgcaccctggtggagcacatcgagagccccagctccatctgggtcttcgccggggcccccgaccgctgcccgcccacgtgcctgttcgtgggcgggatggccgagctcggcgcgttcttcagcatcctgcaggacatgcggaacaccatcatggcctccaagaccgtggggaccgccgacgagaagctgcgcaagaagtccagcttctaccagagctacctccgccggacgcagtccatgggcatccagctggaccagcgcatcatcgtcatgttcatggtggcctggggcaaggaggcggtggacaacttccccctggtccacgacatggaccccaagctccggagcctgtcccagatcctgatcgaccagaaggtgaacgagatcagcaaccaggagcccatgaagctctga

SEQ ID NO: 6564 - RNA, 1290 nt, synthetic construct
  misc_feature 1..1290: note = derived and/or modified CDS sequence (opt1) from SEOV(CixiRn21)__FJ803205.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagcggcagggcgccctggccgggatggagccgaaggagttccaggccctccgccagcacagcaaggacgcgggctgcaccctggtggagcacatcgagagcccctccagcatctgggtcttcgccggcgcccccgaccggtgcccgcccacgtgcctgttcgtcgggggcatggacgagctcggggccttcttctccatcctgcaggacatgcgcaacaccatcatggccagcaagaccgtgggcaccgcggacgagaagctgcgcaagaagtccagcttctaccagtcctacctccggcgcacgcagagcatggggatccagctggaccaccggatcatcgtgatgttcatggtggcctggggcaaggaggccgtggacaacttccacctgggcgacgacatggaccccgagctccgcaccctggcccagatcctgatcgaccagaaggtcaaggagatctccaaccaggagcccatgaagctctga

SEQ ID NO: 6565 - RNA, 1290 nt, synthetic construct
  misc_feature 1..1290: note = derived and/or modified CDS sequence (opt1) from SEOV(CixiRn76)__FJ803206.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccagccagaacgcccagtccagcatgaaggccgaggagatcacgcccgggcggttccgcaccgccgtgtgcggcctctaccccgcgcagatcaaggcccggaacatggtctcccccgtgatgagcgtggtcgggttcctggccctggccaaggactggacctcccgcatcgaggagtggctcggcgccccgtgcaagttcatggcggagagccccatcgccggctccctgagcgggaaccccgtgaaccgggactacatccgccagggccagggggccctggccggcatggagcccaaggagttccaggccctccggcagcacgcgaaggacgccggctgcaccctggtggagcacatcgagagcccgtccagcatctgggtcttcgccggggcccgcgaccggtgcccgcccacgtgcctgttcgtgggcgggatggccgagctcggcgcgttcttctccatcctgcaggacatgcgcaacaccatcatggccagcaagaccgtggggaccgccgacgagaagctgcgcaagaagtccagcttctaccagtcctacctccggcgcacgcagagcatgggcatccagctggaccagcggatcatcgtcatgttcatggtggcctggggcaaggaggcggtggacaacttccacctgggggacgacatggaccccgagctccgctccctggcccagatcctgatcgaccagaaggtcaaggagatcagcaaccaggagcccatgaagctctga

SEQ ID NO: 6566 - RNA, 1290 nt, synthetic construct
  misc_feature 1..1290: note = derived and/or modified CDS sequence (opt1) from SEOV(CUI)__GQ279395.1__N
  source 1..1290: mol_type = other RNA
atggccaccatggaggagctgcagcgcgagatcagcgcccacgagggccagctcgtgatcgcgcggcagaaggtcaaggacgccgagaagcagtacgagaaggaccccgacgacctgaacaagcgcgccctgcacgaccgggagtccgtggccgccagcatccagtccaagatcgacgagctcaagcgccagctggcggaccggatcgccgccgggaagaacatcggccaggaccgcgacccgaccggggtggagcccggcgaccacctgaaggagcggagcgccctctcctacgggaacacgctggacctgaacagcctcgacatcgacgagcccaccggccagaccgcggactggctgaccatcatcgtctacctgacgtccttcgtggtgcccatcatcctcaaggccctgtacatgctgaccacccgcggccggcagaccagcaaggacaacaaggggatgcgcatccggttcaaggacgactccagctacgaggacgtcaacggcatccgcaagccgaagcacctctacgtgtccatgcccaacgcccagagctccatgaaggccgaggagatcacgcccgggcggttccgcaccgccgtgtgcggcctgtaccccgcgcagatcaaggcccggaacatgctgagcccggtcatgtccgtggtggggttcctcgccctggccaaggactggaccagccgcatcgaggagtggctgggcgccccctgcaagttcatggcggagtcccccatcgccggcagcctctccgggaaccccgtcaaccgggactacatccgccagcggcagggcgccctggccgggatggagccgaaggagttccaggccctgcgccagcacagcaaggacgcgggctgcaccctcgtggagcacatcgagagcccctccagcatctgggtgttcgccggcgcccccgaccggtgcccgcccacgtgcctgttcgtcgggggcatggccgagctgggggccttcttctccatcctccaggacatgcgcaacaccatcatggcgagcaagaccgtgggcaccgccgacaagaagctgcgcaagaagtccagcttctaccagtcctacctgcggcgcacgcagagcatggggatccagctcgaccagcggatcatcgtgatgttcatgttcgcctggggcaaggaggccgtcgacaacttccacctgggcgacgacatggaccccgagctgcgcgggctcgcgcagatcctgatcgaccagaaggtgaaggagatctccaaccaggagcccatgaagctgtga

SEQ ID NO: 6567 - RNA, 1290 nt, synthetic construct
  misc_feature 1..1290: note = derived and/or modified CDS sequence (opt1) from SEOV(FeixianRn1)__GU592942.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgaccccaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcaccggcagcctgtccgggaaccccgtgaaccgggactacatccgccagcggcagggcgccctggccgggatggagccgaaggagttccaggccctccgccagcacgccaaggacgcgggctgcacgctggtggagcacatcgagagccccagctccatctgggtcttcgccggcgcccccgaccggtgcccgccgacctgcctgttcgtcgggggcatggccgagctcggggccttcttcagcatcctgcaggacatgcgcaacaccatcatggcgtccaagaccgtgggcacggccgacgagaagctgcgcaagaagtccagcttctaccagagctacctccggcgcacccagtccatggggatccagctggaccagcggatcatcgtgatgttcatggtggcctggggcaaggaggccgtggacaacttccacctgggcgacgacatggaccccgagctccgcagcctggcgcagatcctgatcgaccagaaggtcaaggagatctccaaccaggagcccatgaagctctga

SEQ ID NO: 6568 - RNA, 1290 nt, synthetic construct
  misc_feature 1..1290: note = derived and/or modified CDS sequence (opt1) from SEOV(GanyuRn66)__GU592932.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgaccccaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcaccgcggagtcccccatcgccggcagcctgtccgggaaccccgtgaaccgggactacatccgccagcggcagggcgccctggccgggatggagccgaaggagttccaggccctccgccagcacgcgaaggacgccggctgcacgctggtggagcacatcgagagccccagctccatctgggtcttcgccggcgcccccgaccggtgcccgccgacctgcctgttcgtcgggggcatggccgagctcggggcgttcttcagcatcctgcaggacatgcgcaacaccatcatggcctccaagaccgtgggcacggccgacgagaagctgcgcaagaagtccagcttctaccagagctacctccggcgcacccagtccatggggatccagctggaccagcggatcatcgtgatgttcatggtggcctggggcaaggaggcggtggacaacttccacctgggcgacgacatggaccccgagctccgcagcctggcccagatcctgatcgaccagaaggtcaaggagatctccaaccaggagcccatgaagctctga

SEQ ID NO: 6569 - RNA, 1290 nt, synthetic construct
  misc_feature 1..1290: note = derived and/or modified CDS sequence (opt1) from SEOV(Gongzhuling108)__KF745947.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagtccgccctgcacgaccgcgagagcgtggccgcctccatccagagcaagatcgacgagctgaagcggcagctcgcggaccgcatcgccgccgggaagaacatcggccaggaccgggacccgaccggggtggagcccggcgaccacctgaaggagcgctccgccctgagctacgggaacacgctcgacctgaactccctggacatcgacgagcccaccggccagaccgcggactggctcaccatcctggtctacctgacgagcttcgtggtgcccatcatcctcaaggccctgtacatgctgaccacccggggccgccagacctccaaggacaacaaggggatgcggatccgcttcaaggacgacggcagctacgaggacgtcaacgggatccggaagccgaagcacctctacgtgcccatgcccaacgcccagtccagcatgaaggccgaggagatcacgcccggccgcttccggaccgccgtgtgcgggctgtacccggcgcagatcaagccccgcaacatggtctcccccgtgatgagcgtggtcggcttcctggccctcgccaaggactggacctcccggatcgaggagtggctgggcgccccctgcaagttcatggccgagagcccgatcgcggggtccctgagcggcaaccccgtgaaccgcgactacatccggcagcgccagggggccctcgccggcatggagcccaaggagttccaggccctgcggcagcacgccaaggacgcgggctgcaccctggtggagcacatcgagtcccccagcagcatccgcgtcttcgccggggccccggcccggtgcccgcccacgtgcctcttcgtgggcgggatggccgagctgggcgcgttcttctccatcctgcaggacatgcgcaacaccatcatggccagcaagaccgtggggaccgccgacgagaagctccgcaagaagtccagcttctaccagtcctacctgcggcgcagccagtccatgggcatccagctggaccagcggatcatcgtcatgttcatggtggccagcggcaaggaggcggtggacaacttccacctcggggacgacatggaccccgagctgcgctccctggtccagatcctcatcgaccagaaggtgaaggagatcagcaaccaggagcccatgaagctgtga

SEQ ID NO: 6570 - RNA, 1290 nt, synthetic construct
  misc_feature 1..1290: note = derived and/or modified CDS sequence (opt1) from SEOV(Gongzhuling147)__KF745948.1__N
  source 1..1290: mol_type = other RNA
atggccaccatggaggagatccagcgcgagatcagcgcccacgagggccagctggtgatcgcgcggcagatcgtcaaggacgccgagaagcagtacgagaaggaccccgccgacctcaacaagcgcgccctgcacgaccgggagtccgtggccgcgagcatccagtccaagatcgacgagctgaagcgccacctcgccgaccggatcgccgccgggaagaacatcggccaggaccgcgacccgaccggggtggagcccggcgaccacctgaaggagcggagcgcgctgtcctacgggaacacgctcgacctgaacagcctggacatcgacgagcccaccggccagaccgccgactggctcaccatcatcgtctacctgacgtccttcgtggtgcccatcatcctgaaggccctctacatcctgaccaccagcggccgccagacctccaaggacaacaaggggatgcggatccgcttcaaggacgacagctcctacgaggacgtcaacggcatccggatgccgaagcacctgtacgtgcccatgcccaacgcccagagctccatgaaggccgaggacatcacgcccgggcgcttccggaccgcggtgtgcggcctctacccggcccagatcaaggcccgcaacatggtcagccccctgatgtccgtggtggggttcctggccctccccaaggactggaccagccggatcgacgagtggctgggcgccccctgcaagttcatggcggagtccccgatcgccggcagcctgtccgggaaccccgtcaaccgcgaccacatccggcagcgccagggcgccctcgccgggatggaccccaaggagttccaggccgtgcggcagcacgcgaaggacgccggctgcaccctggtggagcacatcgagagccccagctccatctgggtcttcgccggcgccccggaccgctgcccgcccacgtgcctgttcgtcgggggcatggccgagctcggggcgttcttcaccatcctgcaggacatgcggaacaccatcatgcccagcaagaccgtgggcacggccgacgagaagctgcgcaagaagtccagcttctaccagtcctacctccgccggacccagagcatggggatccagctggaccagcgcatcatcgtgatcttcatggtggcctgggccaaggaggcggtggacaacttccacctgggcgacgacatggaccccgagctccggtccctggcccagatcctgatcgaccagaaggtcaaggagatcagcaaccaggtgcccatgaagctctga

SEQ ID NO: 6571 - RNA, 1290 nt, synthetic construct
  misc_feature 1..1290: note = derived and/or modified CDS sequence (opt1) from SEOV(Gongzhuling415)__KF745949.1__N
  source 1..1290: mol_type = other RNA
atggccaccatggaggagatccagcgcgagatcagcgcccacgagggccagctggtgatcgcgcggcagatggtcaaggacgccgagaagcagtacgagaaggacctcgccgacctgaacaagcgcgccctgcacgaccgggagtccgtggccgcgagcatccagtccaagatcgacgagctcaagcgccagctggccgaccggatcgccgccgggaagaacatcgagcaggaccgcgaccccaccggcgtggagccgggggaccacctgaaggagcggagcgcgctctcctacggcaacacgctggacctgaacagcctcgacatcgacgagcccaccgggcagaccgccgactggctgaccatcatcgtctacctgacgtccttcgtggtgcccatcatcctcaaggccctgtacatcctgaccacccgcggccggcagaccagcaaggacaacaagggcatgacgatccgcttcaaggacgactccagctacgaggacgtcaacgggatccggatgcccaagcacctctacgtgccgatgcccaacgcccagtccagcatgaaggccgaggacatcacccccggccgcttccggaccgcggtgtgcgggctgtaccccgcccagatcaaggcccgcaacatggtctccccgctgatgagcgtggtgggcttcctcgccctgcccaaggactggacctcccggatcgacgagtggctgggggccccctgcaagttcatggcggagagccccatcgccggctccctcagcggcaacccggtcaaccgcgaccacatccggcagcgccagggggccctggccggcatggaccccaaggagttccaggccgtgcggcagcacgcgaaggacgccgggtgcacgctggtggagcacatcgagtcccccagcagcatctgggtcttcgccggcgcccccgaccgctgcctcccgacctgcctgttcgtgggcgggatggccgagctgggcgcgttcttcaccatcctccaggacatgcggaacaccatcatggcctccaagacggtggggaccgccgacgagaagctgggcaagaagtccagcttctaccagagctacctgcgccgcacccagtccatggggatccagctcgaccagcggatcatcgtcatgttcatggtggcctgggcgaaggaggccgtggacaacatccacctgggcgacgacatggaccccgagctgcgcagcctcgcccagatcctgatcgaccagaaggtcaaggagatctccaaccaggtgcccatgaagctgtga

SEQ ID NO: 6572 - RNA, 1290 nt, synthetic construct
  misc_feature 1..1290: note = derived and/or modified CDS sequence (opt1) from SEOV(Gongzhuling42)__KF745942.1__N
  source 1..1290: mol_type = other RNA
atggccaccatggaggagatccagcgcgagatcagcgcccacgagggccagctggtgatcgcgcggcagaaggtcaaggacgcccagaagcagtacgagaaggaccccgacgacctcaacaagcgcgccctgcacgaccgggagtccgtggccgccagcatccagctgaagatcgacgagctcaagcgccagctggcggaccggatcgccgccgggaagaacatcggccaggaccgcgaccccaccggggtggagcccggcgaccacctgaaggagcggtccgccctcagctacgggaacacgctggacctgaactccctcgacatcgacgagcccaccggccagaccgcggactggctgaccatcatcgtctacctgacgagcttcgtggtgcccatcatcctcaaggccctgtacatgctgaccacccgcggccggcagacctccaaggacaacaaggggatgcgcatccggttcaaggacgacagctcctacgaggacgtcaagggcatccgcaagccgaagcacctctacgtgcccatgcccaacgcccagagctccatgaaggccgaggagatcacgcccgggcggtgccgcaccgccgtgtgcggcctgtacccggcgcagatcaaggcccggaacatggtcagccccgtgatgtccgccgtggggatcctggccctcgccaaggactggaccagccgcatcgaggagtggctgggcaccccctgcaagttcatggcggagtcccccatcgccggcagcctgtccgggaacccggtcaaccgggaccacatccgccagcggcagggcgccctcgccgggatggagcccaaggagttccagggcctgcgccagcacgccaaggacgcgggctgcacgctggtggagcacatcgagagcccctccagcatctgggtgttcgccggggcccccgaccggtgcccgccgacctgcctcttcgtcggcgggatggccgagctgggcgccttcttcgcgatcctgcaggacatgcgcaacaccatcatggccagcaagaccgtggggacggccgacgagaagctccgcaagaagtccagcttctaccagtcctacctgcggcgcacccagagcatgggcatccagctggaccagcggatcatcgtgatgttcatggtcgcctgggcgaaggaggccgtggacaacttccacctcggcgacgacatggaccccgagctgcgctccctggcccagatcctcatggaccagaaggtgaaggagatcagcaaccaggagcccatgaagctgtga

SEQ ID NO: 6573 - RNA, 1290 nt, synthetic construct
  misc_feature 1..1290: note = derived and/or modified CDS sequence (opt1) from SEOV(Gongzhuling45)__KF745943.1__N
  source 1..1290: mol_type = other RNA
atggccaccatggaggagatccagcgcgagatcagcgcccacgagggccagctggtgatcgcgcggcagatggtcaaggacgccgagaagcagtacgagaaggaccccgccgacctcaacaagcgcgccctgcacgaccgggagtccgtggccgcgagcatccagtccaagatcgacgagctgaagcgccagctcgccgaccggatcgccgccgggaagaacatcggccaggaccgcgacccgaccggggtggagcccggcgaccacctgaaggagcggagcgcgctgtcctaccgcaacacgctcgacctgaacagcctggacatcgacgagcccaccgggcagaccgccgactggctcaccatcatcgtctacctgacgtccttcgtggtgcccatcatcctgaaggccctctacatcctgaccacccggggccgccagaccagcaaggacaacaagggcatgcggatccgcttcaaggacgactccagctacgaggacgtcaacgggatccggatgccgaagcacctgtacctccccatgcccaacgcccagtccagcatgaaggccgaggacatcacgcccggccgcttccggaccgcggtgtgcgggctgtacccggcccagatcaaggcccgcaacatggtgagccccctgatgagcgtcgtgggcttcctcgccctgcccaaggactggacctcccggatcgacgagtggctgggggccccctgcaagttcatggcggagagcccgatcgccggctccctcagcggcaaccccgtgaaccgcgaccacatccggcagcgccagggggccctggccggcatggaccccaaggagttccaggccgtccggcagcacgcgaaggacgccgggtgcaccctggtggagcacatcgagtcccccagcagcatctgggtgttcgccggcgccccggaccgctgcccgcccacgtgcctcttcgtcggcgggatggccgagctgggcgcgttcttcaccatcctgcaggacatgcgcaacaccatcatggcctccaagaccgtggggacggccgacgagaagctccggaagaagtcctccttctaccagagctacctgcgccggacccagtccatgggcatccagctggaccagcgcatcatcgtgatgttcatggtcgcctgggcgaaggaggccgtggacaacttccacctcggggacgacatggaccccgagctgcggagcctggcccagatcctcatcgaccacaaggtgaaggagatctccaaccaggtccccatgaagctgtga

SEQ ID NO: 6574 - RNA, 1290 nt, synthetic construct
  misc_feature 1..1290: note = derived and/or modified CDS sequence (opt1) from SEOV(Gongzhuling58)__KF745944.1__N
  source 1..1290: mol_type = other RNA
atggccaccatggaggagatccagcgcgagatcagcgcccacgagggccagctggtgatcgcgcggcagatggtcaaggacgccgagaagcagtacgagaaggaccccgccgacctcaacaagcgcgccctgcacgaccgggagtccgtggccgcgagcatccagtccaagatcgacgagctgaagcgccagctcgccgaccggatcgccgccgggaagaacatcggccaggaccgcgacccgaccggggtggagcccggcgaccacctgaaggagcggagcgcgctgtcctacgggaacacgctcgacctgaacagcctggacatcgacgagcccaccggccagaccgccgactggctcaccatcatcgtctacctgacgtccttcgtggtgcccatcatcctgaaggccctctacatcctgaccacccgcggccggcagaccagcaaggacaacaaggggatgcgcatccggttcaaggacgactccagctacgaggacgtcaacggcatccgcatgccgaagcacctgtacgtgcccatgcccaacgcccagtccagcatgaaggccgaggacatcacgcccgggcggttccgcaccgcggtgtgcggcctctacccggcccagatcaaggcccggaacatggtcagccccctgatgagcgtggtggggttcctggccctccccaaggactggacctcccgcatcgacgagtggctgggcgccccctgcaagttcatggcggagagcccgatcgccggctccctgagcgggaaccccgtcaaccgggaccacatccgccagcggcagggcgccctcgccgggatggaccccaaggagttccaggccgtgcgccagcacgcgaaggacgccggctgcaccctggtggagcacatcgagtcccccagcagcatctgggtcttcgccggcgccccggaccggtgcccgcccacgtgcctgttcgtcgggggcatggccgagctcggggcgttcttcaccatcctgcaggacatgcgcaacaccatcatggcctccaagaccgtgggcacggccgacgagaagctgcgcaagaagtcctccttctaccagagctacctccggcgcacccagtccatggggatccagctggaccagcggatcatcgtgatgttcatggtggcctgggcgaaggaggccgtggacaacttccacctgggcgacgacatggaccccgagctccgcagcctggcccagatcctgatcgaccagaaggtcaaggagatctccaaccaggtgcccatgaagctctga

SEQ ID NO: 6575 - RNA, 1290 nt, synthetic construct
  misc_feature 1..1290: note = derived and/or modified CDS sequence (opt1) from SEOV(Gongzhuling85)__KF745945.1__N
  source 1..1290: mol_type = other RNA
atggccaccatggaggagatccagcgcgagatcagcgcccacgagggccagctggtgatcgcgcggcagatggtcaaggacgccgagaagcagtacgagaaggaccccgccgacctcatcaagcgcgccctgcacgaccgggagtccgtggccgcgagcatccagtccaagatcgacgagctgaagcgccagctcgccgaccggatcgccgccgggaagaacatcggccaggaccgcgacccgaccgggctggagcccggcgaccacctgaaggagcggagcgcgctctcctacgggaacacgctggacctgaacagcctcgacatcgacgagcccaccggccagaccgccgactggctgaccgtgatcgtctacctgacgtccttcgtggtgcccatcatcctcaaggccctgtacatcctgaccacccgcggccggcagaccagcaaggacaacaaggggatgcgcatccggttcaaggacgtctccagctacgaggacgtgaacggcatccgcatgccgaagcacctctacgtgcccatgcccaacgcccagtccagcatgaaggccgaggacatcacgcccgggcggttccgcaccgcggtctgcggcctgtacccggcccagatcaaggcccggaacatggtgagccccctgatgagcgtggtcgggttcctcgccctgcccaaggactggacctcccgcatcgacgagtggctgggcgccccctgcaagttcatggcggagagcccgatcgccggctccctcagcgggaaccccgtgaaccgggaccacatccgccagcggcagggcgccctggccgggatggaccccaaggagttccaggccgtgcgccagcacgcgaaggacgccggctgcaccctggtcgagcacatcgagtcccccagcagcatctgggtgttcgccggcgccccggaccggtgcccgcccacgtgcctcttcgtgcgcgggatggccgagctgggcgcgttcttcaccatcctgcaggacatgcgcaacaccatcatggcctccaagaccgtcgggacggccgacgagaagctccggaagaagtcctccttctaccagagctacctgcgccggacccagtccatgggcatccagctggaccagcgcatcatcgtgatgttcatggtggcctgggcgaaggaggccgtcgacaacttccacctcggggacgacatgcaccccgagctgcggagcctggcccagatcctcatcgaccagaaggtgaaggagatctccaaccaggtgcccatgaagctgtga

SEQ ID NO: 6576 - RNA, 1290 nt, synthetic construct
  misc_feature 1..1290: note = derived and/or modified CDS sequence (opt1) from SEOV(Gongzhuling97)__KF745946.1__N
  source 1..1290: mol_type = other RNA
atggccaccatggaggagatccagcgcgagatcagcgcccacgagggccagctggtgatcgcgcggcagatggtcaaggacgccgagaagcagtacgagaaggaccccgccgacctcaacaagcgcgccctgcacgaccgggagtccgtggccgcgagcatccagtccaagatcgacgacctgaagcgccagctcgccgaccggatcgccgccgggaagaacatcggccaggaccgcgacccgaccggggtggagcccggcgaccacctgaaggagcggagcgcgctgtcctacgggaacacgctcgacctgaacagcctggacatcgacgagcccaccggccagaccgccgactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcatgccgaagcacctgtacgtgcggatgcccaacgcccagtccagcatgaaggccgaggacatcacgcccgggcgcttccggaccgcggtgtgcggcctctaccccgcccagatcaaggcccgcaacatggtctccccgctgatgagcgtggtggggttcctggccctccccaaggactggacctcccggatcgacgagtggctgggcgccccctgcaagttcatggcggagagccccatcgccggctccctgagcgggaacccggtcaaccgcgaccacatccggcagcgccagggcgccctcgccgggatggaccccaaggagttccaggccgtgcggcagcacgcgaaggacgccggctgcaccctggtggagcacatcgagtcccccagcagcatctgggtcttcgccggcgcccccgaccgctgcccgcccacgtgcctgttcgtcgggggcatggccgagctcggggcgttcttcaccatcctgcaggacatgcgcatcaccatcatggcctccaagaccgtgggcacggccgacgagaagctgcggaagaagtccagcttctaccagagctacctccgccggacccagtccatggggatccagctggaccagcgcctgatcgtgatgttcatggtggcctgggcgaaggaggccgtggacaacttccacctcggcgacgacatggaccccgagctgcggagcctggcccagatcctcatcgaccagaaggtcaagcagatctccaaccaggtgcccatgaagctgtga

SEQ ID NO: 6577 - RNA, 1290 nt, synthetic construct
  misc_feature 1..1290: note = derived and/or modified CDS sequence (opt1) from SEOV(Gou3)__AB027522.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgaccccaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggagcttccggaccgccgtgtgcggcctctaccccgcgaccatcaaggcccgcaacatggtctccccggtgatgagcgtggtcgggttcctggccctggccaaggactggacctcccggatcgaggactggctcggcgccccctgcaagttcatggcggagagccccatcgccggctccctgagcgggaaccccgtgaaccgcgactacatccggcagcgccagggcgccctggccgggatggagccgaaggagttccaggccctccggcagcacagcaaggacgcgggctgcacgatggtggagcagatcgagtcccccagctccatctgggtcttcgccggcgcccccgaccgctgcccgccgacctgcctgttcgtcgggggcatggccgagctgggggccttcttcagcatcctccaggacatgcggaacaccatcatggcgtccaagaccgtgggcacggccgacgagaagctgcgcaagaagtccagcttctaccagagctacctgcgccggacccagtccatggggatccagctcgaccagcgcatcatcgtgatgttcatggtggcctggggcaaggaggccgtggacaacttccacctgggcgacgacatggaccccgagctgcggagcctcgcgcagatcctgatcgaccagaaggtcaaggagatctccaaccaggagcccatgaagctgtga

SEQ ID NO: 6578 - RNA, 1290 nt, synthetic construct
  misc_feature 1..1290: note = derived and/or modified CDS sequence (opt1) from SEOV(Hb8610)__AF288643.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccggcaagagcatcgggcaggaccgcgacccgaccggggtggagcccggcgaccacctgaaggagcggtccgccctgagctacgggaacacgctcgacctgaactccctggacatcgacgagcccaccggccagaccgcggactggctcaccatcatcgtctacctgacgagcttcgtggtgcccatcatcctgaaggccctctacatgctgaccacccgcggccggcagacctccaaggacaacaaggggatgcgcatccggttcaaggacgacagctcctacgaggacgtcaacggcatccgcaagccgaagcacctgtacgtgagcatgcccaacgcccagtccagcatgaaggccgaggagatcacgcccgggcggttccgcaccgccgtgtgcggcctctaccccgcgcagatcaaggcccggaacatggtctccccggtgatgagcgtggtcgggttcctggccctggccaaggactggacctcccgcatcgaggagtggctcggcgccccctgcaagttcatggcggagagccccatcgccggctccctgagcgggaaccccgtgaaccgggactacatccgccagcggcagggcgccctggccgggatggagccgaaggagttccaggccctccgccagcacgcgaaggacgccggctgcaccctggtggagcacatcgagagcccctccagcatctgggtcttcgccggcgcccccgaccggtgcccgcccacgtgcctgttcgtcgggggcatggccgagctcggggcgttcttctccatcctgcaggacatgcgcaacaccatcatggccagcaagaccgtgggcaccgccgacgagaagctgcgcaagaagtccagcttctaccagtcctacctccggcgcacgcagagcatggggatccagctggaccagcggatcatcgtgatgttcatggtggcctggggcaagaaggcggtggacaacttccacctgggcgacgacatggaccccgagctccgctccctggcccagatcctgatcgaccagaaggtcaaggagatcagcaaccaggagcccatgaagctctga

SEQ ID NO: 6579 - RNA, 1290 nt, synthetic construct
  misc_feature 1..1290: note = derived and/or modified CDS sequence (opt1) from SEOV(HuBJ16)__GQ279380.1__N
  source 1..1290: mol_type = other RNA
atggccaccatggaggagatccagcgcgagatcagcgcccacgagggccagctggtgatcgcgcggcagaaggtcaagaacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgaccccaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggacccccgtgaaccgggactacatccgccagcggcagggcgccctggccgggatggagccgaaggagttccaggccctccgccagcacgcgaaggacgccggctgcacgctggtggagcacatcgagagccccagctccatctgggtcttcgccggcgcccccgaccggtgcccgccgacctgcctgttcgtcgggggcatggccgagctcggggcgttcttcagcatcctgcaggacatgcgcaacaccatcatggcctccaagaccgtgggcacggccgacgagaagctgcgcaagaagtccagcttctaccagagctacctccggcgcacccagtccatggggatccagctggaccagcggatcatcgtgatgttcatggtggcctggggcaaggaggcggtggacaacttccacctgggcgacgacatggaccccgagctccgcagcctggcccagatcctgatcgaccagaaggtcaaggagatctccaaccaggagcccatgaagctctga

SEQ ID NO: 6580 - RNA, 1290 nt, synthetic construct
  misc_feature 1..1290: note = derived and/or modified CDS sequence (opt1) from SEOV(HuBJ22)__GQ279379.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgaccccaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggacccccgtgaaccgggactacatccgccagcggcagggcgccctggccgggatggagccgaaggagttccaggccctccgccagcacgcgaaggacgccggctgcacgctggtggagcacatcgagagccccagctccatctgggtcttcgccggcgcccccgaccggtgcccgccgacctgcctgttcgtcgggggcatggccgagctcggggcgttcttcagcatcctgcaggacatgcgcaacaccatcatggcctccaagaccgtgggcacggccgacgagaagctgcgcaagaagtccagcttctaccagagctacctccggcgcacccagtccatggggatccagctggaccagcggatcatcgtgatgttcatggtggcctggggcaaggaggcggtggacaacttccacctgggcgacgacatggaccccgagctccgcagcctggcccagatcctgatcgaccagaaggtcaaggagatctccaaccaggagcccatgaagctctga

SEQ ID NO: 6581 - RNA, 1290 nt, synthetic construct
  misc_feature 1..1290: note = derived and/or modified CDS sequence (opt1) from SEOV(HuBJ3)__GQ279391.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggtcaacaaggggatgcgcatccggttcaaggacgactccagctacgaggacgtgaacggcatccgcaagccgaagcacctgtacgtgtccatgcccaacgcccagagctccatgaaggccgaggagatcacgcccgggcggttccgcaccgccgtctgcggcctctaccccgcgcagatcaaggcccggaacatggtgagcccggtgatgtccgtcgtggggttcctggccctggccaaggactggaccagccgcatcgaggagtggctcggcgccccctgccggttcatggcggagtcccccatcgccggcagcctgtccgggaaccccgtgaaccgcgactacatccggcagcgccagggcgccctggccgggatggagccgaaggagttccaggccctccggcagcacgcgaaggacgccggctgcaccctggtcgagcacatcgagagccccagctccatctgggtgttcgccggcgcccccgaggggtgcccgcccacgtgcctgttcgtgggcgggatggccgagctcggcgcgttcttcagcatcctgcaggacatgcgcaacaccatcatggcctccaagaccgtcgggaccgccgacgagaagctgcgcaagaagtccagcttctaccagagctacctccggcgcacgcagtccatgggcatccagctggaccagcggatcatcgtgatgttcatggtggcctggggcaaggaggcggtcgacaacttccacctgggggacgacatggaccccgagctccgcagcctggcccagatcctgatcgaccagaaggtgaaggagatctccaaccaggagcccatgaagctctga

SEQ ID NO: 6582 - RNA, 1290 nt, synthetic construct
  misc_feature 1..1290: note = derived and/or modified CDS sequence (opt1) from SEOV(K24-e7)__AF288653.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacttcaacaagcgcgccctccacgaccgggagtccgtggccgccagcatccagtccaagatcgacgagctgaagcgccagctggcggaccggatcgccgccgggaagaacatcggccaggaccgcgacccgaccggggtggagcccggcgaccacctcaaggagcggagcgccctgtcctacgggaacacgctggacctcaacagcctggacatcgacgagcccaccggccagaccgcggactggctgaccatcatcgtctacctcacgtccttcgtggtgcccatcatcctgaaggccctgtacatgctcaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctgtaccccgcgcagatcaaggcccggaacatggtcagcccggtgatgtccgtggtcgggttcctcgccctggccaaggactggaccagccgcatcgaggagtggctgggcgccccctgcaagttcatggcggagtcccccatcgccggcagcctctccgggaaccccgtgaaccgggactacatccgccagcggcagggcgccctggccgggatggagccgaaggagttccaggccctgcgccagcacgcgaaggacgccggctgcaccctcgtggagcacatcgagagccccagctccatctgggtcttcgccggcgcccccgaccggtgcccgcccacgtgcctgttcgtcgggggcatggccgagctgggggcgttcttcagcatcctccaggacatgcgcaacaccatcatggcctccaagaccgtgggcaccgccgacgagaagctgcgcaagaagtccagcttctaccagagctacctgcggcgcacgcagtccatggggatccagctcgaccagcggatcatcgtgatgttcatggtggcctggggcaaggaggcggtggacaacttccacctgggcgacgacatggaccccgagctgcgcagcctcgcccagatcctgatcgaccagaaggtcaaggagatctccaaccaggagcccatgaagctgtga

SEQ ID NO: 6583 - RNA, 1290 nt, synthetic construct
  misc_feature 1..1290: note = derived and/or modified CDS sequence (opt1) from SEOV(K24-v2)__AF288655.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacttcaacaagcgcgccctccacgaccgggagtccgtggccgccagcatccagtccaagatcgacgagctgaagcgccagctggcggaccggatcgccgccgggaagaacatcggccaggaccgcgacccgaccggggtggagcccggcgaccacctcaaggagcggagcgccctgtcctacgggaacacgctggacctcaacagcctggacatcgacgagcccaccggccagaccgcggactggctgaccatcatcgtctacctcacgtccttcgtggtgcccatcatcctgaaggccctgtacatgctcaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctgtaccccgcgcagatcaaggcccggaacatggtcagcccggtgatgtccgtggtcgggttcctcgccctggccaaggactggaccagccgcatcgaggagtggctgggcgccccctgcaagttcatggcggagtcccccatcgccggcagcctctccgggaaccccgtgaaccgggactacatccgccagcggcagggcgccctggccgggatggagccgaaggagttccaggccctgcgccagcacgcgaaggacgccggctgcaccctcgtggagcacatcgagagccccagctccatctgggtcttcgccggcgcccccgaccggtgcccgcccacgtgcctgttcgtcgggggcatggccgagctgggggcgttcttcagcatcctccaggacatgcgcaacaccatcatggcctccaagaccgtgggcaccgccgacgagaagctgcgcaagaagtccagcttctaccagagctacctgcggcacacgcagtccatggggatccagctcgaccagcgcatcatcgtgatgttcatggtggcctggggcaaggaggcggtggacaacttccacctgggcgacgacatggaccccgagctgcggagcctcgcccagatcctgatcgaccagaaggtcaaggagatctccaaccaggagcccatgaagctgtga

SEQ ID NO: 6584 - RNA, 1290 nt, synthetic construct
  misc_feature 1..1290: note = derived and/or modified CDS sequence (opt1) from SEOV(OuhaiRf35)__FJ803208.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagcggcagggcgccctggccgggatggagccgaaggagttccaggccctccgccagcacgcgaaggacgccggctgcaccctggtggagcacatcgagagccccagctccatctgggtcttcgccggcgcccgggaccgctgcccgcccacgtgcctgttcgtcgggggcatggccgagctcggggcgttcttcagcatcctgcaggacatgcgcaacaccatcatggcctccaagaccgtgggcaccgccgacgagaagctgcggaagaagtccagcttctaccagagctacctccgccggacgcagtccatggggatccagctggaccagcgcatcatcgtgatgttcatggtggcctggggcaaggaggcggtggacaacttccacctgggcgacgacatggaccccgagctccggagcctggcccagatcctgatcgaccagaaggtcaaggagatctccaaccaggagcccatgaagctctga

SEQ ID NO: 6585 - RNA, 1290 nt, synthetic construct
  misc_feature 1..1290: note = derived and/or modified CDS sequence (opt1) from SEOV(OuhaiRn146)__FJ803210.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagggccagggggccctggccggcatggagccgaaggagttccaggccctccggcagcacgcgaaggacgccggctgcaccctggtggagcacatcgagagccccagctccatctgggtcttcgccggggcccgcgaccggtgcccgcccacgtgcctgttcgtgggcgggatggccgagctcggcgcgttcttcagcatcctgcaggacatgcgcaacaccatcatggcctccaagaccgtggggaccgccgacgagaagctgcgcaagaagtccagcttctaccagagctacctccggcgcacgcagtccatgggcatccagctggaccagcggatcatcgtcatgttcatggtggcctggggcaaggaggcggtggacaacttccacctgggggacgacatggaccccgagctccgcagcctggcccagatcctgatcgaccagaaggtcaaggagatctccaaccaggagcccatgaagctctga

SEQ ID NO: 6586 - RNA, 1290 nt, synthetic construct
  misc_feature 1..1290: note = derived and/or modified CDS sequence (opt1) from SEOV(Pf26)__AY006465.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcgtgcagtccaagatcgacgagctgaagcgccagctcgcggaccggatcgccgccgggaagaacatcggccaggaccgcgacccgaccggggtcgagcccggcgaccacctgaaggagcggagcgccctgtcctacgggaacacgctcgacctgaacagcctggacatcgacgagcccaccggccagaccgcggactggctcaccatcatcgtgtacctgacgtccttcgtggtccccatcatcctgaaggccctctacatgctgaccacccgcggccggcagaccagcaaggacaacaaggggatgcgcatccggttcaaggacgactccagctacgaggacgtgaacggcatccgcaagccgaagcacctgtacgtgtccatgcccaacgcccagagctccatgaaggccgaggagatcacgcccgggcggttccgcaccgccgtctgcggcctctaccccgcgcagatcaagccgcggaacatggtgagccccgtgatctccgtcgtggggttcctggccctggccaaggactggaccagccgcatcgaggagtggctcggcgccccctgcaagttcatggccgagtcccccatcgcgggcagcctgtccgggaacccggtgaaccgggactacatccgccagcggcagggcgccctggccgggatggagcccaaggagttccaggccctccgccagcacgccaaggacgcgggctgcaccctggtcgagcacatcgagagccccagctccatctgggtgttcgccggcgcccccgaccggtgcccgcccacgtgcctgttcgtcgggggcatggccgagctcggggccttcttcagcatcctgcaggacatgcgcaacaccatcatggcgtccaagaccgtgggcaccgccgacgagaagctgcgcaagaagtccagcttctaccagagctacctccggcgcacgcagtccatggggatccagctggaccagcggatcatcgtgatgttcatggtggcctggggcaaggaggccgtcgacaacttccacctgggcgacgacatggaccccgagctccgcagcctggcgcagatcctgatcgaccagaaggtgaaggagatctccaaccaggagcccatgaagctctga

SEQ ID NO: 6587 - RNA, 1290 nt, synthetic construct
  misc_feature 1..1290: note = derived and/or modified CDS sequence (opt1) from SEOV(Rn-CP7)__GQ279382.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggagcatggtctccccggtgatgagcgtggtcgggttcctggccctggccaaggactggacctcccgcatcgaggagtggctcggcgccccctgcaagttcatggcggagagccccatcgccggctccctgagcgggaaccccgtgaaccgggactacatccgccagcggcagggcgccctggccgggatggagccgaaggagttccaggccctccgccagcacgcgaaggacgccggctgcaccctggtggagcacatcgagagcccctccagcatctgggtcttcgccggcgcccccgaccggtgcccgcccacgtgcctgttcgtcgggggcatggccgagctcggggcgttcttctccatcctgcaggacatgcgcaacaccatcatggccagcaagaccgtgggcaccgccgacgagaagctgcgcaagaagtccagcttctaccagtcctacctccggcgcacgcagagcatggggatccagctggaccagcggatcatcgtgatgttcatggtggcctggggcaaggaggcggtggacaacttccacctgggcgacgacatggaccccgagctccgctccctggcccagatcctgatcgaccagaaggtcaaggagatcagcaaccaggagcccatgaagctctga

SEQ ID NO: 6588 - RNA, 1290 nt, synthetic construct
  misc_feature 1..1290: note = derived and/or modified CDS sequence (opt1) from SEOV(Rn-DC8)__GQ279386.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgaccccaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccgcccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacccccgggcggttccgcacggcggtgtgcggcctctaccccgcccagatcaaggcccggagcatggtctccccggtgatgagcgtggtcgggttcctggccctggccaaggactggacctcccgcatcgaggagtggctcggcgcgccctgcaagttcatggccgagagccccatcgccggctccctgagcgggaaccccgtgaaccgggactacatccgccagcggcagggcgccctggccgggatggagccgaaggagttccaggcgctccgccagcacgccaaggacgccggctgcaccctggtggagcacatcgagagcccctccagcatctgggtcttcgccggcgcccccgaccggtgcccgccgacctgcctgttcgtcgggggcatggcggagctcggggccttcttctccatcctgcaggacatgcgcaacacgatcatggccagcaagaccgtgggcaccgccgacgagaagctgcgcaagaagtccagcttctaccagtcctacctccggcgcacccagagcatggggatccagctggaccagcggatcatcgtgatgttcatggtggcgtggggcaaggaggccgtggacaacttccacctgggcgacgacatggaccccgagctccgctccctggcccagatcctgatcgaccagaaggtcaaggagatcagcaaccaggagcccatgaagctctga

SEQ ID NO: 6589 - RNA, 1290 nt, synthetic construct
  misc_feature 1..1290: note = derived and/or modified CDS sequence (opt1) from SEOV(Rn-M11)__GQ279383.1__N
  source 1..1290: mol_type = other RNA
atggccaccatggaggagatccagcgcgagatcagcgcccacgagggccagctggtgatcgcgcggcagaaggtcaagaacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggagcatggtctccccggtgatgagcgtggtcgggttcctggccctggccaaggactggacctcccgcatcgaggagtggctcggcgccccctgcaagttcatggcggagagccccatcgccggctccctgagcgggaaccccgtgaaccgggactacatccgccagcggcgcggcgccctggccgggatggagccgaaggagttccaggccctccggcagcacgcgaaggacgccggctgcaccctggtggagcacatcgagagcccctccagcatctgggtcttcgccggcgcccccgaccgctgcccgcccacgtgcctgttcgtcgggggcatggccgagctcggggcgttcttctccatcctgcaggacatgcgcaacaccatcatggccagcaagaccgtgggcaccgccgacgagaagctgcggaagaagtccagcttctaccagtcctacctccgccggacgcagagcatggggatccagctggaccagcgcatcatcgtgatgttcatggtggcctggggcaaggaggcggtggacaacttccacctgggcgacgacatggaccccgagctccggtccctggcccagatcctgatcgaccagaaggtcaaggagatcagcaaccaggagcccatgaagctctga

SEQ ID NO: 6590 - RNA, 1290 nt, synthetic construct
  misc_feature 1..1290: note = derived and/or modified CDS sequence (opt1) from SEOV(RuianRf74)__FJ803213.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgaccccaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcatggccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagcggcagggcgccctggccgggatggagccgaaggagttccaggccctccgccagcacgcgaaggacgccggctgcaccctggtggagcacatcgagagccccagctccatctgggtcttcgccggcgcccccgaccggtgcccgccgacctgcctgttcgtcgggggcatggccgagctcggggcgttcttcagcatcctgcaggacatgcgcaacacgatcatggcctccaagaccgtgggcaccgccgacgagaagctgcgcaagaagtccagcttctaccagagctacctccggcgcacccagtccatggggatccagctggaccagcggatcatcgtgatgttcatggtggcctggggcaaggaggcggtggacaacttccacctgggcgacgacatcgaccccgagctccgcagcctggcccagatcctgatcgaccagaaggtcaaggagatctccaaccaggagcccatgaagctctga

SEQ ID NO: 6591 - RNA, 1290 nt, synthetic construct
  misc_feature 1..1290: note = derived and/or modified CDS sequence (opt1) from SEOV(RuianRn23)__FJ803214.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagcggcagggcgccctggccgggatggagccgaaggagttccaggccctccgccagcacgcgaaggacgccggctgcaccctggtggagcacatcgagagccccagctccatctgggtcttcgccggcgcccccgaccggtgcccgcccacgtgcctgttcgtcgggggcatggccgagctcggggcgttcttcagcatcctgcaggacatgcgcaacaccatcaaggcctccaagaccgtgggcaccgccgacgagaagctgcgcaagaagtccagcttctaccagagctacctccggcgcacgcagtccatggggatccagctggaccagcggatcatcgtgatgttcatggtggcctggggcaaggaggcggtggacaacttccacctgggcgacgacatggaccccgagctccgcagcctggcccagatcctgatcgaccagaaggtcaaggagatctccaaccaggagcccatgaagctctga

SEQ ID NO: 6592 - RNA, 1290 nt, synthetic construct
  misc_feature 1..1290: note = derived and/or modified CDS sequence (opt1) from SEOV(RuianRn33)__FJ803215.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacaccctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagcggcagggcgccctggccgggatggagccgaaggagttccaggccctccgccagcacgcgaaggacgccggctgcaccctggtggagcacatcgagagccccagctccatctgggtcttcgccggcgcccccgaccggtgcccgcccacgtgcctgttcgtcgggggcatggccgagctcggggcgttcttcagcatcctgcaggacatgcgcaacaccatcatggcctccaagaccgtgggcaccgccgacgagaagctgcgcaagaagtccagcttctaccagagctacctccggcgcacgcagtccatggggatccagctggaccagcggatcatcgtgatgttcatggtggcccgcggcaaggaggcgatgtacaacctgcacctccgggacgacatgacgccccagctgctgctcctggtgcagatcctgctcgaccaccaggtcaaggagatcagcaaccaggagctgatgaagctgtga

SEQ ID NO: 6593 - RNA, 1290 nt, synthetic construct
  misc_feature 1..1290: note = derived and/or modified CDS sequence (opt1) from SEOV(SC106)__GU361893.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgcccatgcccaacgcccagtccagcatgaaggccgaggagatcacgcccgggcggttccgcaccgccgtgtgcggcctctacccggcgcagatcaaggcccggaacatggtctcccccgtgatgagcgtggtcgggttcctggccctggccaaggactggacctcccgcatcgaggagtggctcggcgccccctgcaagttcatggcggagagccccatcgccggctccctgagcgggaacccggtgaaccgggactacatccgccagcggcagggcgccctggccgggatggagcccaaggagttccaggccctccgccagcacgcgaaggacgccggctgcaccctggtggagcacatcgagtcccccagcagcatctgggtcttcgccggcgcccccgaccggtgcccgcccacgtgcctgttcgtcgggggcatggccgagctcggggcgttcttctccatcctgcaggacatgcgcaacaccatcatggccagcaagaccgtgggcaccgccgacgagaagctgcgcaagaagtccagcttctaccagtcctacctccggcgcacgcagagcatggggatccagctggaccagcggatcatcgtgatgttcatggtggcctggggcaaggaggcggtggacaacttccacctgggcgacgacatggaccccgagctccgctccctggcccagatcctgatcgaccagaaggtcaaggagatcagcaaccaggagcccatgaagctctga

SEQ ID NO: 6594 - RNA, 1290 nt, synthetic construct
  misc_feature 1..1290: note = derived and/or modified CDS sequence (opt1) from SEOV(SEO/Belgium/Rn895/2005)__JQ898106.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggactcccccatcgccggcagcctgtccgggaaccccgtgaaccgggactacatccgccagcggcagggcgccctggccgggatggagccgaaggagttccaggccctccgccagcacagcaaggacgcgggctgcaccctggtggagcacatcgagagcccctccagcatctgggtcttcgccggcgcccccgaccggtgcccgcccacgtgcctgttcgtcgggggcatggccgagctcggggccttcttctccatcctgcaggacatgcgcaacaccatcatggcgagcaagaccgtgggcaccgccgacgagaagctgcgcaagaagtccagcttctaccagtcctacctccggcgcacgcagagcatggggatccagctggaccagcggatcatcgtgatgttcatggtggcctggggcaaggaggccgtggacaacttccacctgggcgacgacatggaccccgagctccgctccctggcgcagatcctgatcgaccagaaggtcaaggagatcagcaaccaggagcccatgaagctctga

SEQ ID NO: 6595 - RNA, 1290 nt, synthetic construct
  misc_feature 1..1290: note = derived and/or modified CDS sequence (opt1) from SEOV(Taonan420)__KF745951.1__N
  source 1..1290: mol_type = other RNA
atggccaccatggaggagatccagcgcgagatcagcgcccacgagggccagctggtgatcgcgcggcagaacgtcaaggacgccgagaagcagtacgagaaggaccccgacgacctcaacaagcgcgccctgcacgaccgggagtccgtggccgccagcatccagtccaagatcgacgagctgaagcgccagcccgcggaccggatcgccgccgggaagaacatcggccaggaccgcgaccccaccggggtggagcccggcgaccacctcaaggagcggagcgccctgtcctacgggaacacgctggacctcaaccgcctggacatcgacgagcccaccggccagcgggcggactggctgaccatcatcgtctacctcaccagcttcgtggtgcgcatcatcctgaaggccctgtacatgttctccacgcggggccgccagaccagcaaggacaacaaggggctccggatccgcttcaaggacgactccagctacgaggacttcaacggcatccggaagccgaagcacctgtacgtccccatgcccaacgcccagtccagcatgaaggccgaggagatcacccccgggcgcttccggaccgccgtgtgcggcctgtacccggcgcagatcaaggcccgcaacatggtgtcccccgtcatgagcgtggtggggttcctcgccctggccaaggactggacgtcccggatcgaggagtggctgggcgccccctgcaagttcatggcggagagccccatcgccggctccctcagcgggaacccggtcaaccgcgactacatccggcagcgccagggcgccctggccgccatggagcccaaggagttccaggcgctgcgccagcacgccaaggaccccgggtgcaccctcgtggagcacatcgagtcccccagcagcatctgggtgtccgccggcgccccggaccggtgcccgccgacctgcctgttcgtcggcgggatggccgagctgggcgcgttcttcagcatcttccaggacatgcgcaacaccatcatgccctccaagacggtggggaccgccgacgagaagctccggaagaagtccctgttctaccagagctacctgcgccggacccagagcatgggcatccagctcgaccagcgcatcatcgtgatgttcatggtcgcctgggggaaggaggccgtggacaacttccacctccccgacgacatggaccccgagctgcggtccctggcgcagatcctgatcgtgcagaaggtcaaggagatcagcaaccaggagcccatgaagctgtga

SEQ ID NO: 6596 - RNA, 1290 nt, synthetic construct
  misc_feature 1..1290: note = derived and/or modified CDS sequence (opt1) from SEOV(Taonan52)__KF745950.1__N
  source 1..1290: mol_type = other RNA
atggccaccatggaggagatccagcgcgagatcagcgcccacgagggccagctggtgaccgcgcggcagaaggtcaaggacgccgagaagcagtacgagaaggaccccgacgacctcaacaagcgcgccctgcacgaccgggagtccgtggccgccagcatccagtccaagatcgacgaggtgaagcgccagctggcggaccggatcgccgccgggaagaacatcggccaggaccgcgacccgacgggggtcgagcccggcgaccaccccaaggagcggagcgccctctcctacgggaacaccctggacctgaacagcctcgacatcgacgagcccaccggccagaccgcggactggctgacgatcatcgtgtacctgacctccttcgtggtcccgatcatcctcaaggccctgtacatgagcaccacccgcggccggcagacgtccaaggacaaccgcgggatgcggatccgcttccaggacgacagctcctacgaggacgtgaacggcatccggaagcccaagcacctgtacgtgcccatgcccaacgcccagagctccatgaaggccgaggaggtcaccccggggcgcttccggaccgccgtgtgcggcctctaccccgcgcagatcaaggcccgcaacatggtgcggcccgtcatgagcgtggtggggttcctggccctggccaaggcctggacctcccgcatcgaggagtggctcggcgcgccctgcaagttcatggccgagagcccgatcgccggctccctgagcgggaaccccgtctaccgggactacatccgccagcggcagggcgccctggccgggatggagcccaaggagttccaggcgctccgccagcacgccaaggacgccggctgcacgctggtggagctgatcgagtcccccagcagcatctccgtgttcgccggcgccccggaccgctgcccccggacctgcctcttcgtcgggggcatggcggagctgggggccaacttcagcatgctgcaggacatgtccaacaccatcatggccagcaagaccgtgggcacggccgacgagaagctccgcaagaagtccagcttctaccagtcctacctgcggcgcacccagagcatggggatccagctggaccagcggatcatcgtgatgttcatggtcgcgtccggcaaggaggccgtggactacttccacctcggcgacgacatggaccccgagctgcgcagcctggcccccatcctcatcgaccagaaggtgaaggagatctccaaccaggagccgatgaagctgtga

SEQ ID NO: 6597 - RNA, 1290 nt, synthetic construct
  misc_feature 1..1290: note = derived and/or modified CDS sequence (opt1) from SEOV(WuhanMm24)__JQ665911.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgccgccgcgagcatccagtccaagatcgacgagctgaagcgccagctcgccgaccggatcgccgccgggaagaacatcggccaggaccgcgacccgaccggggtggagcccggcgaccacctgaaggagcggagcgcgctgtcctacgggaacacgctcgacctgaacagcctggacatcgacgagcccaccggccagaccgccgactggctcaccatcatcgtgtacctgacgtccttcgtcgtgcccatcatcctgaaggccctctacatgctgaccacccgcggccggcagaccagcaaggacaacaaggggatgcgcatccggttcaaggacgactccagctacgaggacgtgaacggcatccgcaagccgaagcacctgtacgtctccatgcccaacgcccagagctccatgaaggccgaggagatcacgcccgggcggttccgcaccgcggtgtgcggcctctaccccgcccagatcaaggcccggaacatggtgagcccggtcatgtccgtggtggggttcctggccctggccaaggactggaccagccgcatcgaggagtggctcggcgcgccctgcaagttcatggccgagtcccccatcgccggcagcctgtccgggaaccccgtcaaccgggactacatccgccagcggcagggcgccctggccgggatggagccgaaggagttccaggcgctccgccagcacagcaaggacgccggctgcaccctggtggagcacatcgagagcccctccagcatctgggtgttcgccggcgcccccgaccggtgcccgcccacgtgcctgttcgtcgggggcatggccgggctcggcgcgttcttctccatcctgcaggacatgcgcaacaccatcatggccagcaagaccgtggggaccgccgacgagaagctgcgcaagaagtccagcttctaccagtcctacctccggcgcacgcagagcatgggcatccagctggaccagcggatcatcgtgatgttcatggtcgcctggggcaaggaggcggtggacaacttccacctgggggacgacatggaccccgagctccgctccctggcccagatcctgatcgaccagaaggtgaaggagatcagcaaccaggagcccatgaagctctga

SEQ ID NO: 6598 - RNA, 1290 nt, synthetic construct
  misc_feature 1..1290: note = derived and/or modified CDS sequence (opt1) from SEOV(WuhanRf02)__JQ665912.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctggaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccgggacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagcggcagggcgccctggccgggatggagccgaaggagttccaggccctccgccagcacagcaaggacgcgggctgcaccctggtggagcacatcgagagcccctccagcatctgggtcttcgccggcgcccgggaccgctgcccgcccacgtgcctgttcgtcgggggcatggccgagctcggggccttcttctccatcctgcaggacatgcgcaacaccatcatggcgagcaagaccgtgggcaccgccgacgagaagctgcggaagaagtccagcttctaccagtcctacctccgccggacgcagagcatggggatccagctggaccagcgcatcatcgtgatgttcatggtggcctggggcaaggaggccgtggacaacttccacctgggcgacgacatggaccccgagctccggtccctggcgcagatcctgatcgaccagaaggtcaaggagatcagcaaccaggagcccatgaagctctga

SEQ ID NO: 6599 - RNA, 1290 nt, synthetic construct
  misc_feature 1..1290: note = derived and/or modified CDS sequence (opt1) from SEOV(WuhanRf07)__JQ665913.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagcggcagggcgccctggccgggatggagccgaaggagttccaggccctccgccagcacagcaaggacgcgggctgcaccctggtggagcacatcgagagcccctccagcatctgggtcttcgccggcgcccgggaccgctgcccgcccacgtgcctgttcgtcgggggcatggccgagctcggggccttcttctccatcctgcaggacatgcgcaacaccatcatggcgagcaagaccgtgggcaccgccgacgagaagctgcggaagaagtccagcttctaccagtcctacctccgccggacgcagagcatggggatccagctggaccagcgcatcatcgtgatgttcatggtggcctggggcaaggaggccgtggacaacttccacctgggcgacgacatggaccccgagctccggtccctggcgcagatcctgatcgaccagaaggtcaaggagatcagcaaccaggagcccatgaagctctga

SEQ ID NO: 6600 - RNA, 1290 nt, synthetic construct
  misc_feature 1..1290: note = derived and/or modified CDS sequence (opt1) from SEOV(ZJ5)__FJ753400.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaacctggtgaaccgggactacatccgccagcggcagggcgccctcgccgggatggagcccaaggagttccaggccctgcgccagcacagcaaggacgcgggctgcaccctggtggagcacatcgagagcccgtccagcatctgggtcttcgccggcgcccccgaccggtgcccgcccacgtgcctcttcgtcgggggcatggccgagctgggggccttcttctccatcctgcaggacatgcgcaacaccatcatggcgagcaagaccgtgggcaccgccgacgagaagctccgcaagaagtccagcttctaccagtcctacctgcggcgcacgcagagcatggggatccagctggaccagcggatcatcgtgatgttcatcgtggcctggggcaaggaggccgtggacaacttccacctcggcgacgacctggaccccgagctgcgctccctcgcgcagatcctgatcgaccagaaggtcaaggagatcagcaaccaggagcccatgaagctgtga

SEQ ID NO: 6601 - RNA, 1290 nt, synthetic construct
  misc_feature 1..1290: note = derived and/or modified CDS sequence (opt1) from SEOV(ZT10)__AY766368.1__N
  source 1..1290: mol_type = other RNA
atggccctgtgcgaggagatccagcgcgagatcagcgcccacgagggccagctcgtgatcgcgcggcagaaggtcaaggacgccgagaagcagtacgagaaggaccccgacgacttcaacaagcgcgccctgcacgaccgggagtccgtggccgccagcatccagtccaagatcgacgagctgaagcgccagctcgcggaccggatcgccgccgggaagaacatcggccaggaccgcgaccccaccggggtggagcccggcgaccacctgaaggagcggagcgccctgtcctacgggaacaccctcgacctgaacagcctggacatcgacgagcccacgggccagaccgcggactggctcaccatcatcgtctacctgacctccttcgtggtgcccatcatcctgaaggccctctacatgctgacgacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacccccgggcggttccgcacggccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagcggcagggcgccctggccgggatggagccgaaggagttccaggccctccgccagcacgcgaaggacgccggctgcaccctggtggagcacatcgagagccccagctccatctgggtcttcgccggcgcccccgaccggtgcccgccgacctgcctgttcgtcgggggcatggccgagctcggggcgttcttcagcggcctggccgacatgcgcaacacgatcatggcctccaagaccgaggggaccgccgacgagaagctgcgcaagaagtccagcttctaccagagctacctccggcgccagcagtccatgggcatccagctggaccagcggatcatcgtgatgttcatggtggcgtggggcaaggaggccgtggacaacttccacctgggggacgacatggaccccgagctccgcagcctggcccagatcctgatcgaccagaaggtgaaggagatctccaaccaggagcccatgaagctctga

SEQ ID NO: 6602 - RNA, 1290 nt, synthetic construct
  misc_feature 1..1290: note = derived and/or modified CDS sequence (opt1) from SEOV(ZT71)__AY750171.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacttcaacaagcgcgccctccacgaccgggagtccgtggccgccagcatccagtccaagatcgacgagctgaagcgccagctggcggaccggatcgccgccgggaagaacatcggccaggaccgcgacccgaccggggtggagcccggcgaccacctcaaggagcggagcgccctgtcctacgggaacacgctggacctcaacagcctggacatcgacgagcccaccggccagaccgcggactggctgaccatcatcgtctacctcacgtccttcgtggtgcccatcatcctgaaggccctgtacatgctcaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctgtaccccgcgcagatcaaggcccggaacatggtcagcccggtgatgtccgtggtcgggttcctcgccctggccaaggactggaccagccgcatcgaggagtggctgggcgccccctgcaagttcatggcggagtcccccatcgccggcagcctctccgggaaccccgtgaaccgggactacatccgccagcggcagggcgccctggccgggatggagccgaaggagttccaggccctgcgccagcacgcgaaggacgccggctgcaccctcgtggagcacatcgagagccccagctccatctgggtcttcgccggcgcccccgaccggtgcccgcccacgtgcctgttcgtcgggggcatggccgagctgggggcgttcttcagcatcctccaggacatgcgcaacaccatcatggcctccaagaccgagggcaccgccgacgagaagctgcgcaagaagtccagcttctaccagagctacctgcggcgccagcagtccatggggatccagctcgaccagcggatcatcgtgatgttcatggtggcctggggcaaggaggcggtggacaacttccacctgggcgacgacatggaccccgagctgcgcagcctcgcccagatcctgatcgaccagaaggtgaaggagatctccaaccaggagcccatgaagctgtga

SEQ ID NO: 6603 - RNA, 1290 nt, synthetic construct
  misc_feature 1..1290: note = derived and/or modified CDS sequence (opt1) from SEOV(zy27)__AF406965.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgactccaacaagcgcgccctccacgaccgggagagcgtggccgcctccatccagagcaagatcgacgagctgaagcgccagctggcggaccggatcgccgccgggaagaacatcggccaggaccgcgacccgaccggggtggagcccggcgaccacctcaaggagcggtccgcccccagctacgggaacacgctggacctgaactccctcgacatcgacgagcccaccggccagaccgcggactggctgaccatcatcgtctacctgacgagcttcgtggtgccgatcatcctcaaggccctgtacatgctgaccacccgcggccggcagacctccaaggacaacaaggggatgcgcatccggttcaaggacgacagctcctacgaggacgtcaacggcatccgcaagcccaagcacctctacgtgagcatgcccaacgcccagtccagcatgaaggccgaggagatcacgcccgagcggttccgcaccgccgtgtgcgggctgtacccggcgcagatcaaggcccggaacatggtctcccccgtgatgagcgtggtcggcttcctggccctcgccaaggactggacctcccgcatcgaggagtggctgggggccccctgcaagttcatggcggagagccccatcgccggctccctgagcggcaacccggtgaaccgggaccacatccgccagcggcagggggccctcgccggcatggagcccaaggagttccaggccctgcgccagcacgcgaaggacgccgggtgcaccctggtggagcacatcgagagcccctccagcatctgggtcttcgccggcgcccccgaccggtgcccgcccacgtgcctcttcgtgggcgggatggccgagctgggcgcgttcttctccatcctgcaggacatgcgcaacaccatcatggccagcaagaccgtggggaccgccgacgagaagctccgcaagaagtccagcttctaccagtcctacctgcggcgcacgcagagcatgggcatccagctggaccagcggatcatcgtcatgttcatggtggcctgggggaaggaggcggtggacaacttccacctcggcgacgacatggaccccgagctgcgctccctggcccagatcctcatcgaccagaaggtcaaggagatcagcaaccaggagcccatgaagctgtga

SEQ ID NO: 6604 - RNA, 1290 nt, synthetic construct
  misc_feature 1..1290: note = derived and/or modified CDS sequence (opt1) from SEOV(DN2)__KX289954.1__N
  source 1..1290: mol_type = other RNA
atggccaccatggaggagatccagcgcgagatcagcgcccacgagggccagctggtgatcgcgcggcagaaggccaaggacgccgagaagcagtacgagaaggaccccgacgacctcaacaagcgcgccctgcacgaccgggggtccgtcgccgcgagcatccagtccaagatcgacgagctgaagcgccagctcgccgaccggatcgccgccggcaagaacatcgggcaggaccgcgacccgaccggcgtggagcccggggaccacctgaaggagcggagcgcgctgtcctacggcaacacgctcgacctgaacagcctggacatcgacgagcccaccggccagaccgccgactggctcaccatcatcgtgtacctgacgtccttcgtcgtgcccatcatcctgaaggccctctacatgctgaccacccgcgggcggcagaccagcaaggacaacaagggcatgcgcatccggttcaaggacgactccagctacgaggacgtgaacgggatccgcaagccgaagcacctgtacgtctccatgcccaacgcccagagctccatgaaggccgaggagatcacgcccggccggttccgcaccgcggtgtgcgggctctaccccgcccagatcaaggcccggaacatggtgagcccggtcatgtccgtggtgggcttcctggccctggccaaggactggaccagccgcatcgaggagtggctcggcgagccctgcaagttcatggcggagtcccccatcgccgggagcctgtccggcaaccccgtcaaccgggactacatccgccagcggcagggggccctggccggcatggagccgaaggagttccaggccctccgccagcacagcaaggacgcgggctgcaccctggtggagcacatcgagagcccctccagcatctgggtgttcgccggggcccccgaccggtgcccgcccacgtgcctgttcgtcggcgggatggccgagctcggcgtgttcttctccatcctgcaggacatgcgcaacaccatcatggccagcaagaccgtggggaccgcggacgagaagctgcgcaagaagtccagcttctaccagtcctacctccggcgcacgcagagcatgggcatccagctggaccagcggatcatcgtcatgttcatggtggcctggggcaaggaggccgtggacaacttccacctgggggacgacatggaccccgagctccgctccctggcccagatcctgatcgaccagaaggtcaaggagatcagcaaccaggagcccatgaagctctga

SEQ ID NO: 6605 - RNA, 1290 nt, synthetic construct
  misc_feature 1..1290: note = derived and/or modified CDS sequence (opt1) from SEOV(IR162)__KX079476.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgaccccaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcgacaccccctgcaagttcatggtggagtcccccatcgccggcagcctgtccggcaaccccgtgaaccgggactacatccgccagcggcagggggcgctggccggcatggagccgaaggagttccaggccctccgccagcacagcaaggacgccgggtgcacgctggtcgagcacatcgagagcccctccagcatctgggtgttcgccggcgcgcccgaccggtgcccgccgacctgcctgttcgtgggcgggatggccgagctcggcgccttcttctccatcctgcaggacatgcgcaacaccatcatggccagcaagaccgtcgggacggccgacgagaagctgcgcaagaagtccagcttctaccagtcctacctccggcgcacccagagcatgggcatccagctggaccagcggatcatcgtgatgttcatggtggcgtgggggaaggaggccgtcgacaacttccacctgggcgacgacatggaccccgagctccgctccctggcccagatcctgatcgaccagaaggtgaaggagatcagcaaccaggagcccatgaagctctga

SEQ ID NO: 6606 - RNA, 1290 nt, synthetic construct
  misc_feature 1..1290: note = derived and/or modified CDS sequence (opt1) from SEOV(Gou3)__AF184988.1__N
  source 1..1290: mol_type = other RNA
atggccaccatggaggagatccagcgcgagatcagcgcccacgagggccagctggtgatcgcgcggcgcaaggtcaaggacgccgagaagcagtacgagaaggaccccgacgacctcaacaagcgggccctgcacgaccgcgagtccgtggccgccagcatccagtccaagatcgacgagctgaagcggcagctcgcggaccgcatcgccgccgggaagaacatcggccaggaccgggacccgaccggggtggagcccggcgaccacctgaaggagcgcagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccggggccgccagaccagcaaggacaacaaggggatgcggatccgcttcaaggacgactccagctacgaggacgtcaacggcatccggaagccgaagcacctgtacgtgtccatgcccaacgcccagagctccatgaaggccgaggagatcacgcccgggcgcttccggaccgccgtgtgcggcctctaccccgcgcagatcaaggcccgcaacatggtcagcccggtgatgtccgtggtcgggttcctggccctggccaaggactggaccagccggatcgaggactggctcggcgccccctgcaagttcatggcggagtcccccatcgccggcagcctgtccgggaaccccgtgaaccgcgactacatccggcagcgccagggcgccctggccgggatggagccgaaggagttccaggccctccggcagcacagcaaggacgcgggctgcaccctggtggagcacatcgagagcccctccagcatctgggtcttcgccggcgcccccgaccgctgcccgcccacgtgcctgttcgtcgggggcatggccgagctcggggccttcttcttcatcctgcaggacatgcgcaacaccatcatggcgtccaagaccgtgggcaccgccgacgagaagctgcggaagaagtccagcttctaccagagctacctccgccggacgcagtccatggggatccagctggaccagcgcatcatcgtgatgttcatggtggcctggggcaaggaggccgtggacaacttccacctgggcgacgacatggaccccgagctccggagcctggcgcagatcctgatcgaccagaaggtcaaggagatctccaaccaggagcccatgaagctctga

SEQ ID NO: 6607 - RNA, 1290 nt, synthetic construct
  misc_feature 1..1290: note = derived and/or modified CDS sequence (opt1) from SEOV(Gou3-v9)__AF288651.1__N
  source 1..1290: mol_type = other RNA
atggccaccaaggaggagatccagcgcgagatcagcgcccacgagggccagctggtgatcgcgcggcagaaggtcaaggacgccgagaagcagtacgagaaggaccccgacgtgctcaacaagcgcgccctgcacgaccgggagtccgtggccgccagcatccagtccaagatcgacgagctgaagcgccagctcgcggaccggatcgccgccggcaagagcatcgggcaggaccgcgacccgaccggggtcgagcccggcgaccacctgaaggagcggtccgccctgagctacgggaacacgctcgacctgaactccctggacatcgacgagcccaccggccagaccgcggactggctcaccatcatcgtgtacctgacgagcttcgtggtccccatcatcctgaaggccctctacatgctgaccacccgcggccggcagacctccaaggacaaccgcgggatgcggatccgcttcaaggacgacagctcctacgaggacgtgaacggcatccggaagccgaagcacctgtacgtgagcatgcccaacgcccagtccagcatgaaggccgaggagatcacgcccgggcgcttccggaccgccgtctgcggcctctaccccgcgcagatcaaggcccgcaacatggtgtccccggtgatgagcgtcgtggggttcctggccctggccaaggactggacctcccggatcgaggactggctcggcgccccctgcaagttcatggcggagagccccatcgccggctccctgagcgggaaccccgtgaaccgcgactacatccggcagcgccagggcgccctggccgggatggagccgaaggagttccaggccctccggcagcacagcaaggacgcgggctgcaccctggtcgagcacatcgagtcccccagctccatctgggtgttcgccggcgcccccgaccgctgcccgcccacgtgcctgttcgtcgggggcatggccgagctcggggccttcttcagcatcctgcaggacatgcgcaacaccatcatggcgtccaagaccgtgggcaccgccgacgagaagctgcggaagaagtccagcttctaccagagctacctccgccggacgcagtccatggggatccagctggaccagcgcatcatcgtgatgttcatggtggcctggggcaaggaggccgtcgacaacttccacctgggcgacgacatggaccccgagctccggagcctggcgcagatcctgatcgaccagaaggtgaaggagatctccaaccaggagcccatgaagctctga

SEQ ID NO: 6608 - RNA, 1290 nt, synthetic construct
  misc_feature 1..1290: note = derived and/or modified CDS sequence (opt1) from SEOV(IR461)__AF329388.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgaccccaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatccgcatccggttcaaggacgactccagctacgagaacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggccgggaacatggtcagcccggtgatgtccgtggtcggcttcctggccctggccaaggactggaccagccggatcgaggagtggctcgacaccccctgcaagttcatggtggagtcccccatcgccggcagcctgtccgggaaccccgtgaaccgcgactacatccggcagcgccagggcgcgctggccgggatggagccgaaggagttccaggccctccggcagcacagcaaggacgccggctgcacgctggtcgagcacatcgagagcccctccagcatctgggtgttcgccggcgcgcccgaccgctgcccgccgacctgcctgttcgtcgggggcatggccgagctcggggccttcttctccatcctgcaggacatgcggaacaccatcatggccagcaagaccgtgggcacggccgacgagaagctgcgcaagaagtccagcttctaccagtcctacctccgccggacccagagcatggggatccagctggaccagcgcatcatcgtgatgttcatggtggcgtggggcaaggaggccgtcgacaacttccacctgggcgacgacatggaccccgagctccggtccctggcccagatcctgatcgaccagaaggtgaaggagatcagcaaccaggagcccatgaagctctga

SEQ ID NO: 6609 - RNA, 1290 nt, synthetic construct
  misc_feature 1..1290: note = derived and/or modified CDS sequence (opt1) from SEOV(JUN5-14)__DQ217791.1__N
  source 1..1290: mol_type = other RNA
atggccaccatggaggagttccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagcggcagggcgccctggccgggatggagccgaaggagttccaggccctccgccagcacgcgaaggacgccggctgcaccctggtggagcacatcgagagccccagctccatctgggtcttcgccggcgcccccgaccggtgcccgcccacgtgcctgttcgtcgggggcatggccgagctcggggcgttcttcagcatcctgcaggacatgcgcaacaccatcatggcctccaagaccgtgggcaccgccgacgagaagctgcgcaagaagtccagcttctaccagagctacctccggcgcacgcagtccatggggatccagctggaccagcggatcatcgtgatgttcatggtggcctggggcaaggaggcggtggacaacttccacctgggcgacgacatggaccccgagctccgcagcctggcccagatcctgatcgaccagaaggtcaaggagatctccaaccaggagcccatgaagctctga

SEQ ID NO: 6610 - RNA, 1290 nt, synthetic construct
  misc_feature 1..1290: note = derived and/or modified CDS sequence (opt1) from SEOV(L99)__AF488708.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcaccctgcacgaccgggagtccgtggccgccagcatccagtccaagatcgacgagctgaagcgccagctcgccgaccggatcgcggccgggaagaacatcggccaggaccgcgaccccacgggggtggagcccggcgaccacctgaaggagcggagcgccctgtcctacgggaacaccctcgacctgaacagcctggacatcgacgagcccaccggccagaccgccgactggctcacgatcatcgtctacctgacctccttcgtggtgcccatcatcctgaaggcgctctacatgctgaccacccgcggccggcagacgagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacccccgggcggttccgcaccgccgtgtgcggcctctaccccgcccagatcaaggcgcggaacatggtcagcccggtgatgtccgtggtcgggttcctggccctggccaaggactggaccagccgcatcgaggagtggctcggcgccccctgcaagttcatggccgagtcccccatcgcgggcagcctgtccgggaaccccgtgaaccgggactacatccgccagcggcagggcgccctggccgggatggagccgaaggagttccaggccctccgccagcacgccaaggacgcgggctgcacgctggtggagcacatcgagagccccagctccatctgggtcttcgccggcgcccccgaccggtgcccgccgacctgcctgttcgtcgggggcatggccgagctcggggccttcttcagcatcctgcaggacatgcgcaacaccatcatggcgtccaagaccgtgggcacggccgacgagaagctgcgcaagaagtccagcttctaccagagctacctccggcgcacccagtccatggggatccagctggaccagcggatcatcgtgatgttcatggtggcctggggcaaggaggccgtggacaacttccacctgggcgacgacatggaccccgagctccgcagcctggcgcagatcctgatcgaccagaaggtcaaggagatctccaaccaggagcccatgaagctctga

SEQ ID NO: 6611 - RNA, 1290 nt, synthetic construct
  misc_feature 1..1290: note = derived and/or modified CDS sequence (opt1) from SEOV(R22)__AF488707.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcggcgccccctgcaagttcatggcggagtcccccatcgccggcagcctgtccgggaaccccgtgaaccgggactacatccgccagcggcagggcgccctggccgggatggagccgaaggagttccaggccctccgccagcacgcgaaggacgccggctgcaccctggtggagcacatcgagagccccagctccatctgggtcttcgccggcgcccccgaccggtgcccgcccacgtgcctgttcgtggggcgcatggccgagctcggcgcgttcttcagcatcctgcaggacatgaagaacaccatcatggcctccaagaccgtggggaccgccgacgagaagctgcgcaagaagtccagcttctaccagagctacctccggcgcacgcagtccatgggcatccagctggaccagcggatcatcgtcatgttcatggtggcctgggggaaggaggcggtggacaacttccacctgggcgacgacatggaccccgagctccgcagcctggcccagatcctgatcgaccagaaggtcaaggagatctccaaccaggagcccatgaagctctga

SEQ ID NO: 6612 - RNA, 1290 nt, synthetic construct
  misc_feature 1..1290: note = derived and/or modified CDS sequence (opt1) from SEOV(TURCKHEIM/Hu/FRA/2016/2016.00044)__KX064270.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggatcgccgccgggaagaacatcggccaggaccgcgacccgaccggggtggagcccggcgaccacctgaaggagcggagcgccctgtcctacgggaacacgctcgacctgaacagcctggacatcgacgagcccaccggccagaccgcggactggctcaccatcatcgtctacctgacgtccttcgtggtgcccatcatcctgaaggccctctacatgctgaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctctaccccgcgcagatcaaggcccggaacatggtcagcccggtgatgtccgtggtcgggttcctggccctggccaaggactggaccagccgcatcgaggagtggctcgacgccccctgcaagttcatcgcggagtcccccatcgccggcagcctgtccggcaaccccgtgaaccgggactacatccgccagcggcagggggccctggccggcatggagccgaaggagttccaggccctccgccagcacagcaaggacgcggggtgcaccctggtggagcacatcgagagcccctccagcatctgggtcttcgccggcgcccccgaccggtgcccgcccacgtgcctgttcgtgggcgggatggccgagctcggcgccttcttctccatcctgcaggacatgcgcaacaccatcatggcgagcaagaccgtggggaccgccgacgagaagctgcgcaagaagtccagcttctaccagtcctacctccggcgcacgcagagcatgggcatccagctggaccagcggatcatcgtcatgttcatggtggcctgggggaaggaggccgtggacaacttccacctgggcgacgacatggaccccgagctccgctccctggcgcagatcctgatcgaccagaaggtcaaggagatcagcaaccaggagcccatgaagctctga

SEQ ID NO: 6613 - RNA, 1290 nt, synthetic construct
  misc_feature 1..1290: note = derived and/or modified CDS sequence (opt1) from SEOV(Z37)__AF187082.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacttcaacaagcgcgccctccacgaccgggagtccgtggccgccagcatccagtccaagatcgacgagctgaagcgccagctggcggaccggatcgccgccgggaagaacatcggccaggaccgcgacccgaccggggtggagcccggcgaccacctcaaggagcggagcgccctgtcctacgggaacacgctggacctcaacagcctggacatcgacgagcccaccggccagaccgcggactggctgaccatcatcgtctacctcacgtccttcgtggtgcccatcatcctgaaggccctgtacatgctcaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctgtaccccgcgcagatcaaggcccggaacatggtcagcccggtgatgtccgtggtcgggttcctcgccctggccaaggactggaccagccgcatcgaggagtggctgggcgccccctgcaagttcatggcggagtcccccatcgccggcagcctctccgggaaccccgtgaaccgggactacatccgccagcggcagggcgccctggccgggatggagccgaaggagttccaggccctgcgccagcacgcgaaggacgccggctgcaccctcgtggagcacatcgagagccccagctccatctgggtcttcgccggcgcccccgaccggtgcccgcccacgtgcctgttcgtcgggggcatggccgagctgggggcgttcttcagcatcctccaggacatgcgcaacaccatcatggcctccaagaccgtgggcaccgccgacgagaagctgcgcaagaagtccagcttctaccagagctacctgcggcgcacgcagtccatggggatccagctcgaccagcggatcatcggcatgttcatggtggcctggggcaaggaggcggtggacaacttccacctgggggacgacatggaccccgagctgcgcagcctcgcccagatcctgatcgaccagaaggtgaaggagatctccaaccaggagcccatgaagctgtga

SEQ ID NO: 6614 - RNA, 1290 nt, synthetic construct
  misc_feature 1..1290: note = derived and/or modified CDS sequence (opt1) from SEOV(Tchoupitoulas (TCH))__AF329389.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacttctacaagcgcgccctccacgaccgggagtccgtggccgccagcatccagtccaagatcgacgagctgaagcgccagctggcggaccggatcgccgccgggaagaacatcggccaggaccgcgacccgaccggggtggagcccggcgaccacctcaaggagcggagcgccctgtcctacgggaacacgctggacctcaacagcctggacatcgacgagcccaccggccagaccgcggactggctgaccatcatcgtctacctcacgtccttcgtggtgcccatcatcctgaaggccctgtacatgctcaccacccgcggccggcagaccagcaaggacaacaaggggatgcgcatccggttcaaggacgactccagctacgaggacgtcaacggcatccgcaagccgaagcacctgtacgtgtccatgcccaacgcccagagctccatgaaggccgaggagatcacgcccgggcggttccgcaccgccgtgtgcggcctgtaccccgcgcagatcaaggcccggaacatggtcagcccggtgatgtccgtggtcgggttcctcgccctggccaaggactggaccagccgcatcgaggagtggctgggcgccccctgcaagttcatggcggagtcccccatcgccggcagcctctccgggaaccccgtgaaccgggactacatccgccagcggcagggcgccctggccgggatggagccgaaggagttccaggccctgcgccagcacagcaaggacgcgggctgcaccctcgtggagcacatcgagagcccctccagcatctgggtcttcgccggcgcccccgaccggtgcccgcccacgtgcctgttcgtcgggggcatggccgagctgggggccttcttctccatcctccaggacatgcgcaacaccatcatggcgagcaagaccgtgggcaccgccgacgagaagctgcgcaagaagtccagcttctaccagtcctacctgcggcgcacgcagagcatggggatccagctcgaccagcggatcatcgtgatgttcatggtggcctggggcaaggaggccgtggacaacttccacctgggcgacgacatggaccccgagctgcgctccctcgcgcagatcctgatcgaccagaaggtcaaggagatcagcaaccaggagcccatgaagctgtga

SEQ ID NO: 6615 - RNA, 1290 nt, synthetic construct
  misc_feature 1..1290: note = derived and/or modified CDS sequence (opt1) from SEOV__M34881.1__N
  source 1..1290: mol_type = other RNA
atggccaccatggaggagatccagcgcgagatcagcgcccacgagggccagctggtgatcgcgcggcagaaggtcaaggacgccgagaagcagtacgagaaggaccccgacgacctcaacaagcgcgccctgcacgaccgggagtccgtggccgccagcatccagtccaagatcgacgagctgaagcgccagctcgcggaccggctgcagcaggggcgcaccagcggccaggaccgggaccccacgggggtggagcccggcgaccacctgaaggagcgctccgccctcagctacgggaacaccctggacctgaactccctcgacatcgacgagcccaccggccagaccgccgactggctgacgatcatcgtctacctgaccagcttcgtggtgcccatcatcctcaaggccctgtacatgctgaccacccggggccgccagacgtccaaggacaacaaggggatgcggatccgcttcaaggacgacagctcctacgaggacgtcaacggcatccggaagccgaagcacctctacgtgagcatgcccaacgcgcagtccagcatgaaggccgaggagatcacccccgggcgcttccggaccgccgtgtgcggcctgtaccccgcccagatcaaggcccgcaacatggtctccccggtgatgagcgtggtcgggttcctggcgctcgccaaggactggacctcccggatcgaggagtggctgggcgccccctgcaagttcatggccgagagcctgatcgccggctccctcagcgggaaccccgtgaaccgcgactacatccggcagcgccagggcgcgctggccgggatggagcccaaggagttccaggccctgcggcagcacagcaaggacgccggctgcacgctcgtggagcacatcgagtccccgagctccatctgggtcttcgccggcgcgcccgaccgctgcccgccgacctgcctgttcgtcgggggcatggccgagctgggggccttcttcagcatcctccaggacatgcgcaacaccatcatggcctccaagaccgtgggcacggccgacgagaagctgcggaagaagtccagcttctaccagagctacctgcgccggacccagtccatggggatccagctcgaccagcgcatcatcgtgatgttcatggtggcgtggggcaaggaggccgtggacaacttccacctgggcgacgacatggaccccgagctgcggagcctcgcccagatcctgatcgaccagaaggtcaaggagatctccaaccaggagcccatgaagctgtga

SEQ ID NO: 6616 - RNA, 1287 nt, synthetic construct
  misc_feature 1..1287: note = derived and/or modified CDS sequence (opt1) from SNV(H10)__NC_005216.1__N
  source 1..1287: mol_type = other RNA
atgagcaccctgaaggaggtgcaggacaacatcaccctccacgagcagcagctggtcacggcccgccagaagctgaaggacgccgagcgggcggtggagctcgaccccgacgacgtgaacaagtccaccctgcagagccgccgggccgccgtctccgccctggagaccaagctcggcgagctgaagcgcgagctggccgacctcatcgcggcccagaagctggccagcaagccggtggaccccaccgggatcgagcccgacgaccacctgaaggagaagtccagcctccggtacggcaacgtgctggacgtcaactccatcgacctggaggagcccagcgggcagacggccgactggaagtccatcggcctctacatcctgagcttcgcgctgccgatcatcctcaaggccctgtacatgctgtccacccgcgggcggcagaccatcaaggagaacaagggcacccgcatccggttcaaggacgacagctcctacgaggaggtgaacggcatccgcaagccccggcacctctacgtgagcatgcccacggcccagtccaccatgaaggccgacgagatcacccccgggcgcttccggaccatcgcctgcggcctgttcccggcgcaggtcaaggcccgcaacatcatcagccccgtgatgggggtgatcggcttctccttcttcgtcaaggactggatggagcggatcgacgacttcctggccgcccgctgccccttcctccccgagcagaaggacccgcgggacgccgcgctggccacgaaccgcgcctacttcatcacccggcagctccaggtggacgagagcaaggtgtccgacatcgaggacctgatcgccgacgcccgcgcggagagcgccaccatcttcgccgacatcgccacgccccacagcgtctgggtgttcgcctgcgcgcccgaccggtgcccgcccaccgccctgtacgtggccgggatgcccgagctgggcgccttcttcgcgatcctccaggacatgcgcaacaccatcatggcctccaagagcgtcggcacctccgaggagaagctgaagaagaagtccgccttctaccagagctacctgcgccggacccagagcatggggatccagctcgaccagaagatcatcatcctgtacatgtcccactggggccgcgaggccgtgaaccacttccacctgggggacgacatggaccccgagctccgggagctggcccagacgctggtggacatcaaggtccgcgagatcagcaaccaggagcccctcaagctgtga

SEQ ID NO: 6617 - RNA, 1287 nt, synthetic construct
  misc_feature 1..1287: note = derived and/or modified CDS sequence (opt1) from SNV(2)__JQ690282.1__N
  source 1..1287: mol_type = other RNA
atgagcaccctgaaggaggtgcaggacaacatcaccctccacgagcagcagctggtcacggcccgccagaagctgaaggacgccgagcgggcggtggagctcgaccccgacgacgtgaacaagtccaccctgcagagccgccgggccgccgtctccgccctggagaccaagctcggcgagctgaagcgcgagctggccgacctcatcgcggcccagaagctggccagcaagccggtggaccccaccgggatcgagcccgacgaccacctgaaggagaagtccagcctccggtacggcaacgtgctggacgtcaactccatcgacctggaggagcccagcgggcagacggccgactggaagtccatcggcctctacatcctgagcttcgcgctgccgatcatcctcaaggccctgtacatgctgtccacccgcgggcggcagaccatcaaggagaacaagggcacccgcatccggttcaaggacgacagctcctacgaggaggtgaacggcatccgcaagccccggcacctctacgtgagcatgcccacggcccagtccaccatgaaggccgacgagatcacccccgggcgcttccggaccatcgcctgcggcctgttcccggcgcaggtcaaggcccgcaacatcatcagccccgtgatgggggtgatcggcttctccttcttcgtcaaggactggatggagcggatcgacgacttcctggccgcccgctgccccttcctccccgagcagaaggacccgcgggacgccgcgctggccacgaaccgcgcctacttcatcacccggcagatgcaggtcgacgagagcaaggtgtccgacatcgaggacctgatcgccgacgcccgcgcggagagcgccaccatcttcgccgacatcgccacgccccacagcgtgtgggtgttcgcctgcgcgcccgaccggtgcccgcccaccgccctctacgtggccgggatgcccgagctgggcgccttcttcgcgatcctgcaggacatgcgcaacaccatcatggcctccaagagcgtcggcacctccgaggagaagctcaagaagaagtccgccttctaccagagctacctgcgccggacccagagcatggggatccagctggaccagaagatcatcatcctctacatgtcccactggggccgcgaggccgtgaaccacttccacctgggggacgacatggaccccgagctgcgggagctcgcccagacgctggtggacatcaaggtccgcgagatcagcaaccaggagcccctgaagctctga

SEQ ID NO: 6618 - RNA, 1287 nt, synthetic construct
  misc_feature 1..1287: note = derived and/or modified CDS sequence (opt1) from SNV(3)__JQ690278.1__N
  source 1..1287: mol_type = other RNA
atgagcaccctgaaggaggtgcaggacaacatcaccctccacgagcagcagctggtcacggcccgccagaagctgaaggacgccgagcgggcggtggagctcgaccccgacgacgtgaacaagtccaccctgcagagccgccgggccgccgtctccgccctggagaccaagctcggcgagctgaagcgcgagctggccgacctcatcgcggcccagaagctggccagcaagccggtggaccccaccgggatcgagcccgacgaccacctgaaggagaagtccagcctccggtacggcaacgtgctggacgtcaactccatcgacctggaggagcccagcgggcagacggccgactggaagtccatcggcctctacatcctgagcttcgcgctgccgatcatcctcaaggccctgtacatgctgtccacccgcgggcggcagaccatcaaggagaacaagggcacccgcatccggttcaaggacgacagctcctacgaggaggtgaacggcatccgcaagccccggcacctctacgtgagcatgcccacggcccagtccaccatgaaggccgacgagatcacccccgggcgcttccggaccatcgcctgcggcctgttcccggcgcaggtcaaggcccgcaacatcatcagccccgtgatgggggtgatcggcttctccttcttcgtcaaggactggatggagcggatcgacgacttcctggccgcccgctgccccttcctccccgagcagaaggacccgcgggacgccgcgctggccacgaaccgcgcctacttcatcacccggcagctccaggtggacgagagcaaggtgtccgacatcgaggacctgatcgccgacgcccgcgcggagagcgccaccatcttcgccgacatcgccacgccccacagcgtctgggtgttcgcctgcgcgcccgaccggtgcccgcccaccgccctgtacgtggccgggatgcccgagctgggcgccttcttcgcgatcctccaggacatgcgcaacaccatcatggcctccaagagcgtcggcacctccgaggagaagctgaagaagaagtccgccttctaccagagctacctgcgccggacccagagcatggggatccagcccgaccagaagatcatcatcctctacatgtcccactggggccgcgaggccgtgaaccacttccacctgggggacgacatggaccccgagctgcgggagctcgcccagacgctggtggacatcaaggtccgcgagatcagcaaccaggagccgctgaagctctga

SEQ ID NO: 6619 - RNA, 1287 nt, synthetic construct
  misc_feature 1..1287: note = derived and/or modified CDS sequence (opt1) from SNV(CC107/POR)__KT885046.1__N
  source 1..1287: mol_type = other RNA
atgagcaccctgaaggaggtgcaggacaacatcaccctccacgagcagcagctggtcacgacccgccagaagctgaaggacgccgagcgggccgtggagctcgaccccgacgacgtgaacaagtccaccctgcagagccgccgggcggccgtctccgccctggagaccaagctcggcgagctgaagcgcgagctggccgacctcatcgccgcgcagaagctggccagcaagccggtggaccccacggggatcgagcccgacgaccacctgaaggagaagtccagcctccggtacggcaacgtgctggacgtcaactccatcgacctggaggagcccagcgggcagaccgccgactggaagtccatcggcctctacatcctgagcttcgccctgccgatcatcctcaaggcgctgtacatgctgtccacccgcgggcggcagaccatcaaggagaacaagggcacgcgcatccggttcaaggacgacagctcctacgaggaggtgaacggcatccgcaagccccggcacctctacgtgagcatgcccaccgcccagtccaccatgaaggccgacgagatcacccccgggcgcttccggacgatcgcctgcggcctgttcccggcccaggtcaaggcgcgcaacatcatcagccccgtgatgggggtgatcggcttctccttcttcgtcaaggactggatggagcggatcgacgagttcctggccgcccgctgccccttcctccccgagcagaaggacccgcgggacgccgccctggcgaccaaccgcgcctacttcatcacccggcagatgcaggtcgacgagagcaaggtgtccgacatcgaggacctgatcgccgacgcccgcgccgagagcgcgaccatcttcgccgacatcgccacgccccacagcgtgtgggtgttcgcctgcgcccccgaccggtgcccgcccaccgcgctctacgtggccgggatgcccgagctgggcgccttcttcgccatcctgcaggacatgcgcaacaccatcatggcgtccaagagcgtcggcacctccgaggagaagctcaagaagaagtccgccttctaccagagctacctgcgccggacgcagagcatggggatccagctggaccagaagatcatcatcctctacatgtcccactggggccgcgaggccgtgaaccacttccacctgggggacgacatggaccccgagctgcgggagctcgcccagaccctggtggacatcaaggtccgcgagatcagcaaccaggagcccctgaagctctga

SEQ ID NO: 6620 - RNA, 1287 nt, synthetic construct
  misc_feature 1..1287: note = derived and/or modified CDS sequence (opt1) from HPS(Convict Creek 107)__L33683.1__N
  source 1..1287: mol_type = other RNA
atgagcaccctgaaggaggtgcaggacaacatcaccctccacgagcagcagctggtcacgacccgccagaagctgaaggacgccgagcgggccgtggagctcgaccccgacgacgtgaacaagtccaccctgcagagccgccgggcggccgtctccgccctggagaccaagctcggcgagctgaagcgcgagctggccgacctcatcgccgcgcagaagctggccagcaagccggtggaccccacggggatcgagcccgacgaccacctgaaggagaagtccagcctccggtacggcaacgtgctggacgtcaactccatcgacctggaggagcccagcgggcagaccgccgactggaagtccatcggcctctacatcctgagcttcgccctgccgatcatcctcaaggcgctgtacatgctgtccacccgcgggcggcagaccatcaaggagaacaagggcacgcgcatccggttcaaggacgacagctcctacgaggaggtgaacggcatccgcaagccccggcacctctacgtgagcatgcccaccgcccagtccaccatgaaggccgacgagatcacccccgggcgcttccggacgatcgcctgcggcctgttcccggcccaggtcaaggcgcgcaacatcatcagccccgtgatgggggtgatcggcttctccttcttcgtcaaggactggatggagcggatcgacgagttcctggccgcccgctgccccttcctccccgagcagaaggacccgcgggacgccgccctggcgaccaaccgcgcctacttcatcacccggcagatgcaggtcgacgagagcaaggtgtccgacatcgaggacctgatcgccgacgcccgcgccgagagcgcgaccatcttcgccgacatcgccacgccccacagcgtgtgggtgttcgcctgcgcccccgaccggtgcccgcccaccgcgctctacgtggccgggatgcccgagctgggcgccttcttcggcatcctgcaggacatgcgcaacaccatcatggcctccaagagcgtcgggacctccgaggagaagctcaagaagaagtccgcgttctaccagagctacctgcgccggacgcagagcatgggcatccagctggaccagaagatcatcatcctctacatgtcccactgggggcgcgaggccgtgaaccacttccacctgggcgacgacatggaccccgagctgcgggagctcgcccagaccctggtggacatcaaggtccgcgagatcagcaaccaggagcccctgaagctctga

SEQ ID NO: 6621 - RNA, 1287 nt, synthetic construct
  misc_feature 1..1287: note = derived and/or modified CDS sequence (opt1) from HPS(Convict Creek 74)__L33816.1__N
  source 1..1287: mol_type = other RNA
atgagcaccctgaaggaggtgcaggacaacatcaccctccacgagcagcagctggtcacgtcccgccagaagctgaaggacgccgagcgggccgtggagctcgaccccgacgacgtgaacaagagcaccctgcagtcccgccgggcggccgtcagcgccctggagaccaagctcggcgagctgaagcgcgagctggccgaccacatcgccgcgcagaagctcgcctccaagccggtggaccccaccgggatcgagcccgacgaccacctgaaggagaagtccagcctgcggtacggcaacgtgctcgacgtcaacagcatcgacctggaggagcccaacgggcagacggccgactggaagtccatcggcctgtacatcctcagcttcgccctgccgatcatcctgaaggcgctctacatgctgtccacccgcgggcggcagaccatcaaggagaacaagggcacccgcatccggttcaaggacgacagctcctacgaggaggtgaacggcatccgcaagccccggcacctgtacgtgagcatgcccacggcccagtccaccatgaaggccgacgagatcacccccgggcgcttccggaccatcgcctgcggcctcttcccggcccaggtcaaggcgcgcaacatcatcagccccgtgatgggggtgatcggcttctccttcttcgtcaaggactggatggagcggatcgacgagttcctggccgcccgctgccccttcctgcccgagcagaaggacccgcgggacgccgccctcgcgacgaaccgcgcctacttcatcacccggcagctccaggtggacgagagcaaggtgtccgacatcgaggacctgatcgccgacgcccgcgccgagagcgcgaccatcttcgccgacatcgccacgccccacagcgtctgggtgttcgcctgcgcccccgaccggtgcccgcccaccgcgctgtacgtggccgggatgcccgagctgggcgccttcttcggcatcctgcaggacatgcgcaacaccatcatggcctccaagagcgtcgggacctccgaggagaagctcaagaagaagtccgcgttctaccagagctacctgcgccggacccagagcatgggcatccagctggaccagaagatcatcatcctctacatgtcccactgggggcgcgaggccgtgaaccacttccacctgggcgacgacatggaccccgagctgcgggagctcgcccagacgctggtggacatcaaggtccgcgagatcagcaaccaggagcccctgaagctctga

SEQ ID NO: 6622 - RNA, 1287 nt, synthetic construct
  misc_feature 1..1287: note = derived and/or modified CDS sequence (opt1) from HPS(H-NY1)__U47135.1__N
  source 1..1287: mol_type = other RNA
atgagcaccctgaaggaggtgcaggacaacatcaccctccacgagcagcagctggtcacggcccgccagaagctgaaggacgccgagaaggcggtggaggtggaccccgacgacgtcaacaagtccaccctccagggccggcgcgccgccgtgagcgccctggagaccaagctgggggagctcaagcggcagctggccgacctgatcgcggcccagaagctcgcctccaagccgatcgaccccaccggcatcgagcccgacgaccacctgaaggagaagtccagcctgcgctacgggaacgtgctcgacgtcaacagcatcgacctggaggagccctccggccagacggccgactggaaggcgatcgggatgtacatcctgagcttcgccatcccgatcatcctcaaggccctgtacatgctgtccacccggggccgccagaccgtgaaggagaacaagggcacccggatccgcttcaaggacgacagctcctacgaggaggtgaacgggatccggaagccccgccacctctacgtcagcatgcccacggcccagtccaccatgaaggccgacgagatcacccccggccggttccgcaccatcgcgtgcgggctgttcccggcccaggtgaaggcccggaacatcatcagccccgtgatgggcgtcatcgggttcaacttcttcgtgaaggactggatggaccgcatcgacgacttcctggccgagcggtgccccttcctccccgagccgcgcgaccccaaggacgccgcgctgggcacgaaccgggcctacttcatcacccgccaggcccaggtggacgagtccaaggtcgtggacatcgaggagctgatcgtggacgcccgggccgagagcgcgaccctcttcaccgacatcgccacgccccactccgtctgggtgttcgcctgcgcccccgaccgctgcccgcccaccgccctgtacgtggcgggcatgcccgagctgggggccttcttcgccatcctccaggacatgcggaacaccatcatggccagcaagtccgtcggcaccgcggaggagaagctgaagaagaagtccgccttctaccagagctacctgcgccgcacgcagagcatggggatccagctcgaccagaagatcatcatcctgtacatgatccactggggcaaggaggccgtgaaccacttccacctgggcgacgacatggaccccgagctccgggagctggcccaggccctggtggacgcgaaggtcaaggagatcagcaaccaggagccgctcaagctgtga

SEQ ID NO: 6623 - RNA, 1290 nt, synthetic construct
  misc_feature 1..1290: note = derived and/or modified CDS sequence (opt1) from THAIV(Nakhon Ratchasima/Bi0017/2004)__AM397664.1__N
  source 1..1290: mol_type = other RNA
atggccaccatggaggagctgcagcgcgagatcaacgcccacgagggccagctcgtggtcgcgcggcagaaggtgaaggacgccgagaagcagtacgagaaggaccccgacgacctgaaccgccgggccctgcacgaccgcgagagcgtggccgcctccatccagagcaagatcgacgagctcaagcggcagctggcggaccgcatcgcctccgggcggaccatcggccaggaccgcgacccgacgggggtcgagcccggcgaccacctccgggagcgcagcatgctgtcctacgggaacgtgctggacctgaacaacctcgacatcgaggagcccaccggccagaccgccgactggctgaccatcatcgtgtacctgacgagcttcgtcatccccatcatcctcaaggccctgtacatgctgaccacccggggccgccagaccacgaaggacaacaaggggatgcggatccgcttcaaggacgactccagctacgaggacgtgaacggcatccggaagccgaagcacctctacatctccatgcccaacgcgcagagctccatgaaggccgaggagatcacccccgggcgcttccggaccgccgtgtgcggcctgtaccccgcccaggtcaaggcccgcaacatggtgagcccggtgatgtccgtcatcgggttcatggcgctggccaaggactggaccgaccggatccaggactggctcggcgccccctgcaagttcctgcccgacctgagcacgcagtccctccacgccagcccgcccaccaacgccgactacatcgcgcagcgccagggcctgctggccgggatggagaccaaggagtccaagggcatccgggaccacgcccgcgacgccgggtgcaccctcgtggaccacctggacagcccctccagcatctgggtgttcgccggcgcgcccgaccgctgcccgcccacgtgcctgttcatcgccggcatggccgagctcggggccttcttcagcatcctgcaggacatgcggaacaccatcatggcctccaagaccgtcggcaccagcgaggagaagctgaagaagaagtccagcttctaccagtcctacctccgccggacgcagagcatggggatccagctggaccagcgcatcatcgtgatgttcatggtggcgtggggcaaggaggccgtcgacaacttccacctgggggacgacatggaccccgagctccggaacctggcccagctgctcatcgaccagaaggtgaaggagatctccaaccaggagcccctgaagctgtga

SEQ ID NO: 6624 - RNA, 1290 nt, synthetic construct
  misc_feature 1..1290: note = derived and/or modified CDS sequence (opt1) from TULV(Tula/Moravia/5302Ma/94)__NC_005227.2__N
  source 1..1290: mol_type = other RNA
atgagccagctgaaggagatccaggaggagatcacccgccacgagcagcagatcgtgatcgcccggcagaagctcaaggacgccgagaagaccgtcgaggcggaccccgacgacgtgaacaagtccacgctgcagagccgccgggccgccgtgtccgccctggaggacaagctcgccgacttcaagcgccagctggcggacctggtcagctcccagaagatgggcgagaagccggtggaccccaccgggctcgagcccgacgaccacctgaaggagcggagctccctgcgctacggcaacgtgctcgacgtcaacgccatcgacatcgacgagcccagcgggcagaccgccgactggttctccatcggccagtacatcaccgggttcgccctggcgatcatcctgaaggccctctacatgctgagcacgcggggccgccagaccatcaaggagaacaagggcacccggatccgcttcaaggacgactccagctacgaggagatcaacgggatccggcgcccgaagcacctgtacgtgtccatgcccaccgcccagagcacgatgaaggccgacgagctcacccccggccggttccgcaccatcgtgtgcgggctgttccccgcccagatcatgcaccggaacatcatctccccggtcatgggcgtgatcgggttcagcttcttcgtgaaggactggcccgagaagatcgaggagttcctgatcaagccctgccccttcctcaagaagtccggcccgagcaaggaggaggacttcctggtctccaacgacgcgtacctgctcggccgcgagaaggccctgcgggagagccacctggccgagatcgacgacctcatcgacctggccgccagcggggaccccaccccgcccgactccatcaagagcccccaggcgccctgggtgttcgcctgccgccccgaccggtgcccgcccacgtgcatctacatcgccggcatggccgagctgggggccttcttctccatcctccaggacatgcgcaacaccatcatggcgagcaagaccgtgggcaccgccgaggagaagctgaagaagaagtccagcttctaccagtcctacctgcggcgcacgcagagcatgggcatccagctcgaccagcgcatcatcctgctgttcatgaccgagtgggggtccgacatcgtcaaccacttccacctcggcgacgacatggaccccgagctgcggaccctggcccagagcctcatcgaccagaaggtgaaggagatctccaaccaggagcccctgaagatctga

SEQ ID NO: 6625 - RNA, 1293 nt, synthetic construct
  misc_feature 1..1293: note = derived and/or modified CDS sequence (opt1) from TULV(D17-98)__AF289820.1__N
  source 1..1293: mol_type = other RNA
atgagccagctgaaggagatccaggaggagatcacccgccacgagcagcagatcgtgatcgcccggcagaagctcaaggacgccgagaagaccgtcgaggcggaccccgacgacgtgaacaagtccacgctgcagagccgccgggccgccgtgtccgccctggaggacaagctcgccgacttcaagcgccagctggcggacctggtcagctcccagaagatgggcgagaagcccgtggaccccaccgggctcgagcccgacgaccacctgaaggagcggagctccctgcgctacggcaacgtgctcgacgtcaacgccatcgacatcgacgagcccagcgggcagaccgccgactggttctccatcggccagtacatcatcgggttcgccctggcgatcgtgctgaaggccctctacatgctgagcacccggggccgccagacgatcaaggagaacaagggcacccggatccgcttcaaggacgactccagctacgaggagatcaacgggatccggcgcccgaagcacctgtacgtgtccatgcccaccgcccagagcaccatgaaggccgacgagctcacgcccggccggttccgcaccatcgtctgcgggctgttccccgcccagatcatgcaccggaacatcatctccccggtgatgggcgtgatcgggttcagcttcttcgtcaaggactggcccgacaagatcgaggagttcctgatcaagccctgccccttcctcaagaagcagggcggcccgaacaaggacgaggagttcctggtgtcctacgacgcgtacctgctcgggcgcgagaaggccctgcgggagagccacctggccgagatcgacgacctcatcgacctggccgcctccggcgaccccaccccgcccgacagcatcaagagcccccaggggccctgggtgttcgcgtgcgcccccgaccgctgcccgccgacctgcatctacgtcgccggcatggccgagctgggcgccttcttctccatcctccaggacatgcggaacacgatcatggcgagcaagaccgtggggaccgccgaggagaagctgaagaagaagtccagcttctaccagtcctacctgcgccggacccagagcatgggcatccagctcgaccagcgcatcatcctgctgttcatgatggagtgggggtccgacatcgtgaaccacttccacctcggcgacgacatggaccccgagctgcgcacgctggcccagagcctcatcgaccagaaggtcaaggagatctccaaccaggagcccctgaagatctga

SEQ ID NO: 6626 - RNA, 1293 nt, synthetic construct
  misc_feature 1..1293: note = derived and/or modified CDS sequence (opt1) from TULV(D5-98)__AF289819.1__N
  source 1..1293: mol_type = other RNA
atgagccagctgaaggagatccaggaggagatcacccgccacgagcagcagatcgtgatcgcccggcagaagctcaaggacgccgagaagaccgtcgaggcggaccccgacgacgtgaacaagtccacgctgcagagccgccgggccgccgtgtccgccctggaggacaagctcgccgacttcaagcgccagctggcggacctggtcagctcccagaagatgggcgagaagcccgtggaccccaccgggctcgagcccgacgaccacctgaaggagcggagctccctgcgctacggcaacgtgctcgacgtcaacgccatcgacatcgacgagcccagcgggcagaccgccgactggttctccatcggccagtacatcatcgggttcgccctggcgatcgtgctgaaggccctctacatgctgagcacccggggccgccagacgatcaaggagaacaagggcacccggatccgcttcaaggacgactccagctacgaggagatcaacgggatccggcgcccgaagcacctgtacgtgtccatgcccaccgcccagagcaccatgaaggccgacgagctcacgcccggccggttccgcaccatcgtctgcgggctgttccccgcccagatcatgcaccggaacatcatctccccggtgatgggcgtgatcgggttcagcttcttcgtcaaggactggcccgacaagatcgaggagttcctgatcaagccctgccccttcctcaagaagcagggcggcccgaacaaggacgaggagttcctggtgtcctacgacgcgtacctgctcgggcgcgagaaggccctgcgggagagccacctggccgagatcgacgacctcatcgacctggccgcctccggcgaccccaccccgcccgacagcatcaagagcccccaggcgccctgggtgttcgcctgcgcccccgaccgctgcccgccgacctgcatctacgtcgccgggatggccgagctgggcgcgttcttctccatcctccaggacatgcggaacacgatcatggccagcaagaccgtgggcaccgccgaggagaagctgaagaagaagtccagcttctaccagtcctacctgcgccggacccagagcatggggatccagctcgaccagcgcatcatcctgctgttcatgatggagtggggctccgacatcgtgaaccacttccacctcggggacgacatggaccccgagctgcgcacgctggcccagagcctcatcgaccagaaggtcaaggagatctccaaccaggagcccctgaagatctga

SEQ ID NO: 6627 - RNA, 1293 nt, synthetic construct
  misc_feature 1..1293: note = derived and/or modified CDS sequence (opt1) from TULV(D63-98)__AF289821.1__N
  source 1..1293: mol_type = other RNA
atgagccagctgaaggagatccaggaggagatcacccgccacgagcagcagatcgtgatcgcccggcagaagctcaaggacgccgagaagaccgtcgaggcggaccccgacgacgtgaacaagtccacgctgcagagccgccgggccgccgtgtccgccctggaggacaagctcgccgacttcaagcgccagctggcggacctggtcagctcccagaagatgggcgagaagcccgtggaccccaccgggctcgagcccgacgaccacctgaaggagcggagctccctgcgctacggcaacgtgctcgacgtcaacgccatcgacatcgacgagcccagcgggcagaccgccgactggttctccatcggccagtacatcatcgggttcgccctggcgatcgtgctgaaggccctctacatgctgagcacccggggccgccagacgatcaaggagaacaagggcacccggatccgcttcaaggacgactccagctacgaggagatcaacgggatccggcgcccgaagcacctgtacgtgtccatgcccaccgcccagagcaccatgaaggccgacgagctcacgcccggccggttccgcaccatcgtctgcgggctgttccccgcccagatcatgcaccggaacatcatctccccggtgatgggcgtgatcgggttcagcttcttcgtcaaggactggcccgacaagaaggaggagttcctgatcaagccctgccccttcctcaagaagcagggcggcccgaacaaggacgaggagttcctggtgtccaacgacgcgtacctgctcgggcgcgagaaggccctgcgggagagccacctggccgagatcgacgacctcatcgacctggccgcctccggcgaccccaccccgcccgacagcatcaagagcccccaggggccctgggtgttcgcgtgcgcccccgaccgctgcccgccgacctgcatctacgtcgccggcatggccgagctgggcgccttcttctccatcctccaggacatgcggaacacgatcatggcgagcaagaccgtggggaccgccgaggagaagctgaagaagaagtccagcttctaccagtcctacctgcgccggacccagagcatgggcatccagctcgaccagcgcatcatcctgctgttcatgatggagtgggggtccgacatcgtgaaccacttccacctcggcgacgacatggaccccgagctgcgcacgctggcccagagcctcatcgaccagaaggtcaaggagatctccaaccaggagcccctgaagatctga

SEQ ID NO: 6628 - RNA, 1290 nt, synthetic construct
  misc_feature 1..1290: note = derived and/or modified CDS sequence (opt1) from TULV(MG23/Omsk)__AF442621.1__N
  source 1..1290: mol_type = other RNA
atgagcaccctgaaggagatccaggaggagatcacccgccacgagcagcagatcgtgatcgcccggcagaagctcaaggacgccgagaagacggtcgaggcggaccccgacgacgtgaacaagaacaccctgcagtcccgccgggccgccgtgagcaccctggaggacaagctcgccgagttcaagcgccagctggccgacctggtctccagccagaagatgggcgagaagcccgtggaccccaccgggctcgagcccgacgaccacctgaaggagcggtccagcctgcgctacggcaacgtgctcgacgtcaacgcgacggacatcgacgagccctccgggcagaccgccgactggttcagcatcggccagtacatcatggggttcgccctggccatcgtgctgaaggcgctctacatgctgtccacccggggccgccagaccatcaaggagaacaagggcacgcggatcaagttcaaggacgacagctccatcgaggagatcaacgggatccgccggccgaagcacctgtacgtgagcatgcccaccgcccagtccaccatgaaggccgacgagctcacccccggccgcttccggacgatcgtctgcgggctgttccccgcccagatcatgcaccgcaacatcatcagcccggtgatgggcgtgatcgggttctccttcttcgtcaaggactggcccgacaagatcgaggagttcctgatcaagccctgccccttcctcaagaagcagggcagcaccaaggaggaggagttcctggtgtccaacgacgcctacatgctgggccgggagaaggcgctccgcgagagccacctggccgagatcgacgagctgatcgacctcgccgactccggggacccgaccccgcccgacagcatcaagagcccccaggccccctgggtgttcgcctgcgcgcccgaccggtgcccgccgacctgcatctacatcgccggcatggccgagctgggggccttcttctccatcctgcaggacatgcgcaacacgatcatggccagcaagaccgtcggcaccgcggaggagaagctcaagaagaagtccagcttctaccagtcctacctgcggcgcacccagagcatgggcatccagctggaccagcggatcatcctcctgttcatgatggagtgggggtccgacatcgtgaaccacttccacctgggcgacgacatggaccccgagctccgcacgctggcccagagcctgatcgaccagaaggtgaaggagatctccaaccaggagcccctcaagatctga

SEQ ID NO: 6629 - RNA, 1290 nt, synthetic construct
  misc_feature 1..1290: note = derived and/or modified CDS sequence (opt1) from TULV(c109-s)__AF164094.1__N
  source 1..1290: mol_type = other RNA
atgagccagctgaaggagatccaggaggagatcacccgccacgagcagcagatcgtgatcgcccggcagaagctcaaggacgccgagaagaccgtcgaggcggaccccgacgacgtgaacaagtccacgctgcagagccgccgggccgccgtgtccgccctggaggacaagctcgccgacttcaagcgccagctggcggacctggtcagctcccagaagatgggcgagaagccggtggaccccaccgggctcgagcccgacgaccacctgaaggagcggagctccctgcgctacggcaacgtgctcgacgtcaacgccatcgacatcgacgagcccagcgggcagaccgccgactggttctccatcggccagtacatcaccgggttcgccctggcgatcatcctgaaggccctctacatgctgagcacgcggggccgccagaccatcaaggagaacaagggcacccggatccgcttcaaggacgactccagctacgaggagatcaacgggatccggcgcccgaagcacctgtacgtgtccatgcccaccgcccagagcacgatgaaggccgacgagctcacccccggccggttccgcaccatcgtgtgcgggctgttccccgcccagatcatgcaccggaacatcatctccccggtcatgggcgtgatcgggttcagcttcttcgtgaaggactggcccgagaagatcgaggagttcctgatcaagccctgccccttcctcaagaagtccggcccgagcaaggaggaggacttcctggtctccaacgacgcgtacctgctcggccgcgagaaggccctgcgggagagccacctggccgagatcgacgacctcatcgacctggccgccagcggggaccccaccccgcccgactccatcaagagcccccaggcgccctgggtgttcgcctgcgcccccgaccgctgcccgcccacgtgcatctacatcgccggcatggccgagctgggggcgttcttctccatcctccaggacatgcggaacaccatcatggccagcaagaccgtgggcacctccgaggagaagctgaagaagaagtccagcttctaccagagctacctgcgccggacgcagtccatgggcatccagctcgaccagcgcatcatcctgctgttcatgaccgagtgggggagcgacatcgtcaaccacttccacctcggcgacgacatggaccccgagctgcgcaccctggcccagtccctcatcgaccagaaggtgaaggagatcagcaaccaggagcccctgaagatctga

SEQ ID NO: 6630 - RNA, 1290 nt, synthetic construct
  misc_feature 1..1290: note = derived and/or modified CDS sequence (opt1) from TULV(CHEVRU/Hu/FRA/2015/15.00453)__KT946591.1__N
  source 1..1290: mol_type = other RNA
atgagccagctgaaggagatccaggaggagatcacccgccacgagcagcagatcgtgatcgcccggcagaagctcaaggacgccgagaagaccgtcgaggcggaccccgacgacgtgaacaagtccacgctgcagagccgccaggccgccgtgtccgccctggaggacaagctcgccgacttcaagcggaagctggcggacctggtcagctcccagaagatgggcgagaagcccgtggaccccaccgggctcgagcccgacgaccacctgaaggagcgcagctccctgcggtacggcaacgtgctcgacgtcaacgccatcgacatcgacgagcccagcgggcagaccgccgactggttctccatcggccagtacgtgatggggttcgccctggcgatcatcctgaaggccctctacatgctgagcacccgcggccggcagacgatcaaggagaacaagggcacccgcatccggttcaaggacgactccagctacgaggagatcaacgggatccgccggccgaagcacctgtacgtgtccatgcccaccgcccagagcaccatgaaggccgacgagctcacgcccggccgcttccggaccatcgtctgcgggctgttccccgcccagatcatgcaccgcaacatcatctccccggtgatgggcgtgatcgggttcagcttcttcgtcaaggactggcccgagaagatcgaggagttcctgatcaagccctgccccttcctcaagaagtccggcccgagcaaggaggaggacttcctggtgtccaacgacgcgtacctgctcggccgggagaaggccctgcgcgacagccacctggccgagatcgacgacctcatcgacctggccgagagcggggaccccaccccgcccgactccatcaagagcccccaggccccctgggtgttcgcgtgcgcccccgaccggtgcccgccgacctgcatctacatcgccggcatggccgagctgggggccttcttctccatcctccaggacatgcgcaacacgatcatggcgagcaagaccgtcggcaccgccgaggagaagctgaagaagaagtccagcttctaccagtcctacctgcggcgcacccagagcatgggcatccagctcgaccagcggatcatcctgctgttcatgatcgagtgggggtccgacatcgtgaaccacttccacctcggcgacgacatggaccccgagctgcgcacgctggcccagagcctcatcgaccagaaggtgaaggagatctccaaccaggagcccctgaagatctga

SEQ ID NO: 6631 - RNA, 1290 nt, synthetic construct
  misc_feature 1..1290: note = derived and/or modified CDS sequence (opt1) from TULV(g20-s)__AF164093.1__N
  source 1..1290: mol_type = other RNA
atgagccagctgaaggagatccaggaggagatcacccgccacgagcagcagatcgtgatcgcccggcagaagctcaaggacgccgagaagaccgtcgaggcggaccccgacgacgtgaacaagtccacgctgcagagccgccaggccgccgtgtccgccctggaggacaagctcgccgacttcaagcggaagctggcggacctggtcagctcccagaagatgggcgagaagcccgtggaccccaccgggctcgagcccgacgaccacctgaaggagcgcagctccctgcggtacggcaacgtgctcgacgtcaacgccatcgacatcgacgagcccagcgggcagaccgccgactggttctccatcggccagtacgtgatggggttcgccctggcgatcatcctgaaggccctctacatgctgagcacccgcggccggcagacgatcaaggagaacaagggcacccgcatccggttcaaggacgactccagctacgaggagatcaacgggatccgccggccgaagcacctgtacgtgtccatgcccaccgcccagagcaccatgaaggccgacgagctcacgcccggccgcttccggaccatcgtctgcgggctgttccccgcccagatcatgcaccgcaacatcatctccccggtgatgggcgtgatcgggttcagcttcttcgtcaaggactggcccgagaagatcgaggagttcctgatcaagccctgccccttcctcaagaagtccggcccgagcaaggaggaggacttcctggtgtccaacgacgcgtacctgctcggccgggagaaggccctgcgcgacagccacctggccgagatcgacgacctcatcgacctggccgagagcggggaccccaccccgcccgactccatcaagagcccccaggccccctgggtgttcgcgtgcgcccccgaccggtgcccgccgacctgcatctacatcgccggcatggccgagctgggggccttcttctccatcctccaggacatgcgcaacacgatcatggcgagcaagaccgtcggcaccgccgaggagaagctgaagaagaagtccagcttctaccagtcctacctgcggcgcacccagagcatgggcatccagctcgaccagcggatcatcctgctgttcatgacggagtgggggtccgacatcgtgaaccacttccacctcggcgacgacatggaccccgagctgcgcaccctggcccagagcctcatcgaccagaaggtgaaggagatctccaaccaggagcccctgaagatctga

SEQ ID NO: 6632 - RNA, 1293 nt, synthetic construct
  misc_feature 1..1293: note = derived and/or modified CDS sequence (opt1) from TULV(Sennickerode Sen05/174)__EU439948.1__N
  source 1..1293: mol_type = other RNA
atgagccagctgaaggagatccaggaggagatcacccgccacgagcagcagatcgtgatcgcccggcagaagctcaaggacgccgagaagaccgtcgaggcggaccccgacgacgtgaacaagtccacgctgcagagccgccgggccgccgtgtccgccctggaggacaagctcgccgacttcaagcgccagctggcggacctggtcagctcccagaagatgggcgagaagcccgtggaccccaccgggctcgagcccgacgaccacctgaaggagcggagctccctgcgctacggcaacgtgctcgacgtcaacgccatcgacatcgacgagcccagcgggcagaccgccgactggttctccatcggccagtacatcatcgggttcgccctggcgatcgtgctgaaggccctctacatgctgagcacccggggccgccagacgatcaaggagaacaagggcacccggatccgcttcaaggacgactccagcttcgaggagatcaacgggatccggcgcccgaagcacctgtacgtgtccatgcccaccgcccagagcaccatgaaggccgacgagctcacgcccggccggttccgcaccatcgtctgcgggctgttccccgcccagatcatgcaccggaacatcatctccccggtgatgggcgtgatcgggttcagcttcttcgtcaaggactggcccgacaagatcgaggagttcctgatcaagccctgccccttcctcaagaagcagggcggcccgaacaaggacgaggacttcctggtgtccaacgacgcgtacttcctggggcgcgagaaggccctccgggagagccacctgaacgagatcgacgacctgatcgagctcgccgcctccggcgaccccaccccgcccgacagcatcaagagcccccaggccccctgggtgttcgcgtgcgcccccgaccgctgcccgccgacctgcatctacgtcgccgggatggccgagctgggcgccttcttctccatcctgcaggacatgcggaacacgatcatggcgagcaagaccgtgggcaccgccgaggagaagctcaagaagaagtccagcttctaccagtcctacctgcgccggacccagagcatggggatccagctggaccagcgcatcatcctcctgttcatgatggagtggggctccgacatcgtgaaccacttccacctgggggacgacatggaccccgagctccgcacgctggcccagagcctgatcgaccagaaggtcaaggagatctccaaccaggagcccctcaagatctga

SEQ ID NO: 6633 - RNA, 1293 nt, synthetic construct
  misc_feature 1..1293: note = derived and/or modified CDS sequence (opt1) from TULV(Sennickerode Sen05/175)__EU439949.1__N
  source 1..1293: mol_type = other RNA
atgagccagctgaaggagatccaggaggagatcacccgccacgagcagcagatcgtgatcgcccggcagaagctcaaggacgccgagaagaccgtcgaggcggaccccgacgacgtgaacaagtccacgctgcagagccgccgggccgccgtgtccgccctggaggacaagctcgccgacttcaagcgccagctggcggacctggtcagctcccagaagatgggcgagaagcccgtggaccccaccgggctcgagcccgacgaccacctgaaggagcggagctccctgcgctacggcaacgtgctcgacgtcaacgccatcgacatcgacgagcccagcgggcagaccgccgactggttctccatcggccagtacatcatcgggttcgccctggcgatcgtgctgaaggccctctacatgctgagcacccggggccgccagacgatcaaggagaacaagggcacccggatccgcttcaaggacgactccagcttcgaggagatcaacgggatccggcgcccgaagcacctgtacgtgtccatgcccaccgcccagagcaccatgaaggccgacgagctcacgcccggccggttccgcaccatcgtctgcgggctgttccccgcccagatcatgcaccggaacatcatctccccggtgatgggcgtgatcgggttcagcttcttcgtcaaggactggcccgacaagatcgaggagttcctgatcaagccctgccccttcctcaagaagcagggcggcccgaacaaggacgaggacttcctggtgtccaacgacgcgtacttcctggggcgcgagaaggccctccgggagagccacctgaacgagatcgacgacctgatcgagctcgccgcctccggcgaccccaccccgcccgacagcatcaagagcccccaggccccctgggtgttcgcgtgcgcccccgaccgctgcccgccgacctgcatctacgtcgccgggatggccgagctgggcgccttcttctccatcctgcaggacatgcgcaagagcatcatggcgtccaagacggtgggcaccgccgaggagaagctcaagaagaagtccagcttctaccagagctacctgcggcggacccagtccatggggatccagctggaccagcgcatcatcctcctgttcatgatggagtggggcagcgacatcgtgaaccacttccacctgggggacgacatggaccccgagctccgcaccctggcccagtccctgatcgaccagaaggtcaaggagatcagcaaccaggagcccctcaagatctga

SEQ ID NO: 6634 - RNA, 1293 nt, synthetic construct
  misc_feature 1..1293: note = derived and/or modified CDS sequence (opt1) from TULV(TUL/Karatal/Ma322/2003)__AM945877.1__N
  source 1..1293: mol_type = other RNA
atgagccagctgaaggagatccaggaggagatcacccgccacgagcagcagatcgtgatcgcccggcagaagctcaaggacgccgagaagaccgtcgaggcggaccccgacgacgtgaacaagaacacgctgcagtcccgccgggccgccgtgagcgccctggaggacaagctcgccgagttcaagcgccagctggcggacctggtctccagccagaagatgggcgagaagcccgtggaccccaccgggctcgagcccgacgaccacctgaaggagcggtccagcctgcgctacggcaacgtgctcgacgtcaacgccatcgacatcgacgagccctccgggcagaccgccgactggttcagcatcggccagtacgtgatggggttcgccctggcgatcgtgctgaaggccctctacatgctgtccacccggggccgccagacgatcaaggagaacaagggcacccggatccgcttcaaggacgacagctccttcgaggagatcaacgggatccggcgcccgaagcacctgtacgtcagcatgcccaccgcccagtccaccatgaaggccgacgagctcacgcccggccggttccgcaccatcgtgtgcgggctgttccccgcccagatcatgcaccggaacatcatcagcccggtgatgggcgtcatcgggttctccttcttcgtgaaggactggcccgagaagatcgaggagttcctgatcaagccctgccccttcctcaagaagcagggcagctccggcaaggaggaggagttcctggtgagcaacgacgcgtacctgatcgggcgcgagaagaccctccaggagtcccacctgaccgagatcgacgacctgatcgacctcgccgacagcggcgacccgacgccgcccgacagcatcaagagcccccaggccccctgggtcttcgcctgcgcccccgaccggtgcccgccgacctgcatctacatcgcggggatggccgagctgggcgccttcttcagcatcctgcaggacatgcgcaacaccatcatggcctccaagaccgtgggcacggccgaggagaagctcaagaagaagtcctccttctaccagagctacctgcggcgcacccagtccatggggatccagctggaccagcggatcatcctcctgttcatgatggagtggggcagcgacatcgtgaaccacttccacctgggggacgacatggaccccgagctccgcaccctggcgcagtccctgatcgaccagaaggtcaaggagatcagcaaccaggagcccctcaagatctga

SEQ ID NO: 6635 - RNA, 1293 nt, synthetic construct
  misc_feature 1..1293: note = derived and/or modified CDS sequence (opt1) from TULV(Tula/Kosice144/Ma/95)__Y13979.1__N
  source 1..1293: mol_type = other RNA
atgagccagctgaaggagatccaggaggagatcacccgccacgagcagcagatcgtgatcgcccggcagaagctcaaggacgccgagaagaccgtcgaggcggaccccgacgacgtgaacaagtccacgctgcagagccgccgggccgccgtgtccgccctggaggacaagctcgccgacttcaagcgccagctggcggacctggtcagctcccagaagatgggcgagaagcccgtggaccccaccgggctcgagcccgacgaccacctgaaggagcggagctccctgcgctacggcaacgtgctcgacgtcaacgccatcgacatcgacgagcccagcgggcagaccgccgactggttctccatcggccagtacatcatcgggttcgccctggcgatcgtgctgaaggccctctacatgctgagcacccggggccgccagacgatcaaggagaacaagggcacccggatccgcttcaaggacgactccagcttcgaggagatcaacgggatccggcgcccgaagcacctgtacgtgtccatgcccaccgcccagagcaccatgaaggccgacgagctcacgcccggccggttccgcaccatcgtctgcgggctgttccccgcccagatcatgcaccggaacatcatctccccggtgatgggcgtgatcgggttcagcttcttcgtcaaggactggcccgagaagatcgaggagttcctgatcaagccctgccccttcctcaagaagcagggcgcgccgggcaaggaggaggacttcctggtgtccaacgacgcctacctgctcgggcgcgagaaggccctgcgggagagccacctggccgagatcgacgacctcatcgacctggccgcgtccggcgaccccaccccgcccgacagcatcaagagcccccaggccccctgggtgttcgcctgcgcccccgaccgctgcccgccgacctgcatctacatcgccgggatggcggagctgggcgccttcttctccatcctccaggacatgcggaacacgatcatggccagcaagaccgtcggcaccgccgaggagaagctgaagaagaagtccagcttctaccagtcctacctgcgccggacccagagcatggggatccagctcgaccagcgcatcatcctgctgttcatgacggagtggggctccgacatcgtgaaccacttccacctcggggacgacatggaccccgagctgcgcaccctggcccagagcctcatcgaccagaaggtgaaggagatctccaaccaggagcccctgaagatctga

SEQ ID NO: 6636 - RNA, 1293 nt, synthetic construct
  misc_feature 1..1293: note = derived and/or modified CDS sequence (opt1) from TULV(Tula/Kosice667/Ma/95)__Y13980.1__N
  source 1..1293: mol_type = other RNA
atgagccagctgaaggagatccaggaggagatcacccgccacgagcagcagatcgtgatcgcccggcagaagctcaaggacgccgagaagaccgtcgaggcggaccccgacgacgtgaacaagtccacgctgcagagccgccgggccgccgtgtccgccctggaggacaagctcgccgacttcaagcgccagctggcggacctggtcagctcccagaagatgggcgagaagcccgtggaccccaccgggctcgagcccgacgaccacctgaaggagcggagctccctgcgctacggcaacgtgctcgacgtcaacgccatcgacatcgacgagcccagcgggcagaccgccgactggttctccatcggccagtacatcatcgggttcgccctggcgatcgtgctgaaggccctctacatgctgagcacccggggccgccagacgatcaaggagaacaagggcacccggatccgcttcaaggacgactccagcttcgaggagatcaacgggatccggcgcccgaagcacctgtacgtgtccatgcccaccgcccagagcaccatgaaggccgacgagctcacgcccggccggttccgcaccatcgtctgcgggctgttccccgcccagatcatgcaccggaacatcatctccccggtgatgggcgtgatcgggttcagcttcttcgtcaaggactggcccgagaagatcgaggagttcctgatcaagccctgccccttcctcaagaagcagggcgcgccgggcaaggaggaggacttcctggtgtccaacgacgcctacctgctcgggcgcgagaaggccctgcgggagagccacctggccgagatcgacgacctcatcgacctggccgcgtccggcgaccccaccccgcccgacagcatcaagagcccccaggccccctgggtgttcgcctgcgcccccgaccgctgcccgccgacctgcatctacatcgccgggatggcggagctgggcgccttcttctccatcctccaggacatgcgggacacgatcatggccagcaagaccgtcggcaccgccgaggagaagctgaagaagaagtccagcttctaccagtcctacctgcgccggacccagagcatggggatccagctcgaccagcgcatcatcctgctgttcatgacggagtggggctccgacatcgtgaaccacttccacctcggggacgacatggaccccgagctgcgcaccctggcccagagcctcatcgaccagaaggtgaaggagatctccaaccaggagcccctgaagatctga

SEQ ID NO: 6637 - RNA, 1290 nt, synthetic construct
  misc_feature 1..1290: note = derived and/or modified CDS sequence (opt1) from TULV(Tula/Koziky/5247Ma/94)__AJ223600.1__N
  source 1..1290: mol_type = other RNA
atgagccagctgaaggagatccaggaggagatcacccgccacgagcagcagatcgtgatcgcccggcagaagctcaaggacgccgagaagaccgtcgaggcggaccccgacgacgtgaacaagtccacgctgcagagccgccgggccgccgtgtccgccctggaggacaagctcgccgacttcaagcgccagctggcggacctggtcagctcccagaagatgggcgagaagccggtggaccccaccgggctcgagcccgacgaccacctgaaggagcggagctccctgcgctacggcaacgtgctcgacgtcaacgccatcgacatcgacgagcccagcgggcagaccgccgactggttctccatcggccagtacatcaccgggttcgccctggcgatcatcctgaaggccctctacatgctgagcacgcggggccgccagaccatcaaggagaacaagggcacccggatccgcttcaaggacgactccagctacgaggagatcaacgggatccggcgcccgaagcacctgtacgtgtccatgcccaccgcccagagcacgatgaaggccgacgagctcacccccggccggttccgcaccatcgtgtgcgggctgttccccgcccagatcatgcaccggaacatcatctccccggtcatgggcgtgatcgggttcagcttcttcgtgaaggactggcccgagaagatcgaggagttcctgatcaagccctgccccttcctcaagaagaacggcccgtccaaggaggaggacttcctggtcagcaacgacgcgtacctgctcggccgcgagaaggccctgcgggagtcccacctggccgagatcgacgacctcatcgacctggccgccagcgaggaccccaccccgcccgacagcatcaagagcccccaggcgccctgggtgttcgcctgccgccccgaccggtgcccgcccacgtgcatctacatcgccgggatggccgagctgggcgccttcttctccatcctccaggacatgcgcaacaccatcatggcgtccaagaccgtggggaccgccgaggagaagctgaagaagaagtccagcttctaccagagctacctgcggcgcacgcagtccatgggcatccagctcgaccagcgcatcatcctgctgttcatgaccgagtggggcagcgacatcgtcaaccacttccacctcggggacgacatgtcccccgagctgcggaccctggcccagagcctcatcgaccagaaggtgaaggagatctccaaccaggagcccctgaagatctga

SEQ ID NO: 6638 - RNA, 1290 nt, synthetic construct
  misc_feature 1..1290: note = derived and/or modified CDS sequence (opt1) from TULV(Tula/Moravia/5302v/95)__Z69991.1__N
  source 1..1290: mol_type = other RNA
atgagccagctgaaggagatccaggaggagatcacccgccacgagcagcagatcgtgatcgcccggcagaagctcaaggacgtcgagaagaccgtggaggccgaccccgacgacgtgaacaagtccacgctgcagagccgccgggcggccgtctccgccctggaggacaagctcgccgacttcaagcgccagctggccgacctggtgagctcccagaagatgggcgagaagccggtggaccccaccgggctcgagcccgacgaccacctgaaggagcggagctccctgcgctacggcaacgtcctcgacgtgaacgcgatcgacatcgacgagcccagcgggcagaccgccgactggttctccatcggccagtacatcaccgggttcgccctggccatcatcctgaaggcgctctacatgctgagcacgcggggccgccagaccatcaaggagaacaagggcacccggatccgcttcaaggacgactccagctacgaggagatcaacgggatccggcgcccgaagcacctgtacgtgtccatgcccaccgcccagagcacgatgaaggccgacgagctcacccccggccggttccgcaccatcgtctgcgggctgttccccgcccagatcatgtaccggaacatcatctccccggtgatgggcgtgatcgggttcagcttcttcgtcaaggactggcccgagaagatcgaggagttcctgatcaagccctgccccttcctcaagaagtccggcccgagcaaggaggaggacttcctggtgtccaacgacgcctacctgctcggccgcgagaaggcgctgcgggagagccacctggccgagatcgacgacctcatcgacctggccgccagcggggaccccaccccgcccgactccatcaagagcccccaggccccctgggtgttcgcgtgccgccccgaccggtgcccgcccacgtgcatctacatcgccggcatggccgagctgggggccttcttctccatcctccaggacatgcgcaacaccatcatggccagcaagaccgtcggcaccgcggaggagaagctgaagaagaagtccagcttctaccagtcctacctgcggcgcacgcagagcatgggcatccagctcgaccagcgcatcatcctgctgttcatgaccgagtgggggtccgacatcgtgaaccacttccacctcggcgacgacatggaccccgagctgcggaccctggcccagagcctcatcgaccagaaggtgaaggagatctccaaccaggagcccctgaagatctga

SEQ ID NO: 6639 - RNA, 1293 nt, synthetic construct
  misc_feature 1..1293: note = derived and/or modified CDS sequence (opt1) from TULV__AF017659.1__N
  source 1..1293: mol_type = other RNA
atgagccagctgaaggagatccaggaggagatcacccgccacgagcagcagatcgtgatcgcccggcagaagctcaaggacgccgagaagaccgtcgaggcggaccccgacgacgtgaacaagtccacgctgcagagccgccgggccgccgtgtccgccctggaggacaagctcgccgacttcaagcgccagctggcggacctggtcagctcccagaagatgggcgagaagcccgtggaccccaccgggctcgagcccgacgaccacctgaaggagcggagctccctgcgctacggcaacgtgctcgacgtcaacgccatcgacatcgacgagcccagcgggcagaccgccgactggttctccatcggccagtacatcatcgggttcgccctggcgatcgtgctgaaggccctctacatgctgagcacccggggccgccagacgatcaaggagaacaagggcacccggatccgcttcaaggacgactccagcttcgaggagatcaacgggatccggcgcccgaagcacctgtacgtgtccatgcccaccgcccagagcaccatgaaggccgacgagctcacgcccggccggttccgcaccatcgtctgcgggctgttccccgcccagatcatgcaccggaacatcatctccccggtgatgggcgtgatcgggttcagcttcttcgtcaaggactggcccgagaagatcgaggagttcctgatcaagccctgccccttcctcaagaagcagggcgcgccgggcaaggaggaggacttcctggtgtccaacgacgcctacctgctcgggcgcgagaaggccctgcgggagagccacctggccgagatcgacgacctcatcgacctggccgcgtccggcgaccccaccccgcccgacagcatcaagagcccccaggccccctgggtgttcgcctgcgcccccgaccgctgcccgccgacctgcatctacgtcgccgggatggcggagctgggcgccttcttctccatcctccaggacatgcggaacacgatcatggccagcaagaccgtgggcaccgccgaggagaagctgaagaagaagtccagcttctaccagtcctacctgcgccggacccagagcatggggatccagctcgaccagcgcatcatcctgctgttcatgacggagtggggctccgacatcgtgaaccacttccacctcggggacgacatggaccccgagctgcgcaccctggcccagagcctcatcgaccagaaggtcaaggagatctccaaccaggagcccctgaagatctga

SEQ ID NO: 6640 - RNA, 1293 nt, synthetic construct
  misc_feature 1..1293: note = derived and/or modified CDS sequence (opt1) from TULV(Lodz-1)__AF063892.1__N
  source 1..1293: mol_type = other RNA
atgaccgagctgaaggagatccaggaggagatcacccgccacgagcagcagatcgtgatcgcccggcagaagctcaaggacgccgagaagacggtcgaggcggaccccgacgacgtgaacaagagcaccctgcagtcccgccgggccgccgtgagcgccctggaggacaagctcgccgacttcaagcgccagctggcggacctggtctccagccagaagatgggcgagaagccggtggaccccaccgggctcgagcccgacgaccacctgaaggagcggtccagcctgcgctacggcaacgtgctcgacgtcaacgccatcgacatcgacgagccctccgggcagaccgccgactggttcagcatcggccagtacatcatggggttcgccctggcgatcgtgctgaaggccctctacatgctgtccacgcggggccgccagaccatcaaggagaacaagggcacccggatccgcttcaaggacgacagctcctacgaggagatcaacgggatccggcgcccgaagcacctgtacgtgagcatgcccaccgcccagtccacgatgaaggccgacgagctcacccccggccggttccgcaccatcgtctgcgggctgttccccgcccagatcatgcaccggaacatcatcagcccggtgatgggcgtgatcgggttctccttcttcgtcaaggactggcccgacaagatcgaggagttcctgatcaagccctgccccttcctcaagaagcagggcggcccgaacaaggacgaggagttcctggtgagcaacgacgcgtacctgctcgggcgcgagaaggccctgcgggagtcccacctggccgagatcgacgacctcatcgacctggccgccagcggcgaccccaccccgcccgactccatcaagagcccccaggcgccctgggtgttcgcctgcgcccccgaccgctgcccgcccacgtgcatctacgtcgccgggatggccgagctgggcgcgttcttcagcatcctccaggacatgcggaacaccatcatggcctccaagaccgtgggcaccgccgaggagaagctgaagaagaagtccagcttctaccagagctacctgcgccggacgcagtccatggggatccagctcgaccagcgcatcatcctgctgttcatgatggagtggggcagcgacatcgtgaaccacttccacctcggggacgacatggaccccgagctgcgcaccctggcccagtccctcatcgaccagaaggtcaaggagatcagcaaccaggagcccctgaagatctga

SEQ ID NO: 6641 - RNA, 1293 nt, synthetic construct
  misc_feature 1..1293: note = derived and/or modified CDS sequence (opt1) from TULV(Lodz-2)__AF063897.1__N
  source 1..1293: mol_type = other RNA
atgaccgagctgaaggagatccaggaggagatcacccgccacgagcagcagatcgtgatcgcccggcagaagctcaaggacgccgagaagacggtcgaggcggaccccgacgacgtgaacaagagcaccctgcagtcccgctgggccgccgtgagcgccctggaggacaagctcgccgacttcaagcggcagctggcggacctggtctccagccagaagatgggcgagaagccggtggaccccaccgggctcgagcccgacgaccacctgaaggagcgctccagcctgcggtacggcaacgtgctcgacgtcaacgccatcgacatcgacgagccctccgggcagaccgccgactggttcagcatcggccagtacatcatggggttcgccctggcgatcgtgctgaaggccctctacatgctgtccacgcgcggccggcagaccatcaaggagaacaagggcacccgcatccggttcaaggacgacagctcctacgaggagatcaacgggatccgccggccgaagcacctgtacgtgagcatgcccaccgcccagtccacgatgaaggccgacgagctcacccccggccgcttccggaccatcgtctgcgggctgttccccgcccagatcatgcaccgcaacatcatcagcccggtgatgggcgtgatcgggttctccttcttcgtcaaggactggcccgacaagatcgaggagttcctgatcaagccctgccccttcctcaagaagcagggcggcccgaacaaggacgaggagttcctggtgagcaacgacgcgtacctgctcgggcgggagaaggccctgcgcgagtcccacctggccgagatcgacgacctcatcgacctggccgccagcggcgaccccaccccgcccgactccatcaagagcccccaggcgccctgggtgttcgcctgcgcccccgaccggtgcccgcccacgtgcatctacgtcgccgggatggccgagctgggcgcgttcttcagcatcctccaggacatgcgcaacaccatcatggcctccaagaccgtgggcaccgccgaggagaagctgaagaagaagtccagcttctaccagagctacctgcggcgcacgcagtccatggggatccagctcgaccagcggatcatcctgctgttcatgatggagtggggcagcgacatcgtgaaccacttccacctcggggacgacatggaccccgagctgcgcaccctggcccagtccctcatcgaccagaaggtcaaggagatcagcaaccaggagcccctgaagatctga

SEQ ID NO: 6642 - RNA, 1449 nt, synthetic construct
  misc_feature 1..1449: note = derived and/or modified CDS sequence (opt1) from CCHFV(IbAr10200)__NC_005302.1/U88410.1__N
  source 1..1449: mol_type = other RNA
atggagaacaagatcgaggtgaacaacaaggacgagatgaaccgctggttcgaggagttcaagaagggcaacgggctggtcgacaccttcaccaacagctactccttctgcgagagcgtgcccaacctcgaccggttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgacgtgcccaagatcgagcagctgaccgggtaccagcaggccgccctgaagtggcgcaaggacatcggcttccgggtgaacgcgaacaccgccgccctcagcaacaaggtcctggccgagtacaaggtgcccggcgagatcgtgatgtccgtcaaggagatgctgagcgacatgatccgccggcgcaacctcatcctgaaccgcgggggcgacgagaacccccgggggccggtgtcccacgagcacgtggactggtgccgggagttcgtcaagggcaagtacatcatggccttcaacccgccctggggcgacatcaacaagagcgggcgctccggcatcgcgctggtggccaccgggctcgccaagctggccgagacggagggcaaggggatcttcgacgaggccaagaagaccgtggaggcgctgaacggctacctcgacaagcacaaggacgaggtcgaccgggccagcgccgactccatgatcaccaacctgctgaagcacatcgccaaggcccaggagctctacaagaacagctccgcgctgcgcgcccagagcgcccagatcgacaccgccttcagctcctactactggctgtacaaggccggcgtgacgcccgagaccttccccaccgtgagccagttcctcttcgagctggggaagcagccccggggcaccaagaagatgaagaaggcgctgctctccacgcccatgaagtgggggaagaagctgtacgagctgttcgccgacgacagcttccagcagaaccgcatctacatgcaccccgccgtcctcaccgccggccggatctccgagatgggggtgtgcttcggcaccatcccggtggcgaaccccgacgacgccgcccagggcagcgggcacaccaagtccatcctgaacctgcgcacgaacaccgagaccaacaacccctgcgccaagaccatcgtcaagctgttcgaggtgcagaagacgggcttcaacatccaggacatggacatcgtcgccagcgagcacctcctgcaccagtccctcgtggggaagcagagccccttccagaacgcgtacaacgtgaagggcaacgccacctccgccaacatcatctga

SEQ ID NO: 6643 - RNA, 1449 nt, synthetic construct
  misc_feature 1..1449: note = derived and/or modified CDS sequence (opt1) from CCHFV(Turkey-Kelkit06)__GQ337053.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaaggacagcggcaccatcaagtcctgggacgagaactacgccgagctcaaggtggacgtccccaagatcgagcagctggccaactaccagcaggccgcgctgaagtggcgcaaggacatcgggttccgggtgaacgccaacacggccgccctcagcaacaaggtgctggccgagtacaaggtccccggcgagatcgtgatgtccgtgaaggagatgctgagcgacatgatccgccggcgcaacctcatcctgaaccggggcggggacgagaacccccgcggcccggtctcccgggagcacgtggagtggtgccgcgagttcgtgaaggggaagtacatcatggcgttcaacccgccctggggcgacatcaacaagagcgggcggtccggcatcgccctggtcgccaccggcctcgccaagctggccgagaccgaggggaagggcgtgttcgacgaggcgaagaagaccgtggaggccctgaacgggtacctcgacaagcaccgcgacgaggtcgacaaggccagcgccgactccatgatcacgaacctgcccaagcacatcgccaaggcgcaggagctgtacaagaacagctccgccctccgggcccagggcgcccagatcgacacccccttcagcagcttctactggctgtacaaggccggcgtgacccccgagaccttccccacgatctcccagttcctgttcgagctcggggagcagccccgcggcaccaagaagatgaagaaggcgctgctgagcaccccgatgaagtgggggaagaagctctacgagctgttcgccgacgactccttccagcagaaccggatctacatgcaccccgccgtgctgaccgccggccgcatcagcgagatgggggtctgcttcggcacgatccccgtggcgaaccccgacgacgccgcccagggctccgggcacaccaagagcatcctcaacctgcggacctccaccgagacgaacaacccgtgcgccaagaccatcgtgaagctgttcgagatccaggagaccggcttcaacatccaggacatggacatcgtcgccagcgagcacctcctgcaccagtccatcgtggggaagcagagccccttccagaacgcgtacaacgtcaagggcaacgccacctccgccaacatcatctga

SEQ ID NO: 6644 - RNA, 1449 nt, synthetic construct
  misc_feature 1..1449: note = derived and/or modified CDS sequence (opt1) from CCHFV(Baghdad 12)__AJ538196.1__N
  source 1..1449: mol_type = other RNA
atggagaacaagatcgaggtgaacagcaaggacgagatgaacaagtggttcgaggagttcaagaagggcaacgggctggtcgacacctacaccaactcctacagcttctgcgagtccgtgcccaacctcgaccgcttcgtgttccagatggccggcgccacggacgacgcgcagaaggacagcatctacgcctccgccctggtcgaggccaccaagttctgcgccccgatctacgagtgcgcgtgggccagctccaccgggatcgtgaagaagggcctggagtggttcgagaagaacaccgggacgatcaagagctgggacgagtcctacaccgagctcaaggtggaggtccccaagatcgagcagctgttcaactaccagcaggccgccctgaagtggcggaaggacatcggcttccgcgtgaacgcgaacaccgccgccctcagcaacaaggtgctggccgagtacaaggtccccggcgagatcgtgatgtccgtgaaggagatgctgagcgacatgatccggcgccggaacctcatcctgaaccgcgggggcgacgagaacccccgggggccggtctcccgcgagcacgtggagtggtgccgggagttcgtgaagggcaagtacatcatggccttcaacccgccctggggcgacatcaacaagagcgggcgctccggcatcgcgctggtcgccaccgggctcgccaagctggccgagacggagggcaagggggtgttcgacgaggccaagaagaccgtggaggcgctgaacggctacctcgacaagcacaaggacgaggtcgacaaggccagcgccgacaacatggtgaccaacctgctgaagcacgtggccaaggcccaggagctctacaagaactccagcgcgctgcgggcccagggcgcccagatcgacaccgtcttctccagctactactggctgtacaaggccggggtgacgcccgagaccttccccaccgtgagccagttcctcttcgagctgggcaagcacccccgcgggaccaagaagatgaagaaggccctgctctccacgcccatgaagtggggcaagaagctgtacgagctgttcgcggacgacagcttccagcagaaccggatctacatgcaccccgccgtcctcaccgccgggcgcatctccgagatgggcgtgtgcttcggcaccatcccggtcgccaaccccgacgacgcggccctggggagcggccacaccaagtccatcctgaacctccggacgaacaccgagaccaacaacccctgcgcccgcaccatcgtgaagctgttcgagatccagaagacggggttcaacatccagcacatggacatcgtggccagcgagcacctcctgcaccagtccctggtcggcaagcagagccccttccagaacgcctacaacgtgaaggggaacgcgacctccgccaacatcatctga

SEQ ID NO: 6645 - RNA, 1449 nt, synthetic construct
  misc_feature 1..1449: note = derived and/or modified CDS sequence (opt1) from CCHFV(SR3)__AJ538198.1__N
  source 1..1449: mol_type = other RNA
atggagaacaagatcgaggtgaacagcaaggacgagatgaacaagtggttcgaggagttcaagaagggcaacgggctggtcgacaccttcaccaactcctacagcttctgcgagtccgtgcccaacctcgaccgcttcgtgttccagatggccagcgccacggacgacgcgcagaaggactccatctacgccagcgccctggtcgaggccaccaagttctgcgccccgatctacgagtgcgcgtgggcctccagcaccggcatcgtgaagaaggggctggagtggttcgagaagaacgccggcaccatcaagtcctgggacgagagctacacggagctcaaggtggaggtccccaagatcgagcagctgtccaactaccagcaggccgcgctgaagtggcggaaggacatcgggttccgcgtgaacgccaacaccgccgccctcagcaacaaggtgctggccgagtacaaggtccccggcgagatcgtgatgtccgtgaaggagatgctgagcgacatgatccggcgccggaacctcatcctgaaccgcggcggggacgagaacccccggggcccggtctcccgcgagcacgtggagtggtgccgggagttcgtgaaggggaagtacatcatggcgttcaacccgccctggggcgacatcaacaagagcgggcgctccggcatcgccctggtcgccaccggcctcgccaagctggccgagaccgaggggaagggcgtgttcgacgaggcgaagaagacggtggaggccctgaacgggtacctcgacaagcacaaggacgaggtcgacaaggccagcgccgactccatgatcaccaacctgctgaagcacatcgccaaggcgcaggagctctacaagaacagcagcgccctgcgggcccagggcgcccagatcgacaccgtgttctccagctactactggctgtacaaggccggcgtgacccccgacacgttccccgcggtctcccagttcctcttcgagctggggaagcagccccgcggcaccaagaagatgaagaaggccctgctcagcacccccatgaagtgggggaagaagctgtacgagctgttcgccgacgactccttccagcagaaccggatctacatgcaccccgccgtgctcaccgcgggccgcatcagcgagatgggggtgtgcttcggcacgatcccggtcgccaaccccgacgacgccgccctgggctccgggcacaccaagagcatcctgaacctccggaccaacaccgagacgaacaacccctgcgccaagaccatcgtgaagctgttcgagatccagaagaccggcttcaacatccaggacatggacatcgtcgcgtccgagcacctcctgcaccagagcctggtggggaagcagtcccccttccagaacgcctacaacgtgaagggcaacgccaccagcgccaacatcatctga

SEQ ID NO: 6646 - RNA, 1449 nt, synthetic construct
  misc_feature 1..1449: note = derived and/or modified CDS sequence (opt1) from CCHFV(Gaib)__KX013446.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccaactaccagcaggccgcgctgaagtggcggaaggacatcgggttccgcgtgaacgccaacaccgccgccctcagccacaaggtcctggccgagtacaaggtgcccggcgagatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaagtacatcatggcgttcaacccgccctggggcgacatcaacaagagcgggcgctccggcatcgccctggtggccaccggcctcgccaagctggccgagaccgaggggaagggcgtgttcgacgaggcgaagaagacggtcgaggccctgaacgggtacctcgacaagcacaaggacgaggtggacaaggccagcgccgacaacatgatcaccaacctgctgaagcacatcgccaaggcgcaggagctctacaagaactccagcgccctgcgggcccagggcgcccagatcgacaccgccttctccagctactactggctgtacaaggcgggcgtgacccccgagacgttccccaccgtcagccagttcctcttcgagctggggaagcagccccgcggcaccaagaagatgaagaaggccctgctctccacccccatgaagtgggggaagaagctgtacgagctgttcgccgacgacagcttccagcagaaccggatctacatgcaccccgccgtgctcacggcgggccgcatctccgagatgggggtgtgcttcggcaccatcccggtcgccaaccccgacgacgccgcccagggcagcgggcacaccaagtccatcctgaacctgcggaccaacacggagaccaacaacccctgcgccaagaccatcgtgaagctgttcgagatccagaagaccggcttcaacatccaggacatggacatcgtcgcgagcgagcacctcctgcaccagtccctcgtggggaagcagagccccttccagaacgcctacaacgtgaagggcaacgccacgtccgccaacatcatctga

SEQ ID NO: 6647 - RNA, 1449 nt, synthetic construct
  misc_feature 1..1449: note = derived and/or modified CDS sequence (opt1) from CCHFV(Hodzha)__KX013449.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccaactaccagcaggccgcgctgaagtggcggaaggacatcgggttctgcgtgaacgccaacaccgccgccctcagccagaaggtcctgtccgagtacaaggtgcccggcgagatcgtgatgagcgtcaaggagatgctgtccgacatgatccgccggcgcaacctcatcctgaaccggggcggggacgagaacccccgcggcccggtgagccgggagcacgtggagtggtgccgcgagttcgtcaaggggaagtacatcatggccttcaacccgccctggggcgacatcaacaagtccgggcggagcggcatcgcgctggtggccaccggcctcgccaagctggccgagaccgaggggaagggcgtgttcgacgaggccaagaagacggtcgaggcgctgaacgggtacctcgacaagcacaaggacgaggtggacaaggcctccgccgacaacatgaccaccaacctgctgaagcacatcgccaaggcccaggagctctacaagaacagctccgcgctgcgcgcccagggcgcccagatcgacaccgccttcagcagctactactggctgtacaaggccggcgtgacgcccgagaccttccccaccgtctcccagttcctcttcgagctggggaagcagccccggggcaccaagaagatgaagaaggcgctgctcagcacgcccatgaagtgggggaagaagctgtacgagctgttcgccgacgactccttccagcagaaccgcatctacatgcaccccgccgtgctcaccaccggccggatcagcgagatgggggtgtgcttcggcaccgtcccggtggccgaccccgacgacgcggcccagggctccgggcacaccaagagcatcctgaacctgcgcacgaacaccgagaccaacaacccctgcgccaagacgatcgtcaagctgttcgagatccagaagaccggcttcaacatccaggacatggacatcgtggcctccgagcacctcctgcaccagagcctcgtggggaagcagtcccccttccagaacgcctacaacgtcaagggcaacgcgaccagcgccaacatcatctga

SEQ ID NO: 6648 - RNA, 1449 nt, synthetic construct
  misc_feature 1..1449: note = derived and/or modified CDS sequence (opt1) from CCHFV(IbAn7620)__KX013452.1__N
  source 1..1449: mol_type = other RNA
atggagaacaagatcgaggtgaacaacaaggacgagatgaaccgctggttcgaggagttcaagaaggagaacggcctggtcgacaccttcaccaacagccactccttctgcgagagcgtgcccaacctcgacaagttcgtgttccagatggcctccgccacggacgacgcgcagaaggacagcatctacgccgccgccctggtcgaggccaccaagttctgcgcgccgatctacgagtgcgcctgggtgtccagcaccgggatcgtgaagaagggcctggagtggttcgagaagaacgccgggaccatcaagtcctgggacgagagctacacggagctcaaggtcgaggtgcccaagatcgagcagctgtccaactaccagcaggccgcgctgaagtggcggaaggacatcggcttccgcgtgaacgccaacaccgccaccctcagccacaaggtcctggccgagtacaaggtgcccggggagatcgtgatgtccgtcaaggagatgctgagcgacatgatccggcgccggaacctcatcctgaaccgcggcggcgacgagaacccccgggggccggtgtcccgcgagcacgtggagtggtgccgggagttcgtcaagggcaagtacatcatggccttcaacccgccctggggcgacatcaacaagagcgggcgctccgggatcgcgctggtggccaccggcctcgccaagctggccgaggccgagggcaagggggtgttcgacgaggcgaagaagacggtcgaggccctgaacggctacctcgacaagcacaaggacgaggtggacaagagctccgccgacagcatgatcaccaacctgctgaagcacatcgccaaggcccaggagctctacaagaactccagcgcgctgcgggcccagggggcccagatcgacaccgccttcagctcctactactggctgtacaaggccggcgtgacccccgagacgttccccaccgtcagccagttcctcttcgagctgggcaagcagccccgcgggaccaagaagatgaagaaggcgctgctctccacccccatgaagtggggcaagaagctgtacgagctgttcgccgacgacagcttccagcagaaccggatctacatgcaccccgccgtgctcacggccgggcgcatctccgagatgggcgtgtgcttcgggaccatcccggtcgcgaaccccgacgacgccgccctgggcagcggccacaccaagtccatcctgaacctccggaccagcacggaggccaacaacccctgcgccaagaccatcgtgaagctgttcgagatccagaagaaggggttcgtcatcaaggacatggacatcgtggcgtccgagcacctcctgcaccagagcctggtgggcaagcagtcccccttccagaacgcctacaacgtcaaggggaacgccaccagcgccaacatcatctga

SEQ ID NO: 6649 - RNA, 1449 nt, synthetic construct
  misc_feature 1..1449: note = derived and/or modified CDS sequence (opt1) from CCHFV(K128_76)__KX013455.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgccctccctcgaccgcttcgtgttccagatggccagcgccacggacgacgcgcagaaggactccatctacgccagcgccctggtcgaggccaccaagttctgcgccccgatctacgagtgcgcgtgggtgtccagcaccggcatcgtgaagaaggggctggagtggttcgagaagaacgccggcaccatcaagtcctgggacgagagctacacggagctcaaggtcgaggtgcccaagatcgagcagctggccaactaccagcaggccgcgctgaagtggcggaaggacatcgggttccgcgtgaacgccaacaccgccgccctctcccacaaggtcctggccgagtacaaggtgcccggcgagatcgtgatgagcgtcaaggagatgctgtccgacatgatccggcgccggaacctcatcctgaaccgcggcggggacgagaacccccggggcccggtgagccgcgagcacgtggagtggtgccgggagttcgtcaaggggaagtacatcatggcgttcaacccgccctggggcgacatcaacaagtccgggcgcagcggcatcgccctggtggccaccggcctcgccaagctggccgagaccgaggggaagggcgtgttcgacgaggcgaagaagacggtcgaggccctgaacgggtacctcgacaagcacaaggacgaggtggacaaggcctccgccgacaacatgatcaccaacctgctgaagcacatcgccaaggcgcaggagctctacaagaacagctccgccctgcgggcccagggcgcccagatcgacaccgccttcagcagctactactggctgtacaaggcgggcgtgacccccgagacgttccccaccgtctcccagttcctcttcgagctggggaagcagccccgcggcaccaagaagatgaagaaggccctgctcagcacccccatgaagtgggggaagaagctgtacgagctgttcgccgacgactccttccagcagaaccggatctacatgcaccccgccgtgctcacggcgggccgcatcagcgagatgggggtgtgcttcggcaccatcccggtcgccaaccccgacgacgccgcccagggctccgggcacaccaagagcatcctgaacctgcggaccaacacggagaccaacaacccctgcgccaagaccatcgtgaagctgttcgagatccagaagaccggcttcaacatccaggacatggacatcgtcgcgtccgagcacctcctgcaccagagcctcgtggggaagcagtcccccttccagaacgcctacaacgtgaagggcaacgccacgagcgccaacatcatctga

SEQ ID NO: 6650 - RNA, 1449 nt, synthetic construct
  misc_feature 1..1449: note = derived and/or modified CDS sequence (opt1) from CCHFV(K168_125)__KX013461.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccaactaccagcaggccgcgctgaagtggcggaaggacatcgggttccgcgtgaacgccaacaccgccgccctcagccacaaggtcctggccgagtacaaggtgcccggcgacatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaagtacatcatggcgttcaacccgccctggggcgacatcaacaagagcgggcgctccggcatcgccctggtggccaccggcctcgccaagctggccgagaccgaggggaagggcgtgttcgacgaggcgaagaagacggtcgaggccctgaacgggtacctcgacaagcacaaggacgaggtggacaaggccagcgccgacaacatgatcaccaacctgctgaagcacatcgccaaggcgcaggagctctacaagaactccagcgccctgcgggcccagggcgcccagatcgacaccgccttctccagctactactggctgtacaaggcgggcgtgaccagcgagacgttccccaccgtctcccagttcctcttcgagctggggaagcagccccgcggcaccaagaagatgaagaaggccctgctcagcacccccatgaagtgggggaagaagctgtacgagctgttcgccgacgactccttccagcagaaccggatctacatgcaccccgccgtgctcacggcgggccgcatcagcgagatgggggtgtgcttcggcaccatccccgtcgccaacccggacgacgccgcccagggctccgggcacaccaagagcatcctgaacctgcggaccaacacggagaccaacaacccctgcgccaagaccatcgtgaagctgttcgagatccagaagaccggcttcaacatccaggacatggacatcgtcgcgtccgagcacctcctgcaccagagcctcgtggggaagcagtcccccttccagaacgcctacaacgtgaagggcaacgccacgagcgccaacatcatctga

SEQ ID NO: 6651 - RNA, 1449 nt, synthetic construct
  misc_feature 1..1449: note = derived and/or modified CDS sequence (opt1) from CCHFV(K168_40)__KX013458.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccaactaccagcaggccgcgctgaagtggcggaaggacatcgggttccgcgtgaacgccaacaccgccgccctcagccacaaggtcctggccgagtacaaggtgcccggcgacatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaactacatcatggcgttcaacccgccctggggcgacatcaacaagagcgggcgctccggcatcgccctggtggccaccggcctcgccaagctggccgagaccgaggggaagggcgtgttcgacgaggcgaagaagacggtcgaggccctgaacgggtacctcgacaagcacaaggacgaggtggacaaggccagcgccgacaacatgatcaccaacctgctgaagcacatcgccaaggcgcaggagctctacaagaactccagcgccctgcgggcccagggcgcccagatcgacaccgccttctccagctactactggctgtacaaggcgggcgtgaccagcgagacgttccccaccgtctcccagttcctcttcgagctggggaagcagccccgcggcaccaagaagatgaagaaggccctgctcagcacccccatgaagtgggggaagaagctgtacgagctgttcgccgacgactccttccagcagaaccggatctacatgcaccccgccgtgctcacggcgggccgcatcagcgagatgggggtgtgcttcggcaccatccccgtcgccaacccggacgacgccgcccagggctccgggcacaccaagagcatcctgaacctgcggaccaacacggagaccaacaacccctgcgccaagaccatcgtgaagctgttcgagatccagaagaccggcttcaacatccaggacatggacatcgtcgcgtccgagcacctcctgcaccagagcctcgtggggaagcagtcccccttccagaacgcctacaacgtgaagggcaacgccacgagcgccaacatcatctga

SEQ ID NO: 6652 - RNA, 1449 nt, synthetic construct
  misc_feature 1..1449: note = derived and/or modified CDS sequence (opt1) from CCHFV(K323_27)__KX013473.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacagcggcaccatcaagtcctgggacgagaactacgccgagctcaaggtggacgtccccaagatcgagcagctggccaactaccagcaggccgcgctgaagtggcgcaaggacatcgggttccgggtgaacgccaacacggccgccctcagcaacaaggtgctggccgagtacaaggtccccggcgagatcgtgatgtccgtgaaggagatgctgagcgacatgatccgccggcgcaacctcatcctgaaccggggcggggacgagaacccccgcggcccggtctcccgggagcacgtggagtggtgccgcgagttcgtgaaggggaagtacatcatggcgttcaacccgccctggggcgacatcaacaagagcgggcggtccggcatcgccctggtcgccaccggcctcgccaagctggccgagaccgaggggaagggcgtgttcgacgaggcgaagaagaccgtggaggccctgaacgggtacctcgacaagcaccgcgacgaggtcgacaaggccagcgccgactccatgatcacgaacctgctgaagcacatcgccaaggcgcaggagctctacaagaacagctccgccctgcgggcccagggcgcccagatcgacacccccttcagcagcttctactggctgtacaaggccggcgtgacccccgagaccttccccacgatctcccagttcctcttcgagctggggaagcagccccgcggcaccaagaagatgaagaaggcgctgctcagcacccccatgaagtgggggaagaagctgtacgagctgttcgccgacgactccttccagcagaaccggatctacatgcacccggccgtgctcaccgccggccgcatcagcgagatgggggtctgcttcggcacgatccccgtggcgaaccccgacgacgccgcccagggctccgggcacaccaagagcatcctgaacctgcggacctccaccgagacgaacaacccctgcgccaagaccatcgtgaagctgttcgagatccagaagaccggcttcaacatccaggacatggacatcgtcgccagcgagcacctcctgcaccagtccctcgtggggaagcagagcccgttccagaacgcgttcaacgtcaagggcaacgccacctccgccaacatcatctga

SEQ ID NO: 6653 - RNA, 1449 nt, synthetic construct
  misc_feature 1..1449: note = derived and/or modified CDS sequence (opt1) from CCHFV(Min)__KX013482.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacagcggcaccatcaagtcctgggacgagaactacgccgagctcaaggtggacgtccccaagatcgagcagctggccaactaccagcaggccgcgctgaagtggcgcaaggacatcgggttccgggtgaacgccaacacggccgccctcagcaacaaggtgctggccgagtacaaggtccccggcgagatcgtgatgtccgtgaaggagatgctgagcgacatgatccgccggcgcaacctcatcctgaaccggggcggggacgagaacccccgcggcccggtctcccgggagcacgtggagtggtgccgcgagttcgtgaaggggaagtacatcatggcgttcaacccgccctggggcgacatcaacaagctggggcggagcggcatcgccctcgtcgccaccggcctggccaagctggccgagaccgaggggaagggcgtgttcgacgaggcgaagaagaccgtggaggccctcaacgggtacctggacaagcaccgcgacgaggtcgacaaggcctccgccgacagcatgatcacgaacctgctcaagcacatcgccaaggcgcaggagctgtacaagaactccagcgccctgcgggcccagggcgcccagatcgacacccccttctccagcttctactggctctacaaggccggcgtgacccccgagaccttccccacgatcagccagttcctgttcgagctggggaagcagccccgcggcaccaagaagatgaagaaggcgctcctgtccacccccatgaagtgggggaagaagctgtacgagctgttcgccgacgacagcttccagcagaaccggatctacatgcacccggccgtgctgaccgccggccgcatctccgagatgggggtctgcttcggcacgatccccgtggcgaaccccgacgacgccgcccagggcagcgggcacaccaagtccatcctgaacctccggaccagcaccgagacgaacaacccctgcgccaagaccatcgtgaagctgttcgagatccagaagaccggcttcaacatccaggacatggacatcgtcgcctccgagcacctcctccaccagagcctggtggggaagcagtccccgttccagaacgcgtacaacgtcaagggcaacgccaccagcgccaacatcatctga

SEQ ID NO: 6654 - RNA, 1449 nt, synthetic construct
  misc_feature 1..1449: note = derived and/or modified CDS sequence (opt1) from CCHFV(Saf)__KX013488.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacagcggcaccatcaagtcctgggacgagaactacgccgagctcaaggtggacgtccccaagatcgagcagctggccaactaccagcaggccgcgctgaagtggcgcaaggacatcgggttccgggtgaacgccaacacggccgccctcagcaacaaggtgctggccgagtacaaggtccccggcgagatcgtgatgtccgtgaaggagatgctgagcgacatgatccgccggcgcaacctcatcctgaaccggggcggggacgagaacccccgcggcccggtctcccgggagcacgtggagtggtgccgcgagttcgtgaaggggaagtacatcatggcgttcaacccgccctggggcgacatcaacaagagcgggcggtccggcatcgccctggtcgccaccggcctcgccaagctggccgagaccgaggggaagggcgtgttcgacgaggcgaagaagaccgtggaggccctgaacgggtacctcgacaagcaccgcgacgaggtcgacaaggccagcgccgactccatgatcacgaacctgctgaagcacatcgccaaggcgcaggagctctacaagaacagctccgccctgcgggcccagggcgcccagatcgacacccccttcagcagcttctactggctgtacaaggccggcgtgacccccgagaccttccccacgatctcccagttcctcttcgagctggggaagcagccccgcggcaccaagaagatgaagaaggcgctgctcagcacccccatgaagtgggggaagaagctgtacgagctgttcgccgacgactccttccagcagaaccggatctacatgcacccggccgtgctcaccgccggccgcatcagcgagatgggggtctgcttcggcacgatccccgtggcggaccccgacgacgccgcccagggctccgggcacaccaagagcatcctgaacctgcggacctccaccgagacgaacaacccctgcgcccgcaccatcgtgaagctgttcgagatccagaagaccggcttcaacatccaggacatggacatcgtcgccagcgagcacctcctgcaccagtccctcgtggggaagcagagcccgttccagaacgcgtacaacgtcaagggcaacgccacctccgccaacatcatctga

SEQ ID NO: 6655 - RNA, 1449 nt, synthetic construct
  misc_feature 1..1449: note = derived and/or modified CDS sequence (opt1) from CCHFV(UCCR4459)__KY484031.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccgggtaccagcaggccgcgctgaagtggcggaaggacatcggcttccgcgtgaacgccaacaccgccgccctcagccacaaggtcctggccgagtacaaggtgcccggcgagatcgtgatgtccgtcaaggagatgctgagcgacatgatccggcgccggaacctcatcctgaaccgcgggggcgacgagaacccccgggggccggtgtcccgcgagcacgtggagtggtgccgggagttcgtcaagggcaagtacatcatggcgttcaacccgccctggggcgacatcaacaagctggggcgcagcggcatcgccctcgtggccaccgggctggccaagctggccgagaccgagggcaagggggtgttcgacgaggcgaagaagacggtcgaggccctcaacggctacctggacaagcacaaggacgaggtggacaaggcctccgccgacaacatgatcaccaacctgctcaagcacatcgccaaggcgcaggagctgtacaagaacagctccgccctgcgggcccagggcgcccagatcgacaccgccttcagctcctactactggctctacaaggcgggggtgacccccgagacgttccccaccgtcagccagttcctgttcgagctgggcaagcagccccgcgggaccaagaagatgaagaaggccctcctgagcacccccatgaagtggggcaagaagctgtacgagctgttcgccgacgactccttccagcagaaccggatctacatgcaccccgccgtgctgacggcggggcgcatcagcgagatgggcgtgtgcttcggcaccatcccggtcgccaaccccgacgacgccgcccaggggtccggccacaccaagagcatcctgaacctccggaccaacacggagaccaacaacccctgcgccaagaccatcgtgaagctgttcgagatccagaagaccgggttcaacatccaggacatggacatcgtcgcgtccgagcacctcctccaccagagcctggtgggcaagcagtcccccttccagaacgcctacaacgtgaaggggaacgccacgagcgccaacatcatctga

SEQ ID NO: 6656 - RNA, 1449 nt, synthetic construct
  misc_feature 1..1449: note = derived and/or modified CDS sequence (opt1) from CCHFV(YL16070)__KY354080.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccgactaccagcaggccgcgctgaagtggcggaaggacatcgggttccgcgtgaacgccaacaccaccgccctcagccacaaggtcctggccgagtacaaggtgcccggcgagatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaagtacatcatggccttcaacccgccctggggcgacatcaacaagagcgggcgctccggcatcgcgctggtggccaccggcctcgccaagctggccgagacggaggggaagggcgtgttcgacgaggccaagaagaccgtcgaggcgctgaacgggtacctcaacaagcacaaggacgaggtggacaaggccagcgccgactccatgatcaccaacctgctgaagcacatcgccaaggcccaggagctctacaagaacagctccgcgctgcgggcccagggcgcccagatcgacaccgccttcagcagctactactggctgtacaaggccggcgtgacgcccgagaccttccccaccgtctcccagttcctcttcgagctggggaagcagccccgcggcaccaagaagatgaagaaggcgctgctcagcacgcccctgaagtgggggaagcggctgtacgagctgttcgccgacgactccttccagcagaaccgcatctacatgcaccccgccgtgctgaccgccggccggatcagcgagatgggggtgtgcttcggcaccatcccggtcgcgaaccccgacgacgccgcccagggctccgggcacaccaagagcatcctgaacctccgcacgaacaccgagaccaacaacccctgcgccaagaccatcgtgaagctgttcgagatccagaagacgggcttcaacatccaggacatggacatcgtcgcctccgagcacctcctccaccagagcctggtggggaagcagtcccccttccagaacgcgtacaacgtgaagggcaacgccaccagcgccaacatcatctga

SEQ ID NO: 6657 - RNA, 1449 nt, synthetic construct
  misc_feature 1..1449: note = derived and/or modified CDS sequence (opt1) from CCHFV(66019)__AJ010648.1__N
  source 1..1449: mol_type = other RNA
atggagaacaagatcgaggtgaacaacaaggacgagatgaaccgctggttcgaggagttcaagaagggcaacgggctggtcgacaccttcaccaacagctactccttctgcgagagcgtgcccaacctcgaccggttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccagctaccagcaggccgcgctgaagtggcgcaaggacatcgggttccgggtgaacgccaacaccgccgccctctcccacaaggtcctggccgagtacaaggtgcccggcgagatcgtgatgagcgtcaaggagatgctgtccgacatgatccgccggcgcaacctcatcctgaaccggggcggggacgagaacccccgcggcccggtgagccgggagcacgtggagtggtgccgcgagttcgtcaaggggaagtacatcatggcgttcaacccgccctggggcgacatcaacaagtccgggcggagcggcatcgccctggtggccaccggcctcgccaagctggccgagaccgaggggaagggcgtgttcgacgaggcgaagaagacggtcgaggccctgaacgggtacctcgacaagcacaaggacgaggtggacaaggcctccgccgacaacatgaccaccaacctgctgaagcacatcgccaaggcgcaggagctctacaagaacagctccgccctgcgcgcccagggcgcccagatcgacaccgccttcagcagctactactggctgtacaaggcgggcgtgacgcccgagaccttccccaccgtctcccagttcctcttcgagctggggaagcagccccggggcaccaagaagatgaagaaggccctgctcagcacgcccatgaagtgggggaagaagctgtacgagctgttcgccgacgactccttccagcagaaccgcatctacatgcaccccgccgtgctcaccgcgggccggatcagcgagatgggggtgtgcttcggcaccatcccggtcgccgaccccgacgacgccgcccagggctccgggcacaccaagagcatcctgaacctgcgcacgaacaccgagaccaacaacccctgcgccaagaccatcgtgaagctgttcgagatccagaagacgggcttcaacatccaggacatggacatcgtcgcgtccgagcacctcctgcaccagagcctcgtggggaagcagtcccccttccagaacgcctacaacgtgaagggcaacgccaccagcgccaacatcatctga

SEQ ID NO: 6658 - RNA, 1449 nt, synthetic construct
  misc_feature 1..1449: note = derived and/or modified CDS sequence (opt1) from CCHFV(8402)__AJ010649.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgagcgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccaactaccagcaggccgcgctgaagtggcggaaggacatcgggttccgcgtgaacgccaacaccgccgccctcagccacaaggtcctggccgagtacaaggtgcccggcgagatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaagtacatcatggcgttcaacccgccctggggcgacatcaacaagagcgggcgctccggcatcgccctggtggccaccggcctcgccaagctggccgagaccgaggggaagggcgtgttcgacgaggcgaagaagacggtcgaggccctgaacgggtacctcgacaagcacaaggacgaggtggacaaggccagcgccgacaacatgatcaccaacctgttcaagcacatcgccaaggcgcaggagctgtacaagaacctctccgccctgggcgcccagggcgcccagatcgacaccgccttcagctcctactactggctgtacaaggcgggggtgacccccgagacgttccccaccgtcagccagttcctcttcgagctgggcaagcagccccgggggaccaagaagatgaagaaggccctgctcagcacccccatgaagtggggcaagaagctgtacgagctgttcgccgacgactccttccagcagaaccgcatctacatgcaccccgccgtgctcacggcggggcggatcagcgagatgggcgtgtgcttcggcaccatcccggtcgccaaccccgacgacgccgcccaggggtccggccacaccaagagcatcctgaacctgcgcaccaacacggagaccaacaacccctgcgccaagaccatcgtgaagctgttcgagatccagaagaccgggttcaacatccaggacatggacatcgtcgcgtccgagcacctcctgcaccagagcctcgtgggcaagcagtcccccttccagaacgcctacaacgtgaaggggaacgccacgagcgccaacatcatctga

SEQ ID NO: 6659 - RNA, 1449 nt, synthetic construct
  misc_feature 1..1449: note = derived and/or modified CDS sequence (opt1) from CCHFV(Bul/HU517)__AY277676.2__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacagcggcgccatcaagtcctgggacgagaactacgtggagctcaaggtcgacgtgcccaagatcgagcagctggccaactaccagcaggccgcgctgaagtggcgcaaggacatcgggttccgggtgaacgccaacaccgccgccctcagcaacaaggtcctggccgagtacaaggtgcccggcgagatcgtgatgtccgtcaaggagatgctgagcgacatgatccgccggcgcaacctcatcctgaaccggggctccgacgagaacccccgcgggccggtgagccacgagcacgtggagtggtgccgggagttcgtcaagggcaagtacatcatggcgttcaacccgccctggggcgacatcaacaagtccgggcgcagcgggatcgccctggtggccacgggcctcgccaagctggccgagaccgagggcaagggggtgttcgacgaggcgaagaagaccgtcgaggccctgaacggctacctcgacaagcaccgggacgaggtggacaaggcctccgccgacagcatgatcaccaacctgctgaagcacatcgccaaggcgcaggagctctacaagaactccagcgccctgcgcgcccagggggcccagatcgacacgcccttcagctccttctactggctgtacaaggccggcgtgacccccgagaccttccccaccatcagccagttcctcttcgagctgggcaagcagccccgggggacgaagaagatgaagaaggcgctgctctccacccccatgaagtggggcaagaagctgtacgagctgttcgccgacgacagcttccagcagaaccgcatctacatgcacccggccgtcctcaccgccgggcggatctccgagatgggcgtgtgcttcgggaccatccccgtggcgaaccccgacgacgccgcccagggcagcggccacacgaagtccatcctgaacctgcgcaccagcaccgagaccaacaacccctgcgccaagacgatcgtcaagctgttcgagatccagaagaccgggttcaacatccaggacatggacatcgtggcctccgagcacctcctgcaccagagcctcgtcggcaagcagtccccgttccagaacgcgtacaacgtgaaggggaacgccaccagcgccaacatcatctga

SEQ ID NO: 6660 - RNA, 1449 nt, synthetic construct
  misc_feature 1..1449: note = derived and/or modified CDS sequence (opt1) from CCHFV(V46/13)__KR011837.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacagcggcaccatcaagtcctgggacgagaactacgccgagctcaaggtggacgtccccaagatcgagcagctggccaactaccagcaggccgcgctgaagtggcgcaaggacatcgggttccgggtgaacgccaacacggccgccctcagcaacaaggtgctggccgagtacaaggtccccggcgagatcgtgatgtccgtgaaggagatgctgagcgacatgatccgccggcgcaacctcatcctgaaccggggctccgacgagaacccccgcgggccggtcagccgggagcacgtggagtggtgccgcgagttcgtgaagggcaagtacatcatggcgttcaacccgccctggggcgacatcaacaagtccgggcggagcgggatcgccctggtcgccaccggcctcgccaagctggccgagaccgagggcaagggggtgttcgacgaggcgaagaaggccgtggaggccctgaacggctacctcgacaagcaccgcgacgaggtcgtgaaggcctccgccgacagcatgatcaccaacctgctgaagcacatcgcgaaggcccaggagctctacaagaactccagcgccctgcgggcccagggggcccagatcgacacgcccttcagctccttctactggctgtacaaggcgggcgtgacccccgagaccttccccaccatcagccagttcctcttcgagctgggcaagcagccccgcgggacgaagaagatgaagaaggccctgctctccacccccatgaagtggggcaagaagctgtacgagctgttcgccgacgacagcttccagcagaaccggatctacatgcacccggccgtcctcaccgcggggcgcatctccgagatgggcgtgtgcttcgggaccatccccgtggccaaccccgacgacgccgcccagggcagcggccacacgaagtccatcctgaacctgcggaccagcaccgagaccaacaacccctgcgccaagacgatcgtcaagctgttcgagatccagaagaccgggttcaacatccaggacatggacatcgtggcgtccgagcacctcctgcaccagagcctcgtcggcaagcagtccccgttccagaacgcctacaacgtgaaggggaacgccaccagcgccaacatcatctga

SEQ ID NO: 6661 - RNA, 1449 nt, synthetic construct
  misc_feature 1..1449: note = derived and/or modified CDS sequence (opt1) from CCHFV(1231-CR/TI-2015)__KU161587.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacagcggcaccatcaagtcctgggacgagaactacgccgagctcaaggtggacgtccccaagatcgagcagctggccaactaccagcaggccgcgctgaagtggcgcaaggacatcgggttccgggtgaacgccaacacggccgccctcagcaacaaggtgctggccgagtacaaggtccccggcgagatcgtgatgtccgtgaaggagatgctgagcgacatgatccgccggcgcaacctcatcctgaaccggggcggggacgagaacccccgcggcccggtctcccgggagcacgtggagtggtgccgcgagttcgtgaaggggaagtacatcatggcgttcaacccgccctggggcgacatcaacaagagcgggcggtccggcatcgccctggtcgccaccggcctcgccaagctggccgagaccgaggggaagggcgtgttcgacgaggcgaagaagaccgtggaggccctgaacgggtacctcgacaagcaccgcgacgaggtcgacaaggccagcgccgactccatgatcacgaacctgctgaagcacatcgccaaggcgcaggagctctacaagaacagctccgccctgcgggcccagggcgcccagatcgacacccccttcagcagcttctactggctgtacaaggccggcgtgacccccgagaccttccccacgatctcccagttcctcttcgagctggggaagcagccccgcggcaccaagaagatgaagaaggcgctgctcagcacccccatgaagtgggggaagaagctgtacgagctgttcgccgacgactccttccagcagaaccggatctacatgcacccggccgtgctcaccgccggccgcatcagcgagatgggggtctgcttcggcacgatccccgtggcgaaccccgacgacgccgcccagggctccgggcacaccaagagcatcctgaacctgcggacctccaccgagacgaacaacccctgcgccaagaccatcgtgaagctgttcgagatccagaagaccggcttcaacatccaggacatggacatcgtcgccagcgagcacctcctgcaccagtccctcgtggggaagcagagcccgttccagaacgcgtacaacgtcaagggcaacgccacctccgccaacatcatctga

SEQ ID NO: 6662 - RNA, 1449 nt, synthetic construct
  misc_feature 1..1449: note = derived and/or modified CDS sequence (opt1) from CCHFV(AP92)__U04958.1__N
  source 1..1449: mol_type = other RNA
atggagaacaagatcgaggtgaacagcaaggacgacctgaacaagtggttcgaggagttcaagaagggcaacgggctcgtcgacaccttcaccaactcctacagcttctgcgagaacgtgcccaacctggaccgcttcgtgtaccagatggcctccgccacggacgacgcgcagaaggacagcatctacgcctccgccctggtcgaggccaccaagtactgcgccccgatctacgagtgcgcgtgggtgagctccaccggcatcgtgaagaaggggctcgagtggttcgagaagaacaccagcacgatcaagtcctgggacgagagctacaccgagctgaaggtcgacatccccaagatcgagcagctgtccagctaccagcaggccgccctcaagtggcggaaggacatcggcttccgcatcaacgccaacaccaccgcgctgtccaacaaggtgctggccgagtacaaggtgcccggggagatcctcgtccccgtgaaggagatgctgagcgacatgatccggcgccggaacatcatcctgaaccgcggctccgacgagaacccgcggggccccgtgagccacgagcacatcgagtggtgccgcgagttcatcaaggggaagtacatcatggccttcaacccgccctggggcgacatcaacaagtccgggcggagcggcatcgccctcgtcgccacggggctggcgaagctggccgagaccgagggcaagggcgtgttcgaggaggccaagaagaccgtggaggccctcaaggactacctggacaagcaccgcgacgaggtcgacaagacctccgccgacaacatggtgacgagcctgctcaagcacatcgcgaaggcccaggagctgtacaagaacagctccgccctgcgggcccagggggcccagatcgacacccccttcagctccttctactggctctacaaggcgggcgtgacccccgagaccttccccacggtcagccagttcctgttcgagctggggaagcagccccgcggcaccaagaagatgaagaaggccctcctgtccaccccgatgaagtggggcaagaagcactacgagctgttcgccgacgacagcttccagcagaaccggatctacatgcaccccgccgtgctcaccgccgggcgcatctccgagatgggcgtgtgcttcgggacgatccccgtcgcgaaccccgacgacgccgcccagggcagcgggcacaccaagtccatcctgaacctgcggaccaacaccgagagcaacaacccgtgcgcccgcacgatcgtgaagctgttcgagatccagaagaccggcttcgacatcaaggacatggacatcgtggcgtccgagcacctcctgcaccagagcctcgtcggcaagcagtcccccttccagaacgcctacaacgtgaaggggaacgccaccagcgccaacatcatctga

SEQ ID NO: 6663 - RNA, 1449 nt, synthetic construct
  misc_feature 1..1449: note = derived and/or modified CDS sequence (opt1) from CCHFV(C68031)__M86625.1__N
  source 1..1449: mol_type = other RNA
atggagaacaagatcgaggtgaacaacaaggacgagatgaacaagtggttcgaggagttcaagaagggcaacgggctggtcgacaccttcaccaacccctacagcttctgcgagtccgtgccgaacctcgagcgcttcgtgttccagatggccagcgccacggacgacgcgcagaaggactccatctacgccagcgccctggtcgaggccaccaagttctgcgcccccatctacgagtgcgcgtgggtgtccagcaccggcatcgtgaagaaggggctggagtggttcgagaagaacgccggcaccatcaagtcctgggacgagagctacatcgagctcaaggtcgaggtgcccaagatcgagcagctggccaactaccagcaggccgcgctgaagtggcggaaggacatcgggttccgcgtgaacgccaacacggccgccctctcccacaaggtcctggccgagtacaaggtgcccggcgagatcgtgatgagcgtcaaggagatgctgtccgacatgatccggcgccggaacctcatcctgaaccgcggcggggacgagaacccgcggggccccgtgagccgcgagcacgtggagtggtgccgggagttcgtcaaggggaagtacatcatggcgttcaacccgccctggggcgacatcaacaagtccgggcgcagcggcatcgccctggtggccaccggcctcgccaagctggccgagaccgaggggaagggcgtgttcgacgaggcgaagaagaccgtcgaggccctgaacgggtacctcgacaagcacaaggacgaggtggacaaggcctccgccgacaacatgatcacgaacctgctgaagcacatcgccaaggcgcaggagctctacaagaacagctccgccctgcgggcccagggcgcccagatcgacaccgccttcagctcctactactggctgtacaaggcgggcgtgacccccgagaccttccccacggtcagccagttcctcttcgagctggggaagcagccccgcggcaccaagaagatgaagaaggccctgctcagcacccccatgaagtgggggaagaagctgtacgagctgttcgccgacgactccttccagcagaaccggatctacatgcacccggccgtgctcaccgcgggccgcatcagcgagatgggggtgtgcttcggcacgatccccgtcgccaaccccgacgacgccgcccagggctccgggcacaccaagagcatcctgaacctgcggaccaacaccgagacgaacaacccctgcgccaagaccatcgtgaagctgttcgagatccagaagaccggcttcaacatccaggacatggacatcgtcgcgtccgagcacctcctgcaccagagcctcgtggggaagcagtccccgttccagaacgcctacaacgtgaagggcaacgccaccagcgccaacatcatctga

SEQ ID NO: 6664 - RNA, 1449 nt, synthetic construct
  misc_feature 1..1449: note = derived and/or modified CDS sequence (opt1) from CCHFV(1-CR/HU-2015)__KU161586.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgtaccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacagcggcaccatcaagtcctgggacgagaactacgccgagctcaaggtggacgtccccaagatcgagcagctggccaactaccagcaggccgcgctgaagtggcgcaaggacatcgggttccgggtgaacgccaacacggccgccctcagcaacaaggtgctggccgagtacaaggtccccggcgagatcgtgatgtccgtgaaggagatgctgagcgacatgatccgccggcgcaacctcatcctgaaccggggcggggacgagaacccccgcggcccggtctcccgggagcacgtggagtggtgccgcgagttcgtgaaggggaagtacatcatggcgttcaacccgccctggggcgacatcaacaagagcgggcggtccggcatcgccctggtcgccaccggcctcgccaagctggccgagaccgaggggaagggcgtgttcgacgaggcgaagaagaccgtggaggccctgaacgggtacctcgacaagcaccgcgacgaggtcgacaaggccagcgccgactccatgacgaccaacctgctgaagcacatcgccaaggcgcaggagctctacaagaacagctccgccctgcgggcccagggcgcccagatcgacacccccttcagcagcttctactggctgtacaaggccggcgtgacccccgagacgttccccaccatctcccagttcctcttcgagctggggaagcagccccgcggcaccaagaagatgaagaaggcgctgctcagcacccccatgaagtgggggaagaagctgtacgagctgttcgccgacgactccttccagcagaaccggatctacatgcacccggccgtgctcacggccggccgcatcagcgagatgggggtctgcttcggcaccatccccgtggcgaaccccgacgacgccgcccagggctccgggcacaccaagagcatcctgaacctgcggacctccacggagaccaacaacccctgcgccaagaccatcgtgaagctgttcgagatccagaagaccggcttcaacatccaggacatggacatcgtcgccagcgagcacctcctgcaccagtccctcgtggggaagcagagcccgttccagaacgcgtacaacgtcaagggcaacgccacgtccgccaacatcatctga

SEQ ID NO: 6665 - RNA, 1449 nt, synthetic construct
  misc_feature 1..1449: note = derived and/or modified CDS sequence (opt1) from CCHFV(36-ST-2014)__KR814838.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacaccggcacgatcaagagctgggacgacaactacgccgagctcaaggtggacgtccccaagatcgagcagctggccaactaccagcaggccgcgctgaagtggcgcaaggacatcgggttccgggtgaacgccaacaccgccgccctctccaacaaggtgctggccgagtacaaggtccccggcgagatcgtgatgagcgtgaaggagatgctgtccgacatgatccgccggcgcaacctcatcctgaaccggggcggggacggcaacccccgcgggccggtcagccacgagcacgtggagtggtgccgggagttcgtgaagggcaagtacatcatggcgttcaacccgccctggggcgacatcaacaagtccgggcgcagcggcatcgccctggtcgccaccgggctcgccaagctggccgagaccgagggcaagggggtgttcgacgaggcgaagcggacggtggaggccctgaacggctacctcgacaagcaccgcgacgaggtcgacaaggcctccgccgacagcatgatcaccaacctgctgaagcacatcgccaaggcgcaggagctctacaagaactccagcgccctgcgggcccagggcgcccagatcgacacccccttctccagcttctactggctgtacaaggccggggtgacccccgagacgttccccaccatcagccagttcctcttcgagctgggcaagcagccccgcgggaccaagaagatgaagaaggcgctgctctccacccccatgaagtggggcaagaagctgtacgagctgttcgccgacgacagcttccagcagaaccggatctacatgcacccggccgtgctcacggccgggcgcatctccgagatgggcgtctgcttcggcaccatccccgtggcgaaccccgacgacgccgcccaggggagcggccacaccaagtccatcctgaacctgcggaccagcacggagaccaacaacccctgcgccaagaccatcgtgaagctgttcgagatccagaagaccgggttcaacatccaggacatggacatcgtcgcctccgagcacctcctgcaccagagcctcgtgggcaagcagtccccgttccagaacgcgtacaacgtcaaggggaacgccacgagcgccaacatcatctga

SEQ ID NO: 6666 - RNA, 1449 nt, synthetic construct
  misc_feature 1..1449: note = derived and/or modified CDS sequence (opt1) from CCHFV(37-ST-2009)__KR814835.1__N
  source 1..1449: mol_type = other RNA
atggagaacaagatcgtggtcaacagcaaggacgagatgaacaagtggttcgaggagttcaagaaggtgaacggcctggtggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccgggatcgtgaagaagggcctggagtggttcgagaagaacgccgggaccatcaagagctgggacgagtcctacacggagctcaaggtggacgtccccaagatcgagcagctggccagctaccagcaggccgcgctgaagtggcgcaaggacatcggcttccgggtgaacgccaacaccgccgccctctccagcaaggtgctgtccgagtacaaggtccccggggaggtggtgatgcccgtcaaggagatgctgagcgacatgatccgccggcgcaacctcatcctgaaccggggctccgacgagaacccgcgcggccccgtgagccgggagcacgtggagtggtgccgcgagttcgtcaaggggaagtacatcatggccttcaacccgccctggggcgacatcaacaagtccgggcggagcggcatcgcgctggtggccaccgggctcgccaagctggccgagaccgagggcaagggcatcttcgaggaggcccgcaagacggtggacgcgctgaaggactacctcgaccggcacaaggaggaggtcgacaagaccaacgccgacaacatggtgaccaacctgttcaagcacatcgccaaggcccaggagctgtacaagaactccagcgccctccgcgcgcagggggcccagatcgacacccccttcagctccttctactggctgtacaaggccggcgtgacgcccgagaccttccccaccgtcagccagttcctgttcgagctcgggaagcagccccggggcacccgcaagatgaagaaggccctgctgtccacgccgatgaagtggggcaagaagctctacgagctgttcgccgacgacagcttccagcagaaccggatctacatgcaccccgcggtgctgaccgccgggcgcgtctccgagatgggcgtgtgcttcgggaccatccccgtggacaaccccgacgacgccgcccagggcagcgggcacaccaagtccatcctcaacctgcggacgagcgcggagaccaacaacccgtgcgcccgcaccatcgtcaagctgttcgagatccagaaggccggcttcaacatccaggagatggacatcgtggcctccgagcacctcctgcaccagagcctggtgggcaagcagtcccccttccagaacgcctacaacgtcaaggggaacgcgaccagcgccaacatcatctga

SEQ ID NO: 6667 - RNA, 1449 nt, synthetic construct
  misc_feature 1..1449: note = derived and/or modified CDS sequence (opt1) from CCHFV(59-TK-2012)__KR814833.1__N
  source 1..1449: mol_type = other RNA
atggagaacaagatcgtggtcaacagcaaggacgagatgaacaagtggttcgaggagttcaagaaggtgaacggcctggtggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccgggatcgtgaagaagggcctggagtggttcgagaagaacaccgggacgatcaagagctgggacgagtcctacaccgagctcaaggtggacgtccccaagatcgagcagctggccagctaccagcaggccgccctgaagtggcgcaaggacatcggcttccgggtgaacgcgaacaccgccgccctctccagcaaggtgctgtccgagtacaaggtccccggggagatcgtgatgcccgtgaaggagatgctgagcgacatgatccgccggcgcaacctcatcctgaaccggggctccgacgagaacccgcgcggccccgtcagccgggagcacgtggagtggtgccgcgagttcgtgaaggggaagtacatcatggccttcaacccgccctggggcgacatcaacaagtccgggcggagcggcatcgccctggtcgcgaccgggctcgccaagctggccgagacggagggcaagggcatcttcgaggaggcccgcaagaccgtggacgccctgaaggactacctcgaccggcacaaggaggaggtggacaagaccaacgcggacaacatggtcaccaacctgttcaagcacatcgccaaggcccaggagctgtacaagaactccagcgccctccgcgcccagggggcgcagatcgacacgcccttcagctccttctactggctgtacaaggccggcgtgacccccgagaccttccccaccgtgagccagttcctgttcgagctcgggaagcagccccggggcacgcgcaagatgaagaaggccctgctgtccaccccgatgaagtggggcaagaagctctacgagctgttcgccgacgacagcttccagcagaaccggatctacatgcaccccgccgtcctgaccgcggggcgcatctccgagatgggcgtgtgcttcgggaccatccccgtcgacaaccccgacgacgccgcccagggcagcgggcacacgaagtccatcctcaacctgcggaccagcgccgagaccaacaacccgtgcgcgaagaccatcgtgaagctgttcgagatccagaaggccggcttcaacatccaggagatggacatcgtggcctccgagcacctcctgcaccagagcctggtcggcaagcagtcccccttccagaacgcctacaacgtgaaggggaacgccacgagcgcgaacatcatctga

SEQ ID NO: 6668 - RNA, 1449 nt, synthetic construct
  misc_feature 1..1449: note = derived and/or modified CDS sequence (opt1) from CCHFV(73-ST-2013)__KR814836.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgacaagttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgacgtgcccaagatcgagcagctggccaactaccagcaggccgcgctgaagtggcgcaaggacatcgggttccgggtgaacgccaacaccgccgccctcagcaacaaggtcctggccgagtacaaggtgcccggcgagatcgtgatgtccgtcaaggagatgctgagcgacatgatccgccggcgcaaccagatcctcaaccggggcggggacgagaacccccgcggcccggtgtcccgggagcacgtggactggtgccgcgagttcgtcaaggggaagtacatcatggcgttcaacccgccctggggcgacatcaacaagagcgggcggtccggcatcgccctggtggccaccggcctggccaagctcgccgagaccgaggggaagggcgtgttcgacgaggcgaagaagacggtcgaggccctgaacgggtacctggacaagcacaaggacgaggtggaccgcgccagcgccgactccatgatcaccaacctcctgaagcacatcgccaaggcgcaggagctgtacaagaacagctccgccctccgggcccagggcgcccagatcgacaccgccttcagcagctactactggctgtacaaggcgggcgtgacccccgagacgttccccaccgtctcccagttcctgttcgagctcgggaagcagccccgcggcaccaagaagatgaagaaggccctgctgagcacccccatgaagtgggggaagaagctctacgagctgttcgccgacgactccttccagcagaaccggatctacatgcaccccgccgtgctgacggcgggccgcatcagcgagatgggggtgtgcttcggcaccatcccggtcgccaaccccgacgacgccgcccagggctccgggcacaccaagagcatcctcaacctgcggaccaacacggagaccaacaacccctgcgcccgcaccatcgtgaagctgttcgagatccagaagaccggcttcaacatccaggacatggacatcgtcgcgtccgagcacctcctgcaccagagcctggtggggaagcagtcccccttccagaacgcctacaacgtgaagggcaacgccacgagcgccaacatcatctga

SEQ ID NO: 6669 - RNA, 1449 nt, synthetic construct
  misc_feature 1..1449: note = derived and/or modified CDS sequence (opt1) from CCHFV(75-ST-2010)__KR814845.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacagcggcaccatcaagtcctgggacgagaactacgccgagctcaaggtggacgtccccaagatcgagcagctggccaactaccagcaggccgcgctgaagtggcgcaaggacatcgggttccgggtgaacgccaacacggccgccctcagcaacaaggtgctggccgagtacaaggtccccggcgagatcgtgatgtccgtgaaggagatgctgagcgacatgatccgccggcgcaacctcatcctgaaccggggctccgacgagaacccccgcgggccggtcagccgggagcacgtggagtggtgccgcgagttcgtgaagggcaagtacatcatggcgttcaacccgccctggggcgacatcaacaagtccgggcggagcgggatcgccctggtcgccaccggcctcgccaagctggccgagaccgagggcaagggggtgttcgacgaggcgaagaagaccgtggaggccctgaacggctacctcgacaagcaccgcgacgaggtcgacaaggcctccgccgacagcatgatcacgaacctgctgaagcacatcgccaaggcgcaggagctctacaagaactccagcgccctgcgggcccagggggcccagatcgacacccccttcagctccttctactggctgtacaaggccggcgtgacccccgagaccttccccacgatcagccagttcctcttcgagctgggcaagcagccccgcgggaccaagaagatgaagaaggcgctgctctccacccccatgaagtggggcaagaagctgtacgagctgttcgccgacgacagcttccagcagaaccggatctacatgcacccggccgtgctcaccgccgggcgcatctccgagatgggcgtctgcttcgggacgatccccgtggcgaaccccgacgacgccgcccagggcagcggccacaccaagtccatcctgaacctgcggaccagcaccgagacgaacaacccctgcgccaagaccatcgtgaagctgttcgagatccagaagaccgggttcaacatccaggacatggacatcgtcgcctccgagcacctcctgcaccagagcctcgtgggcaagcagtccccgttccagaacgcgtacaacgtcaaggggaacgccaccagcgccaacatcatctga

SEQ ID NO: 6670 - RNA, 1449 nt, synthetic construct
  misc_feature 1..1449: note = derived and/or modified CDS sequence (opt1) from CCHFV(CHH)__KU707898.1__N
  source 1..1449: mol_type = other RNA
atggagaacaagatcgaggtgaacagcaaggacgagatgaacaagtggttcgaggagttcaagaagggcaacgggctggtcgacaccttcaccaactcctacagcttctgcgagtccgtgcccaacctcgaccgcttcgtgttccagatggccagcgccacggacgacgcgcagaaggactccatctacgccagcgccctggtcgaggccaccaagttctgcgccccgatctacgagtgcgcgtgggcctccagcaccggcatcgtgaagaaggggctggagtggttcgagaagaacgccggcaccatcaagtcctgggacgagagctacacggagctcaaggtggaggtccccaagatcgagcagctgtccaactaccagcaggccgcgctgaagtggcggaaggacatcgggttccgcgtgaacgccaacaccgccgccctcagcaacaaggtgctggccgagtacaaggtccccggcgagatcgtgatgtccgtgaaggagatgctgagcgacatgatccggcgccggaacctcatcctgaaccgcggcggggacgagaacccccggggcccggtctcccgcgagcacgtggagtggtgccgggagttcgtgaaggggaagtacatcatggcgttcaacccgccctggggcgacatcaacaagagcgggcgctccggcatcgccctggtcgccaccggcctcgccaagctggccgagaccgaggggaagggcgtgttcgacgaggcgaagaagacggtggaggccctgaacgggtacctcgacaagcacaaggacgaggtcgacaaggccagcgccgactccatgatcaccaacctgctgaagcacatcgccaaggcgcaggagctctacaagaacagcagcgccctgcgggcccagggcgcccagatcgacaccgtgttctccagctactactggctgtacaaggccggcgtgacccccgacacgttccccaccgtctcccagttcctcttcgagctggggaagcagccccgcggcaccaagaagatgaagaaggcgctgctcagcacccccatgaagtgggggaagaagctgtacgagctgttcgccgacgactccttccagcagaaccggatctacatgcaccccgccgtgctcacggccggccgcatcagcgagatgggggtgtgcttcggcaccatcccggtcgcgaaccccgacgacgccgccctgggctccgggcacaccaagagcatcctgaacctccggaccaacacggagaccaacaacccctgcgccaagaccatcgtgaagctgttcgagatccagaagaccggcttcaacatccaggacatggacatcgtcgcctccgagcacctcctgcaccagagcctggtggggaagcagtcccccttccagaacgcgtacaacgtgaagggcaacgccacgagcgccaacatcatctga

SEQ ID NO: 6671 - RNA, 1449 nt, synthetic construct
  misc_feature 1..1449: note = derived and/or modified CDS sequence (opt1) from CCHFV(CJH)__KU707899.1__N
  source 1..1449: mol_type = other RNA
atggagaacaagatcgaggtgaagaacaagcacgagaagaacaagtggttcgaggagttcaagaagggcaacgggctggtcgacaccttcaccaacagctactccttctgcgagaacgtgcccaacctcgaccgcttcgtgttccagatggccggcgccacggacgacgcgcagaaggacagcatctacgcctccgccctggtcgaggccaccaagttctgcgccccgatctacgagtgcgcgtgggccagctccaccgggatcgtgaagaagggcctggagtggttcgagaagaacgccgggaccatcaagagctgggacgagtcctacacggagctcaaggtggaggtccccaagatcgagcagctgagcaactaccagcaggccgcgctgaagtggcggaaggacatcggcttccgcggcaacgccaacaccgccgccctctccaacaaggtgctggccgagtacaaggtgcccggggagatcgtcatgagcgtgaaggagatgctgtccgacatgatccggcgccggaacctcatcctgaaccgcggcggggacgagaacccccggggcccggtgagccgcgagcacgtcgagtggtgccgggagttcgtgaaggggaagtacatcatggcgttcaacccgccctggggcgacatcaacaagtccggccgcagcgggatcgccctggtggccaccggcctcgccaagctggccgagaccgaggggaagggcgtcttcgacgaggcgaagaagacggtggaggccctgaacggctacctcgacaagcacaaggacgaggtggacaaggcctccgccgacagcatgatcaccaacctgctgaagcacatcgccaaggcgcaggagctctacaagaactccagcgccctgcgggcccagggggcccagatcgacaccgtcttctccagctactactggctgtacaaggccggcgtgacccccgagacgttccccaccgtgagccagttcctcttcgagctggggaagcagccccgcggcaccaagaagatgaagaaggcgctgctctccacccccatgaagtgggggaagaagctgtacgagctgttcgccgacgacagcttccagcagaaccggatctacatgcaccccgccgtcctcacggccggccgcatctccgagatgggcgtgtgcttcgggaccatcccggtggcgaaccccgacgacgccgccctgggcagcgggcacaccaagtccatcctgaacctccggaccaacacggagaccaacaacccctgcgccaagaccatcgtcaagctgttcgagatccagaagaccggcttcaacatccaggacatggacatcgtggccagcgagcacctcctgcaccagtccctggtcgggaagcagagccccttccagaacgcgtacaacgtgaagggcaacgccacgtccgccaacatcatctga

SEQ ID NO: 6672 - RNA, 1449 nt, synthetic construct
  misc_feature 1..1449: note = derived and/or modified CDS sequence (opt1) from CCHFV(CLT/TI05146)__DQ227496.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccgactaccagcaggccgcgctgaagtggcggaaggacatcgggttccgcgtgaacgccaacaccaccgccctcagccacaaggtcctggccgagtacaaggtgcccggcgagatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaagtacatcatggccttcaacccgccctggggcgacatcaacaagagcgggcgctccggcatcgcgctggtggccaccggcctcgccaagctggccgagacggaggggaagggcgtgttcgacgaggccaagaagaccgtcgaggcgctgaacgggtacctcaacaagcacaaggacgaggtggacaaggccagcgccgactccatgatcaccaacctgctgaagcacatcgccaaggcccaggagctctacaagaacagctccgcgctgcgggcccagggcgcccagatcgacaccgccttcagcagctactactggctgtacaaggccggcgtgacgcccgagaccttccccaccgtctcccagttcctcttcgagctggggaagcagccccgcggcaccaagaagatgaagaaggcgctgctcagcacgcccctgaagtgggggaagaagctgtacgagctgttcgccgacgactccttccagcagaaccggatctacatgcaccccgccgtgctgaccgccggccgcatcagcgagatgggggtgtgcttcggcaccatcccggtcgcgaaccccgacgacgccgcccagggctccgggcacaccaagagcatcctgaacctccggacgaacaccgagaccaacaacccctgcgccaagaccatcgtgaagctgttcgagatccagaagacgggcttcaacatccaggacatggacatcgtcgcctccgagcacctcctccaccagagcctggtggggaagcagtcccccttccagaacgcgtacaacgtgaagggcaacgccaccagcgccaacatcatctga

SEQ ID NO: 6673 - RNA, 1449 nt, synthetic construct
  misc_feature 1..1449: note = derived and/or modified CDS sequence (opt1) from CCHFV(CYT/TI05099)__DQ227495.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccgactaccagcaggccgcgctgaagtggcggaaggacatcgggttccgcgtgaacgccaacaccaccgccctcagccacaaggtcctggccgagtacaaggtgcccggcgagatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaagtacatcatggccttcaacccgccctggggcgacatcaacaagagcgggcgctccggcatcgcgctggtggccaccggcctcgccaagctggccgagacggaggggaagggcgtgttcgacgaggccaagaagaccgtcgaggcgctgaacgggtacctcaacaagcacaaggacgaggtggacaaggccagcgccgactccatgatcaccaacctgctgaagcacatcgccaaggcccaggagctctacaagaacagctccgcgctgcgggcccagggcgcccagatcgacaccgccttcagcagctactactggctgtacaaggccggcgtgacgcccgagaccttccccaccgtctcccagttcctcttcgagctggggaagcagccccgcggcaccaagaagatgaagaaggcgctgctcagcacgcccctgaagtgggggaagaagctgtacgagctgttcgccgacgactccttccagcagaaccggatctacatgcaccccgccgtgctgaccgccggccgcatcagcgagatgggggtgtgcttcggcaccatcccggtcgcgaaccccgacgacgccgcccagggctccgggcacaccaagagcatccccaacctgcggacgaacaccgagaccaacaacccctgcgccaagaccatcgtgaagctgttcgagatccagaagacgggcttcaacatccaggacatggacatcgtcgcctccgagcacctcctccaccagagcctcgtggggaagcagtccccgttccagaacgcgtacaacgtgaagggcaacgccaccagcgccaacatcatctga

SEQ ID NO: 6674 - RNA, 1449 nt, synthetic construct
  misc_feature 1..1449: note = derived and/or modified CDS sequence (opt1) from CCHFV(Dubai 616)__JN108025.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggccggcgccacggacgacgcgcagaaggactccatctacgccagcgccctggtcgaggccaccaagttctgcgccccgatctacgagtgcgcgtgggtgtccagcaccgggatcgtgaagaagggcctggagtggttcgagaagaacgccgggaccatcaagtcctgggacgagagctacacggagctcaaggtcgaggtgcccaagatcgagcagctggccaactaccagcaggccgcgctgaagtggcggaaggacatcggcttccgcgtgaacgccaacaccgccgccctctcccacaaggtcctggccgagtacaaggtgcccggcgagatcgtgatgagcgtcaaggagatgctgtccgacatgatccggcgccggaacctcatcctgaaccgcgggggcgacgagaacccccgggggccggtgagccgcgagcacgtggagtggtgccgggagttcgtcaagggcaagtacatcatggcgttcaacccgccctggggcgacatcaacaagtccgggcgcagcggcatcgccctggtggccaccgggctcgccaagctggccgagaccgagggcaagggggtgttcgacgaggcgaagaagacggtcgaggccctgaacggctacctcgacaagcacaaggacgaggtggacaaggcctccgccgacaacatgatcaccaacctgctgaagcacatcgccaaggcgcaggagctctacaagaacagctccgccctgcgggcccagggcgcccagatcgacaccgccttcagctcctactactggctgtacaaggcgggggtgacccccgagacgttccccaccgtcagccagttcctcttcgagctgggcaagcagccccgcgggaccaagaagatgaagaaggccctgctcagcacccccatgaagtggggcaagaagctgtacgagctgttcgccgacgactccttccagcagaaccggatctacatgcaccccgccgtgctcacggcggggcgcatcagcgagatgggcgtgtgcttcggcaccatcccggtcgccaaccccgacgacgccgcccaggggtccggccacaccaagagcatcctgaacctgcggaccaacacggagaccaacaacccctgcgccaagaccatcgtgaagctgttcgagatccagaagaccgggttcaacatccaggacatggacatcgtcgcgtccgagcacctcctgcaccagagcctcgtgggcaagcagtcccccttccagaacgcctacaacgtgaaggggaacgccacgagcgccaacatcatctga

SEQ ID NO: 6675 - RNA, 1449 nt, synthetic construct
  misc_feature 1..1449: note = derived and/or modified CDS sequence (opt1) from CCHFV(GRH)__KU707900.1__N
  source 1..1449: mol_type = other RNA
atggagaacaagatcgaggtgaacagcaaggacgagatgaacaagtggttcgaggagttcaagaagggcaacgggctggtcgacaccttcaccaactcctacagcttctgcgagtccgtgcccaacctcgaccgcttcgtgttccagatggccagcgccacggacgacgcgcagaaggactccatctacgccagcgccctggtcgaggccaccaagttctgcgccccgatctacgagtgcgcgtgggcctccagcaccggcatcgtgaagaaggggctggagtggttcgagaagaacgccggcaccatcaagtcctgggacgagagctacacggagctcaaggtggaggtccccaagatcgagcagctgtccaactaccagcaggccgcgctgaagtggcggaaggacatcgggttccgcgtgaacgccaacaccgccgccctcagcaacaaggtgctggccgagtacaaggtccccggcgagatcgtgatgtccgtgaaggagatgctgagcgacatgatccggcgccggaacctcatcctgaaccgcggcggggacgagaacccccggggcccggtctcccgcgagcacgtggagtggtgccgggagttcgtgaaggggatgtacatcatggcgttcaacccgccctggggcgacatcaacaagagcgggcgctccggcatcgccctggtcgccaccggcctcgccaagctggccgagaccgaggggaagggcgtgttcgacgaggcgaagaagacggtggaggccctgaacgggtacctcgacaagcacaaggacgaggtcgacaaggccagcgccgactccatgatcaccaacctgctgaagcacatcgccaaggcgcaggagctctacaagaacagcagcgccctgcgggcccagggcgcccagatcgacaccgtgttctccagctactactggctgtacaaggccggcgtgacccccgacacgttccccaccgtctcccagttcctcttcgagctggggaagcagccccgcggcaccaagaagatgaagaaggcgctgctcagcacccccatgaagtgggggaagaagctgtacgagctgttcgccgacgactccttccagcagaaccggatctacatgcaccccgccgtgctcacggccggccgcatcagcgagatgggggtgtgcttcggcaccatcccggtcgcgaaccccgacgacgccgccctgggctccgggcacaccaagagcatcctgaacctccggaccaacacggagaccaacaacccctgcgccaagaccatcgtgaagctgttcgagatccagaagaccggcttcaacatccaggacatggacatcgtcgcctccgagcacctcctgcaccagagcctggtggggaagcagtcccccttccagaacgcgtacaacgtgaagggcaacgccacgagcgccaacatcatctga

SEQ ID NO: 6676 - RNA, 1449 nt, synthetic construct
  misc_feature 1..1449: note = derived and/or modified CDS sequence (opt1) from CCHFV(Iran-Gilan69)__KJ027521.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacagcggcaccatcaagtcctgggacgagaactacgccgagctcaaggtggacgtccccaagatcgagcagctggccagctaccagcaggccgcgctgaagtggcgcaaggacatcgggttccgggtgaacgccaacacggccgccctctccaacaaggtgctggccgagtacaaggtccccggcgagatcgtgatgagcgtgaaggagatgctgtccgacatgatccgccggcgcaacctcatcctgaaccggggcggggacgagaacccccgcggcccggtcagccgggagcacgtggagtggtgccgcgagttcgtgaaggggaagtacatcatggcgttcaacccgccctggggcgacatcaacaagtccgggcggagcggcatcgccctggtcgccaccggcctcgccaagctggccgagaccgaggggaagggcgtgttcgacgaggcgaagaagaccgtggaggccctgaacgggtacctcgacaagcaccgcgacgaggtcgacaaggcctccgccgacagcatgatcacgaacctgctgaagcacatcgccaaggcgcaggagctctacaagaactccagcgccctgcgggcccagggcgcccagatcgacacccccttcagctccttctactggctgtacaaggccggcgtgacccccgagaccttccccacgatcagccagttcctcttcgagctggggaagcagccccgcggcaccaagaagatgaagaaggcgctgctctccacccccatgaagtgggggaagaagctgtacgagctgttcgccgacgacagcttccagcagaaccggatctacatgcacccggccgtgctcaccgccggccgcatctccgagatgggggtctgcttcggcacgatccccgtggcgaaccccgacgacgccgcccagggcagcgggcacaccaagtccatcctgaacctgcggaccagcaccgagacgaacaacccctgcgccaagaccatcgtgaagctgttcgagatccagaagaccggcttcaacatccaggacatggacatcgtcgcctccgagcacctcctgcaccagagcctcgtggggaagcagtccccgttccagaacgcgtacaacgtcaagggcaacgccaccagcgccaacatcatctga

SEQ ID NO: 6677 - RNA, 1449 nt, synthetic construct
  misc_feature 1..1449: note = derived and/or modified CDS sequence (opt1) from CCHFV(Iran-Isfahan78)__KJ027522.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacagcggcaccatcaagtcctgggacgagaactacgccgagctcaaggtggacgtccccaagatcgagcagctggccaactaccagcaggccgcgctgaagtggcgcaaggacatcgggttccgggtgaacgccaacacggccgccctcagcaacaaggtgctggccgagtacaaggtccccggcgagatcgtgatgtccgtgaaggagatgctgagcgacatgatccgccggcgcaacctcatcctgaaccggggcggggacgagaacccccgcggcccggtctcccgggagcacgtggagtggtgccgcgagttcgtgaaggggaagtacatcatggcgttcaacccgccctggggcgacatcaacaagagcgggcggtccggcatcgccctggtcgccaccggcctcgccaagctggccgagaccgaggggaagggcgtgttcgacgaggcgaagaagaccgtggaggccctgaacgggtacctcgacaagcaccgcgacgaggtcgacaaggccagcgccgactccatgatcacgaacctgctgaagcacatcgccaaggcgcaggagctctacaagaacagctccgccctgcgggcccagggcgcccagatcgacacccccttcagcagcttctactggctgtacaaggccggcgtgacccccgagaccttccccacggtgtcccagttcctcttcgagctggggaagcagccccgcggcaccaagaagatgaagaaggcgctgctcagcacccccatgaagtgggggaagaagctgtacgagctgttcgccgacgactccttccagcagaaccggatctacatgcacccggccgtcctcaccgccggccgcatcagcgagatgggggtgtgcttcggcacgatccccgtggcgaaccccgacgacgccgcccagggctccgggcacaccaagagcatcctgaacctgcggacctccaccgagacgaacaacccctgcgccaagaccatcgtcaagctgttcgagatccagaagaccggcttcaacatccaggacatggacatcgtggccagcgagcacctcctgcaccagtccctcgtcgggaagcagagcccgttccagaacgcgtacaacgtgaagggcaacgccacctccgccaacatcatctga

SEQ ID NO: 6678 - RNA, 1449 nt, synthetic construct
  misc_feature 1..1449: note = derived and/or modified CDS sequence (opt1) from CCHFV(Iran-KhRazavi72)__KJ485700.1__N
  source 1..1449: mol_type = other RNA
atggagaacaagatcgaggtgaagaacaagcacgagaagaacaagtggttcgaggagttcaagaagggcaacgggctggtcgacaccttccccaacagctactccttctgcgagaacgtgccgaacctcgaccgcttcgtgttccagatggccggcgccaccgacgacgcgcagaaggacagcatctacgcctccgccctggtcgaggccacgaagttctgcgcccccatctacgagtgcgcgtgggccagctccaccgggatcgtgaagaagggcctggagtggttcgagaagaacgccgggaccatcaagagctgggacgagtcctacaccgagctcaaggtggaggtccccaagatcgagcagctgagcaactaccagcaggccgcgctgaagtggcggaaggacatcggcttccgcggcaacgccaacacggccgccctctccaacaaggtgctggccgagtacaaggtgcccggggagatcgtcatgagcgtgaaggagatgctgtccgacatgatccggcgccggaacctcatcctgaaccgcggcggggacgagaacccgcggggccccgtgagccgcgagcacgtcgagtggtgccgggagttcatcaaggggaagtacatcatggcgttcaacccgccctggggcgacatcaacaagtccggccgcagcgggatcgccctggtggccaccggcctcgccaagctggccgagaccgaggggaagggcgtgttcgacgaggcgaagaagaccgtcgaggccctgaacggctacctcgacaagcacaaggacgaggtggacaaggcctccgccgacagcatgatcacgaacctgctgaagcacatcgccaaggcgcaggagctctacaagaactccagcgccctgcgggcccagggggcccagatcgacaccgtgttctccagctactactggctgtacaaggccggcgtcacccccgagaccttccccacggtgagccagttcctcttcgagctggggaagcagccccgcggcaccaagaagatgaagaaggcgctgctctccacccccatgaagtgggggaagaagctgtacgagctgttcgccgacgacagcttccagcagaaccggatctacatgcacccggccgtgctcaccgccggccgcatctccgagatgggcgtctgcttcgggacgatccccgtggcgaaccccgacgacgccgccctgggcagcgggcacaccaagtccatcctgaacctccggaccaacaccgagacgaacaacccctgcgccaagaccatcgtgaagctgttcgagatccagaagaccggcttcaacatccaggacatggacatcgtcgccagcgagcacctcctgcaccagtccctggtggggaagcagagcccgttccagaacgcgtacaacgtcaagggcaacgccacctccgccaacatcatctga

SEQ ID NO: 6679 - RNA, 1449 nt, synthetic construct
  misc_feature 1..1449: note = derived and/or modified CDS sequence (opt1) from CCHFV(Iran-Zahedan19)__KJ676542.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggccggcgccacggacgacgcgcagaaggactccatctacgccagcgccctggtcgaggccaccaagttctgcgccccgatctacgagtgcgcgtgggtgtccagcaccgggatcgtgaagaagggcctggagtggttcgagaagaacgccgggaccatcaagtcctgggacgagagctacacggagctcaaggtcgaggtgcccaagatcgagcagctggccaactaccagcaggccgcgctgaagtggcggaaggacatcggcttccgcgtgaacgccaacaccgccgccctctcccacaaggtcctggccgagtacaaggtgcccggcgagatcgtgatgagcgtcaaggagatgctgtccgacatgatccggcgccggaacctcatcctgaaccgcgggggcgacgagaacccccgggggccggtgagccgcgagcacgtggagtggtgccgggagttcgtcaagggcaagtacatcatggcgttcaacccgccctggggcgacatcaacaagtccgggcgcagcggcatcgccctgatcgccaccgggctcgccaagctggccgagaccgagggcaagggggtgttcgacgaggcgaagaagacggtggaggccctgaacggctacctcgacaagcacaaggacgaggtcgacaaggcctccgccgacaacatgatcaccaacctgctgaagcacatcgccaaggcgcaggagctctacaagaacagctccgccctgcgggcccagggcgcccagatcgacaccgccttcagctcctactactggctgtacaaggcgggggtgacccccgagacgttccccaccgtgagccagttcctcttcgagctgggcaagcagccccgcgggaccaagaagatgaagaaggccctgctcagcacccccatgcggtggggcaagaagctgtacgagctgttcgccgacgactccttccagcagaaccgcatctacatgcaccccgccgtcctcacggcggggcggatcagcgagatgggcgtgtgcttcggcaccatcccggtggccaaccccgacgacgccgcccaggggtccggccacaccaagagcatcctgaacctgcgcaccaacacggagaccaacaacccctgcgccaagaccatcgtcaagctgttcgagatccagaagaccgggttcaacatccaggacatggacatcgtggcgtccgagcacctcctgcaccagagcctcgtcggcaagcagtcccccttccagaacgcctacaacgtgaaggggaacgccacgagcgccaacatcatctga

SEQ ID NO: 6680 - RNA, 1449 nt, synthetic construct
  misc_feature 1..1449: note = derived and/or modified CDS sequence (opt1) from CCHFV(NIV 112143)__JN572089.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccaactaccagcaggccgcgctgaagtggcggaaggacatcgggttccgcgtgaacgccaacaccgccgccctcagccacaaggtcctggccgagtacaaggtgcccggcgagatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaagtacatcatggcgttcaacccgccctggggcgacatcaacaagagcgggcgctccggcatcgccctgatcgccaccggcctcgccaagctggccgagaccgaggggaagggcgtgttcgacgaggcgaagaagacggtggaggccctgaacgggtacctcgacaagcacaaggacgaggtcgacaaggccagcgccgacaacatgatcaccaacctgctgaagcacatcgccaaggcgcaggagctctacaagaactccagcgccctgcgggcccagggcgcccagatcgacaccgccttctccagctactactggctgtacaaggcgggcgtgacccccgagacgttccccaccgtgagccagttcctcttcgagctggggaagcagccccgcggcaccaagaagatgaagaaggccctgctctccacccccatgcggtgggggaagaagctgtacgagctgttcgccgacgacagcttccagcagaaccgcatctacatgcaccccgccgtcctcacggcgggccggatctccgagatgggggtgtgcttcggcaccatcccggtggccaaccccgacgacgccgcccagggcagcgggcacaccaagtccatcctgaacctgcgcaccaacacggagaccaacaacccctgcgccaagaccatcgtcaagctgttcgagatccagaagaccggcttcaacatccaggacatggacatcgtggcgagcgagcacctcctgcaccagtccctcgtcgggaagcagagccccttccagaacgcctacaacgtgaagggcaacgccacgtccgccaacatcatctga

SEQ ID NO: 6681 - RNA, 1449 nt, synthetic construct
  misc_feature 1..1449: note = derived and/or modified CDS sequence (opt1) from CCHFV(NIVA 118595)__JN572088.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccaactaccagcaggccgcgctgaagtggcggaaggacatcgggttccgcgtgaacgccaacaccgccgccctcagccacaaggtcctggccgagtacaaggtgcccggcgagatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaagtacatcatggcgttcaacccgccctggggcgacatcaacaagagcgggcgctccggcatcgccctggtggccaccggcctcgccaagctggccgagaccgaggggaagggcgtgttcgacgaggcgaagaagacggtcgaggccctgaacgggtacctcgacaagcacaaggacgaggtggacaaggccagcgccgacaacatgatcaccaacctgctgaagcacatcgccaaggcgcaggagctctacaagaactccagcgccctgcgggcccagggcgcccagatcgacaccgccttctccagctactactggctgtacaaggcgggcgtgacccccgagacgttccccaccgtcagccagttcctcttcgagctggggaagcagccccgcggcaccaagaagatgaagaaggccctgctctccacccccatgcggtgggggaagaagctgtacgagctgttcgccgacgacagcttccagcagaaccgcatctacatgcaccccgccgtgctcacggcgggccggatctccgagatgggggtgtgcttcggcaccatcccggtcgccaaccccgacgacgccgcccagggcagcgggcacaccaagtccatcctgaacctgcgcaccaacacggagaccaacaacccctgcgccaagaccatcgtgaagctgttcgagatccagaagaccggcttcaacatccaggacatggacatcgtcgcgagcgagcacctcctgcaccagtccctcgtggggaagcagagccccttccagaacgcctacaacgtgaagggcaacgccacgtccgccaacatcatctga

SEQ ID NO: 6682 - RNA, 1449 nt, synthetic construct
  misc_feature 1..1449: note = derived and/or modified CDS sequence (opt1) from CCHFV(SPU 130/89)__KJ682821.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgacaagttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagcgcgggctggagtggttcgagaagaacgccggcaccatcaagagctgggacgagtcctacacggagctcaaggtcgacgtgcccaagatcgagcagctggccaactaccagcaggccgcgctgaagtggcggaaggacatcgggttccgcgtgaacgccaacaccgccgccctcagcaacaaggtcctggccgagtacaaggtgcccggcgagatcgtgatgtccgtcaaggagatgctgagcgacatgatccggcgccggaaccagatcctcaaccgcggcggggacgagaacccccggggcccggtgtcccgcgagcacgtggactggtgccgggagttcgtcaaggggaagtacatcatggcgttcaacccgccctggggcgacatcaacaagagcgggcgctccggcatcgccctggtggccaccggcctggccaagctcgccgagaccgaggggaagggcgtgttcgacgaggcgaagaagacggtcgaggccctgaacgggtacctggacaagcacaaggacgaggtggaccgggccagcgccgactccatgatcaccaacctcctgaagcacatcgccaaggcgcaggagctgtacaagaacagctccgccctccgcgcccagggcgcccagatcgacaccgccttcagcagctactactggctgtacaaggcgggcgtgacccccgagacgttccccaccgtctcccagttcctgttcgagctcgggaagcagccccggggcaccaagaagatgaagaaggccctgctgagcacccccatgaagtgggggaagaagctctacgagctgttcgccgacgactccttccagcagaaccgcatctacatgcaccccgccgtgctgacggcgggccggatcagcgagatgggggtgtgcttcggcaccatcccggtcgccaaccccgacgacgccgcccagggctccgggcacaccaagagcatcctcaacctgcgcaccaacacggagaccaacaacccctgcgcccggaccatcgtgaagctgttcgagatccagaagaccggcttcaacatccaggacatggacatcgtcgcgtccgagcacctcctgcaccagagcctggtggggaagcagtcccccttccagaacgcctacaacgtgaagggcaacgccacgagcgccaacatcgtctga

SEQ ID NO: 6683 - RNA, 1449 nt, synthetic construct
  misc_feature 1..1449: note = derived and/or modified CDS sequence (opt1) from CCHFV(SPU 18/88)__KJ682818.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgacaagttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagcgcgggctggagtggttcgagaagaacgccggcaccatcaagagctgggacgagtcctacacggagctcaaggtcgacgtgcccaagatcgagcagctggccaactaccagcaggccgcgctgaagtggcggaaggacatcgggttccgcgtgaacgccaacaccgccgccctcagcaacaaggtcctggccgagtacaaggtgcccggcgagatcgtgatgtccgtcaaggagatgctgagcgacatgatccggcgccggaaccagatcctcaaccgcggcggggacgagaacccccggggcccggtgtcccgcgagcacgtggactggtgccgggagttcgtcaaggggaagtacatcatggcgttcaacccgccctggggcgacatcaacaagagcgggcgctccggcatcgccctggtggccaccggcctggccaagctcgccgagaccgaggggaagggcgtgttcgacgaggcgaagaagacggtcgaggccctgaacgggtacctggacaagcacaaggacgaggtggaccgggccagcgccgactccatggtgaccaacctcctgaagcacatcgccaaggcgcaggagctgtacaagaacagctccgccctccgcgcccagggcgcccagatcgacaccgccttcagcagctactactggctgtacaaggcgggcgtcacccccgagacgttccccaccgtgtcccagttcctgttcgagctcgggaagcagccccggggcaccaagaagatgaagaaggccctgctgagcacccccatgaagtgggggaagaagctctacgagctgttcgccgacgactccttccagcagaaccgcatctacatgcaccccgccgtgctgacggcgggccggatcagcgagatgggggtctgcttcggcaccatcccggtggccaaccccgacgacgccgcccagggctccgggcacaccaagagcatcctcaacctgcgcaccaacacggagaccaacaacccctgcgcccggaccatcgtcaagctgttcgagatccagaagaccggcttcaacatccaggacatggacatcgtggcgtccgagcacctcctgcaccagagcctggtggggaagcagtcccccttccagaacgcctacaacgtcaagggcaacgccacgagcgccaacatcatctga

SEQ ID NO: 6684 - RNA, 1449 nt, synthetic construct
  misc_feature 1..1449: note = derived and/or modified CDS sequence (opt1) from CCHFV(SPU 187/90)__KJ682823.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgacaagttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagcgcgggctggagtggttcgagaagaacgccggcaccatcaagagctgggacgagtcctacacggagctcaaggtcgacgtgcccaagatcgagcagctggccaactaccagcaggccgcgctgaagtggcggaaggacatcgggttccgcgtgaacgccaacaccgccgccctcagcaacaaggtcctggccgagtacaaggtgcccggcgagatcgtgatgtccgtcaaggagatgctgagcgacatgatccggcgccggaaccagatcctcaaccgcggcggggacgagaacccccggggcccggtgtcccgcgagcacgtggactggtgccgggagttcgtcaaggggaagtacatcatggcgttcaacccgccctggggcgacatcaacaagagcgggcgctccggcatcgccctggtggccaccggcctggccaagctcgccgagaccgaggggaagggcgtgttcgacgaggcgaagaagacggtcgaggccctgaacgggtacctggacaagcacaaggacgaggtggaccgggccagcgccgactccatgatcaccaacctcctgaagcacatcgccaaggcgcaggagctgtacaagaacagctccgccctccgcgcccagggcgcccagatcgacaccgccttcagcagctactactggctgtacaaggcgggcgtgacccccgagacgttccccaccgtctcccagttcctgttcgagctcgggaagcagccccggggcaccaagaagatgaagaaggccctgctgagcacccccatgaagtgggggaagaagctctacgagctgttcgccgacgactccttccagcagaaccgcatctacatgcaccccgccgtgctgacggcgggccggatcagcgagatgggggtgtgcttcggcaccatcccggtcgccaaccccgacgacgccgcccagggctccgggcacaccaagagcatcctcaacctgcagaccaacacggagaccaacaacccctgcgcccgcaccatcgtgaagctgttcgagatccagaagaccggcttcaacatccaggacatggacatcgtcgcgtccgagcacctcctgcaccagagcctggtggggaagcagtcccccttccagaacgcctacaacgtgaagggcaacgccacgagcgccaacatcatctga

SEQ ID NO: 6685 - RNA, 1449 nt, synthetic construct
  misc_feature 1..1449: note = derived and/or modified CDS sequence (opt1) from CCHFV(SPU 383/87)__KJ682816.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgacaagttcgtgttccagatggccggcgccacggacgacgcgcagaaggactccatctacgccagcgccctggtcgaggccaccaagttctgcgccccgatctacgagtgcgcgtgggtgtccagcaccgggatcgtgaagcgcggcctggagtggttcgagaagaacgccgggaccatcaagtcctgggacgagagctacacggagctcaaggtcgacgtgcccaagatcgagcagctggccaactaccagcaggccgcgctgaagtggcggaaggacatcggcttccgcgtgaacgccaacaccgccgccctctccaacaaggtcctggccgagtacaaggtgcccggcgagatcgtgatgagcgtcaaggagatgctgtccgacatgatccggcgccggaaccagatcctcaaccgcgggggcgacgagaacccccgggggccggtgagccgcgagcacgtggactggtgccgggagttcgtcaagggcaagtacatcatggcgttcaacccgccctggggcgacatcaacaagtccgggcgcagcggcatcgccctggtggccaccgggctggccaagctcgccgagaccgagggcaagggggtgttcgacgaggcgaagaagacggtcgaggccctgaacggctacctggacaagcacaaggacgaggtggaccgggcctccgccgacagcatgatcaccaacctcctgaagcacatcgccaaggcgcaggagctgtacaagaactccagcgccctccgcgcccagggcgcccagatcgacaccgccttctccagctactactggctgtacaaggcgggggtgacccccgagacgttccccaccgtcagccagttcctgttcgagctcggcaagcagccccgggggaccaagaagatgaagaaggccctgctgtccacccccatgaagtggggcaagaagctctacgagctgttcgccgacgacagcttccagcagaaccgcatctacatgcaccccgccgtgctgacggcggggcggatctccgagatgggcgtgtgcttcggcaccatcccggtcgccaaccccgacgacgccgcccaggggagcggccacaccaagtccatcctcaacctgcgcaccaacacggagaccagcaacccctgcgcccggaccatcgtgaagctgttcgagatccagaagaccgggttcaacatccaggacatggacatcgtcgcgtccgagcacctcctgcaccagagcctggtgggcaagcagtcccccttccagaacgcctacaacgtgaaggggaacgccacgagcgccaacatcgtctga

SEQ ID NO: 6686 - RNA, 1449 nt, synthetic construct
  misc_feature 1..1449: note = derived and/or modified CDS sequence (opt1) from CCHFV(SPU 383/87)__KJ682816.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgacaagttcgtgttccagatggccggcgccacggacgacgcgcagaaggactccatctacgccagcgccctggtcgaggccaccaagttctgcgccccgatctacgagtgcgcgtgggtgtccagcaccgggatcgtgaagcgcggcctggagtggttcgagaagaacgccgggaccatcaagtcctgggacgagagctacacggagctcaaggtcgacgtgcccaagatcgagcagctggccaactaccagcaggccgcgctgaagtggcggaaggacatcggcttccgcgtgaacgccaacaccgccgccctctccaacaaggtcctggccgagtacaaggtgcccggcgagatcgtgatgagcgtcaaggagatgctgtccgacatgatccggcgccggaaccagatcctcaaccgcgggggcgacgagaacccccgggggccggtgagccgcgagcacgtggactggtgccgggagttcgtcaagggcaagtacatcatggcgttcaacccgccctggggcgacatcaacaagtccgggcgcagcggcatcgccctggtggccaccgggctggccaagctcgccgagaccgagggcaagggggtgttcgacgaggcgaagaagacggtcgaggccctgaacggctacctggacaagcacaaggacgaggtggaccgggcctccgccgacagcatgatcaccaacctcctgaagcacatcgccaaggcgcaggagctgtacaagaactccagcgccctccgcgcccagggcgcccagatcgacaccgccttctccagctactactggctgtacaaggcgggggtgacccccgagacgttccccaccgtcagccagttcctgttcgagctcggcaagcagccccgggggaccaagaagatgaagaaggccctgctgtccacccccatgaagtggggcaagaagctctacgagctgttcgccgacgacagcttccagcagaaccgcatctacatgcaccccgccgtgctgacggcggggcggatctccgagatgggcgtgtgcttcggcaccatcccggtcgccaaccccgacgacgccgcccaggggagcggccacaccaagtccatcctcaacctgcgcaccaacacggagaccagcaacccctgcgcccggaccatcgtgaagctgttcgagatccagaagaccgggttcaacatccaggacatggacatcgtcgcgtccgagcacctcctgcaccagagcctggtgggcaagcagtcccccttccagaacgcctacaacgtgaaggggaacgccacgagcgccaacatcatctga

SEQ ID NO: 6687 - RNA, 1449 nt, synthetic construct
  misc_feature 1..1449: note = derived and/or modified CDS sequence (opt1) from CCHFV(SPU 431/85)__KJ682815.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgacaagttcgtgttccagatggcctccgccacggacgacgcgcagaaggacagcatctacgcctccgccctggtcgaggccaccaagttctgcgccccggtgtacgagtgcgcgtgggtgagctccaccggcatcgtcaagcgcgggctggagtggttcgagaagaacgccggcaccatcaagagctgggacgagtcctacacggagctcaaggtggacgtgcccaagatcgagcagctggccaactaccagcaggccgcgctgaagtggcggaaggacatcgggttccgcgtcaacgccaacaccgccgccctcagcaacaaggtgctggccgagtacaaggtgcccggcgagatcgtcatgtccgtgaaggagatgctgagcgacatgatccggcgccggaaccagatcctcaaccgcggcggggacgagaacccccggggcccggtgtcccgcgagcacgtcgactggtgccgggagttcgtgaaggggaagtacatcatggcgttcaacccgccctggggcgacatcaacaagagcgggcgctccggcatcgccctggtggccaccggcctggccaagctcgccgagaccgaggggaagggcgtcttcgacgaggcgaagaagacggtggaggccctgaacgggtacctggacaagcacaaggacgaggtggaccgggccagcgccgactccatgatcaccaacctcctgaagcacatcgccaaggcgcaggagctgtacaagaacagctccgccctccgcgcccagggcgcccagatcgacaccgccttcagcagctactactggctgtacaaggcgggcgtcacccccgagacgttccccaccgtgtcccagttcctgttcgagctcgggaagcagccccggggcaccaagaagatgaagaaggccctgctgagcacccccatgaagtgggggaagaagctctacgagctgttcgccgacgacacgttccagcagaaccgcatctacatgcaccccgccgtgctgaccgcgggccggatctccgagatgggggtctgcttcggcaccatcccggtggccaaccccgacgacgccgcccagggcagcgggcacaccaagtccatcctcaacctgcgcacgaacaccgagaccaacaacccctgcgcccggaccatcgtcaagctgttcgagatccagaagacgggcttcaacatccaggacatggacatcgtggcgagcgagcacctcctgcaccagtccctggtggggaagcagagccccttccagaacgcctacaacgtcaagggcaacgccacctccgtgaacatcatctga

SEQ ID NO: 6688 - RNA, 1449 nt, synthetic construct
  misc_feature 1..1449: note = derived and/or modified CDS sequence (opt1) from CCHFV(SPU 45/88)__KJ682819.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgacaagttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagcgcgggctggagtggttcgagaagaacgccggcaccatcaagagctgggacgagtcctacacggagctcaaggtcgacgtgcccaagatcgagcagctggccaactaccagcaggccgcgctgaagtggcggaaggacatcgggttccgcgtgaacgccaacaccgccgccctcagcaacaaggtcctggccgagtacaaggtgcccggcgagatcgtgatgtccgtcaaggagatgctgagcgacatgatccggcgccggaaccagatcctcaaccgcggcggggacgagaacccccggggcccggtgtcccgcgagcacgtggactggtgccgggagttcgtcaaggggaagtacatcatggcgttcaacccgccctggggcgacatcaacaagagcgggcgctccggcatcgccctggtggccaccggcctggccaagctcgccgagaccgaggggaagggcgtgttcgacgaggcgaagaagacggtcgaggccctgaacgggtacctggacaagcacaaggacgaggtggaccgggccagcgccgactccatgatcaccaacctcctgaagcacatcgccaaggcgcaggagctgtacaagaacagctccgccctccgcgcccagggcgcccagatcgacaccgccttcagcagctactactggctgtacaaggcgggcgtgacccccgagacgttccccaccgtctcccagttcctgttcgagctcgggaagcagccccggggcaccaagaagatgaagaaggccctgctgagcacccccatgaagtgggggaagaagctctacgagctgttcgccgacgactccttccagcagaaccgcatctacatgcaccccgccgtgctgacggcgggccggatcagcgagatgggggtgtgcttcggcaccatcccggtcgccaaccccgacgacgccgcccagggctccgggcacaccaagagcatcctcaacctgcgcaccaacacggagaccaacaacccctgcgcccggaccatcgtgaagctgttcgagatccagaagaccggcttcaacatccaggacatggacatcgtcgcgtccgagcacctcctgcaccagagcctggtggggaagcagtcccccttccagaacgcctacaacgtgaagggcaacgccacgagcgccaacatcatctga

SEQ ID NO: 6689 - RNA, 1449 nt, synthetic construct
  misc_feature 1..1449: note = derived and/or modified CDS sequence (opt1) from CCHFV(SPU 48/90)__KJ682822.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgacaagttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagcgcgggctggagtggttcgagaagaacgccggcaccatcaagagctgggacgagtcctacacggagctcaaggtcgacgtgcccaagatcgagcagctggccaactaccagcaggccgcgctgaagtggcggaaggacatcgggttccgcgtgaacgccaacaccgccgccctcagcaacaaggtcctggccgagtacaaggtgcccggcgagatcgtgatgtccgtcaaggagatgctgagcgacatgatccggcgccggaaccagatcctcaaccgcggcggggacgagaacccccggggcccggtgtcccgcgagcacgtggactggtgccgggagttcgtcaaggggaagtacatcatggcgttcaacccgccctggggcgacatcaacaagagcgggcgctccggcatcgccctggtggccaccggcctggccaagctcgccgagaccgaggggaagggcgtgttcgacgaggcgaagaagacggtcgaggccctgaacgggtacctggacaagcacaaggacgaggtggaccgggccagcgccgactccatgatcaccaacctcttcaagcacatcgccaaggcgcaggagctgtacaagaacagctccgccctgcgcgcccagggcgcccagatcgacaccgccttcagcagctactactggctctacaaggcgggcgtgacccccgagacgttccccaccgtctcccagttcctgttcgagctggggaagcagccccggggcaccaagaagatgaagaaggccctcctgagcacccccatgaagtgggggaagaagctgtacgagctgttcgccgacgactccttccagcagaaccgcatctacatgcaccccgccgtgctgacggcgggccggatcagcgagatgggggtgtgcttcggcaccatcccggtcgccaaccccgacgacgccgcccagggctccgggcacaccaagagcatcctgaacctccgcaccaacacggagaccaacaacccctgcgcccggaccatcgtgaagctgttcgagatccagaagaccggcttctccatccaggacatggacatcgtcgcgagcgagcacctcctccaccagtccctggtggggaagcagagccccttccagaacgcctacaacgtgaagggcaacgccacgtccgccaacatcatctga

SEQ ID NO: 6690 - RNA, 1449 nt, synthetic construct
  misc_feature 1..1449: note = derived and/or modified CDS sequence (opt1) from CCHFV(SPU 497/88)__KJ682820.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgacaagttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagcgcgggctggagtggttcgagaagaacgccggcaccatcaagagctgggacgagtcctacacggagctcaaggtcgacgtgcccaagatcgagcagctggccaactaccagcaggccgcgctgaagtggcggaaggacatcgggttccgcgtgaacgccaacaccgccgccctcagcaacaaggtcctggccgagtacaaggtgcccggcgagatcgtgatgtccgtcaaggagatgctgagcgacatgatccggcgccggaaccagatcctcaaccgcggcggggacgagaacccccggggcccggtgtcccgcgagcacgtggactggtgccgggagttcgtcaaggggaagtacatcatggcgttcaacccgccctggggcgacatcaacaagagcgggcgctccggcatcgccctggtggccaccggcctggccaagctcgccgagaccgaggggaagggcgtgttcgacgaggcgaagaagacggtcgaggccctgaacgggtacctggacaagcacaaggacgaggtggaccgggccagcgccgactccatgatcaccaacctcctgaagcacatcgccaaggcgcaggagctgtacaagaacagctccgccctccgcgcccagggcgcccagatcgacaccgccttcagcagctactactggctgtacaaggcgggcgtgacccccgagacgttccccaccgtctcccagttcctgttcgagctcgggaagcagccccggggcaccaagaagatgaagaaggccctgctgagcacccccatgaagtgggggaagaagctctacgagctgttcgccgacgactccttccagcagaaccgcatctacatgcaccccgccgtgctgacggcgggccggatcagcgagatgggggtgtgcttcggcgccatcccggtcgccaaccccgacgacgccgcccagggctccgggcacaccaagagcatcctcaacctgcgcaccaacaccgagacgaacaacccctgcgcgcggaccatcgtgaagctgttcgagatccagaagaccggcttcaacatccaggacatggacatcgtcgcctccgagcacctcctgcaccagagcctggtggggaagcagtcccccttccagaacgcctacaacgtgaagggcaacgccaccagcgccaacatcatctga

SEQ ID NO: 6691 - RNA, 1449 nt, synthetic construct
  misc_feature 1..1449: note = derived and/or modified CDS sequence (opt1) from CCHFV(SPU 556/87)__KJ682817.1__N
  source 1..1449: mol_type = other RNA
atggagaacaagatcgaggtgaacaacaaggacgagatgaaccgctggttcgaggagttcaagaagggcaacgggctggtcgacaccttcaccaacagctactccttctgcgagagcgtgcccaacctcgaccggttcgtgttccagatggccggcgccacggacgacgcgcagaaggactccatctacgccagcgccctggtcgaggccaccaagttctgcgccccgatctacgagtgcgcgtgggtgtccagcaccgggatcgtgaagaagggcctggagtggttcgagaagaacgccgggaccatcaagtcctgggacgagagctacacggagctcaaggtcgacgtgcccaagatcgagcagctggccaactaccagcaggccgcgctgaagtggcgcaaggacatcggcttccgggtgaacgccaacaccgccgccctctccaacaaggtcctggccgagtacaaggtgcccggcgagatcgtgatgagcgtcaaggagatgctgtccgacatgatccgccggcgcaaccagatcctcaaccgcgggggcgacgagaacccccgggggccggtgagccgggagcacgtggactggtgccgcgagttcgtcaagggcaagtacatcatggcgttcaacccgccctggggcgacatcaacaagtccgggcggagcggcatcgccctggtggccaccgggctggccaagctcgccgagaccgagggcaagggggtgttcgacgaggcgaagaagacggtcgaggccctgaacggctacctggacaagcacaaggacgaggtggaccgcgcctccgccgacagcatgatcaccaacctcctgaagcacatcgccaaggcgcaggagctgtacaagaactccagcgccctccgggcccagggcgcccagatcgacaccgccttctccagctactactggctgtacaaggcgggggtgacccccgagacgttccccaccgtcagccagttcctgttcgagctcggcaagcagccccgcgggaccaagaagatgaagaaggccctgctgtccacccccatgaagtggggcaagaagctctacgagctgttcgccgacgacagcttccagcagaaccggatctacatgcaccccgccgtgctgacggcggggcgcatctccgagatgggcgtgtgcttcggcaccatcccggtcgccaaccccgacgacgccgcccaggggagcggccacaccaagtccatcctcaacctgcggaccaacacggagaccaacaacccctgcgccaagaccatcgtgaagctgttcgagatccagaagaccgggttcaacatccaggacatggacatcgtcgcgagcgagcacctcctgcaccagtccctggtgggcaagcagagccccttccagaacgcctacaacgtgaaggggaacgccacgtccgccaacatcatctga

SEQ ID NO: 6692 - RNA, 1449 nt, synthetic construct
  misc_feature 1..1449: note = derived and/or modified CDS sequence (opt1) from CCHFV(SPU 92/01)__KC880335.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgacaagttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagcgcgggctggagtggttcgagaagaacgccggcaccatcaagagctgggacgagtcctacacggagctcaaggtcgacgtgcccaagatcgagcagctggccaactaccagcaggccgcgctgaagtggcggaaggacatcgggttccgcgtgaacgccaacaccgccgccctcagcaacaaggtcctggccgagtacaaggtgcccggcgagatcgtgatgtccgtcaaggagatgctgagcgacatgatccggcgccggaaccagatcctcaaccgcggcggggacgagaacccccggggcccggtgtcccgcgagcacgtggactggtgccgggagttcgtcaaggggaagtacatcatggcgttcaacccgccctggggcgacatcaacaagagcgggcgctccggcatcgccctggtggccaccggcctggccaagctcgccgagaccgaggggaagggcgtgttcgacgaggcgaagaagacggtcgaggccctgaacgggtacctggacaagcacaaggacgaggtggaccgggccagcgccgactccatgatcaccaacctcctgaagcacatcgccaaggcgcaggagctgtacaagaacagctccgccctccgcgcccagggcgcccagatcgacaccgccttcagcagctactactggctgtacaaggcgggcgtgacccccgagacgttccccaccgtctcccagttcctgttcgagctcgggaagcagccccggggcaccaagaagatgaagaaggccctgctgagcacccccatgaagtgggggaagaagctctacgagctgttcgccgacgactccttccagcagaaccgcatctacatgcaccccgccgtgctgacggcgggccggatcagcgagatgggggtgtgcttcggcaccatcccggtcgccaaccccgacgacgccgcccagggctccgggcacaccaagagcatcctcaacctgcagaccaacacggagaccaacaacccctgcgcccgcaccatcgtgaagctgttcgagatccagaagaccggcttcaacatccaggacatggacatcgtcgcgtccgagcacctcctgcaccagagcctggtggggaagcagtcccccttccagaacgcctacaacgtgaagggcaacgccacgagcgtcaacatcatctga

SEQ ID NO: 6693 - RNA, 1449 nt, synthetic construct
  misc_feature 1..1449: note = derived and/or modified CDS sequence (opt1) from CCHFV(SRR)__KU707901.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggccggcgccacggacgacgcgcagaaggactccatctacgccagcgccctggtcgaggccaccaagttctgcgccccgatctacgagtgcgcgtgggtgtccagcaccgggatcgtgaagaagggcctggagtggttcgagaagaacgccgggaccatcaagtcctgggacgagagctacacggagctcaaggtcgaggtgcccaagatcgagcagctggccaactaccagcaggccgcgctgaagtggcggaaggacatcggcttccgcgtgaacgccaacaccgccgccctctcccacaaggtcctggccgagtacaaggtgcccggcgagatcgtgatgagcgtcaaggagatgctgtccgacatgatccggcgccggaacctcatcctgaaccgcgggggcgacgagaacccccgggggccggtgagccgcgagcacgtggagtggtgccgggagttcgtcaagggcaagtacatcatggcgttcaacccgccctggggcgacatcaacaagtccgggcgcagcggcatcgccctggtggccaccgggctcgccaagctggccgagaccgagggcaagggggtgttcgacgaggcgaagaagacggtcgaggccctgaacggctacctcgacaagcacaaggacgaggtggacaaggcctccgccgacaacatgatcaccaacctgctgaagcacatcgccaaggcgcaggagctctacaagaacagctccgccctgcgggcccagggcgcccagatcgacaccgccttcagctcctactactggctgtacaaggcgggggtgacccccgagacgttccccaccgtcagccagttcctcttcgagctgggcaagcagccccgcgggaccaagaagatgaagaaggccctgctcagcacccccatgcggtggggcaagaagctgtacgagctgttcgccgacgactccttccagcagaaccgcatctacatgcaccccgccgtgctcacggcggggcggatcagcgagatgggcgtgtgcttcggcaccatcccggtcgccaaccccgacgacgccgcccaggggtccggccacaccaagagcatcctgaacctgcgcaccaacacggagaccaacaacccctgcgccaagaccatcgtgaagctgttcgagatccagaagaccgggttcaacatccaggacatggacatcgtcgcgtccgagcacctcctgcaccagagcctcgtgggcaagcagtcccccttccagaacgcctacaacgtgaaggggaacgccacgagcgccaacatcatctga

SEQ ID NO: 6694 - RNA, 1449 nt, synthetic construct
  misc_feature 1..1449: note = derived and/or modified CDS sequence (opt1) from CCHFV(STV/HU29223)__AF481802.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacagcggcaccatcaagtcctgggacgagaactacgccgagctcaaggtggacgtccccaagatcgagcagctggccaactaccagcaggccgcgctgaagtggcgcaaggacatcgggttccgggtgaacgccaacacggccgccctcagcaacaaggtgctggccgagtacaaggtccccggcgagatcgtgatgtccgtgaaggagatgctgagcgacatgatccgccggcgcaacctcatcctgaaccggggcggggacgagaacctgcgcggccccgtctcccgggagcacgtggagtggtgccgcgagttcgtgaaggggaagtacatcatggcgttcaacccgccctggggcgacatcaacaagagcgggcggtccggcatcgccctcgtcgccaccggcctggccaagctggccgagaccgaggggaagggcgtgttcgacgaggcgaagaagaccgtggaggccctcaacgggtacctggacaagcaccgcgacgaggtcgacaaggccagcgccgactccatgatcacgaacctgctcaagcacatcgccaaggcgcaggagctgtacaagaacagctccgccctgcgggcccagggcgcccagatcgacacccccttcagcagcttctactggctctacaaggccggcgtgacccccgagaccttcccgacgatctcccagttcctgttcgagctggggaagcagccccgcggcaccaagaagatgaagaaggcgctcctgagcacccccatgaagtgggggaagaagctgtacgagctgttcgccgacgactccttccagcagaaccggatctacatgcaccccgccgtgctgaccgccggccgcatcagcgagatgggggtctgcttcggcacgatcccggtggcgaaccccgacgacgccgcccagggctccgggcacaccaagagcatcctgaacctccggacctccaccgagacgaacaacccctgcgccaagaccatcgtgaagctgttcgagatccagaagaccggcttcaacatccaggacatggacatcgtcgccagcgagcacctcctccaccagtccctggtggggaagcagagccccttccagaacgcgtacaacgtcaagggcaacgccacctccgccaacatcatctga

SEQ ID NO: 6695 - RNA, 1449 nt, synthetic construct
  misc_feature 1..1449: note = derived and/or modified CDS sequence (opt1) from CCHFV(TAJ/HU8966)__AY049083.2__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccaactaccagcaggccgcgctgaagtggcggaaggacatcgggttccgcgtgaacgccaacaccgccgccctcagccacaaggtcctggccgagtacaaggtgcccggcgagatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaagtacatcatggcgttcaacccgccctggggcgacatcaacaagagcgggcgctccggcatcgccctggtggccaccggcctcgccaagctggccgagaccgaggggaagggcgtgttcgacgaggcgaagaagacggtcgaggccctgaacgggtacctcgacaagcacaaggacgaggtggacaaggccagcgccgacaacatgatcaccaacctgctgaagcacatcgccaaggcgcaggagctctacaagaactccagcgccctgcgggcccagggcgcccagatcgacaccgccttctccagctactactggctgtacaaggcgggcgtgacccccgagacgttccccaccgtcagccagttcctcttcgagctggggaagcagccccgcggcaccaagaagatgaagaaggccctgctctccacccccatgaagtgggggaagaagctgtacgagctgttcgccgacgacagcttccagcagaaccggatctacatgcaccccgccgtgctcacggcgggccgcatctccgagatgggggtgtgcttcggcaccatcccggtcgccgaccccgacgacgccgcccagggcagcgggcacaccaagtccatcctgaacctgcggaccaacacggagaccaacaacccctgcgccaagaccatcgtgaagctgttcgagatccagaagaccggcttcaacatccaggacatggacatcgtcgcgagcgagcacctcctgcaccagtccctcgtggggaagcagagccccttccagaacgcctacaacgtgaagggcaacgccacgtccgccaacatcatctga

SEQ ID NO: 6696 - RNA, 1449 nt, synthetic construct
  misc_feature 1..1449: note = derived and/or modified CDS sequence (opt1) from CCHFV(TAJ/HU8975)__AY297692.2__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacatcgagctcaaggtcgaggtgcccaagatcgagcagctggccaactaccagcaggccgcgctgaagtggcggaaggacatcgggttccgcgtgaacgccaacacggccgccctcagccacaaggtcctggccgagtacaaggtgcccggcgagatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaagtacatcatggcgttcaacccgccctggggcgacatcaacaagagcgggcgctccggcatcgccctggtggccaccggcctcgccaagctggccgagaccgaggggaagggcgtgttcgacgaggcgaagaagaccgtcgaggccctgaacgggtacctcgacaagcacaaggacgaggtggacaaggccagcgccgacaacatgatcacgaacctgctgaagcacatcgccaaggcgcaggagctctacaagaactccagcgccctgcgggcccagggcgcccagatcgacaccgccttctccagctactactggctgtacaaggcgggcgtgacccccgagaccttccccacggtcagccagttcctcttcgagctggggaagcagccccgcggcaccaagaagatgaagaaggccctgctctccacccccatgaagtgggggaagaagctgtacgagctgttcgccgacgacagcttccagcagaaccggatctacatgcaccccgccgtgctcaccgcgggccgcatctccgagatgggggtgtgcttcggcacgatcccggtcgccaaccccgacgacgccgcccagggcagcgggcacaccaagtccatcctgaacctgcggaccaacaccgagacgaacaacccctgcgccaagaccatcgtgaagctgttcgagatccagaagaccggcttcaacatccaggacatggacatcgtcgcgagcgagcacctcctgcaccagtccctcgtggggaagcagagccccttccagaacgcctacaacgtgaagggcaacgccacctccgccaacatcatctga

SEQ ID NO: 6697 - RNA, 1449 nt, synthetic construct
  misc_feature 1..1449: note = derived and/or modified CDS sequence (opt1) from CCHFV(TAJ/HU8978)__AY297691.2__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggccggcgccacggacgacgcgcagaaggactccatctacgccagcgccctggtcgaggccaccaagttctgcgccccgatctacgagtgcgcgtgggtgtccagcaccgggatcgtgaagaagggcctggagtggttcgagaagaacgccgggaccatcaagtcctgggacgagagctacacggagctcaaggtcgaggtgcccaagatcgagcagctggccaactaccagcaggccgcgctgaagtggcggaaggacatcggcttccgcgtgaacgccaacaccgccgccctctcccacaaggtcctggccgagtacaaggtgcccggcgagatcgtgatgagcgtcaaggagatgctgtccgacatgatccggcgccggaacctcttcctgaaccgcgggggcgacgagaacccccgggggccggtgagccgcgagcacgtggagtggtgccgggagttcgtcaagggcaagtacatcatggcgttcaacccgccctggggcgacatcaacaagtccgggcgcagcggcatcgccctggtggccaccgggctcgccaagctggccgagaccgagggcaagggggtgttcgacgaggcgaagcggacggtcgaggccctgaacggctacctcgacaagcacaaggacgaggtggacaaggcctccgccgacaacatgatcaccaacctgctgaagcacatcgccaaggcgcaggagctctacaagaacagctccgccctgcgcgcccagggcgcccagatcgacaccagcttctccagctactactggctgtacaaggccgggcggacccccgagacgttccccaccgtgagccagttcctcttcgagctgggcaagcagccccgcgggaccaagaagatgaagaaggcgctgctctccacccccatgaagtggggcaagaagctgtacgagctgttcgccgacgacagcttccagcagaaccggatctacatgcaccccgccgtcctcacggccgggcgcatctccgagatgggcgtgtgcttcggcaccatcccggtggcgaaccccgacgacgccgcccaggggagcggccacaccaagtccatcctgaacctgcggaccaacacggagaccaacaacccctgcgccaagaccatcgtcaagctgttcgagatccagaagaccgggttcaacatccaggacatggacatcgtggccagcgagcacctcctgcaccagtccctcgtcggcaagcagagccccttccagaacgcgtacaacgtgaaggggaacgccacgtccgccaacatcatctga

SEQ ID NO: 6698 - RNA, 1449 nt, synthetic construct
  misc_feature 1..1449: note = derived and/or modified CDS sequence (opt1) from CCHFV(Uzbek/TI10145)__AF481799.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccgactaccagcaggccgcgctgaagtggcggaaggacatcgggttccgcgtgaacgccaacaccgccgccctcagccacaaggtcctggccgagtacaaggtgcccggcgagatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaagtacatcatggcgttcaacccgccctggggcgacatcaacaagagcgggcgctccggcatcgccctggtggccaccggcctcgccaagctggccgagaccgaggggaagggcgtgttcgacgaggcgaagaagacggtcgaggccctgaacgggtacctcgacaagcacaaggacgaggtggacaaggccagcgccgacaacatgatcaccaacctgctgaagcacatcgccaaggcgcaggagctctacaagaactccagcgccctgcgggcccagggcgcccagatcgacaccgccttctccagctactactggctgtacaaggcgggcgtgacccccgagacgttccccaccgtcagccagttcctcttcgagctggggaagcagccccgcggcaccaagaagatgaagaaggccctgctctccacccccatgaagtgggggaagaagctgtacgagctgttcgccgacgacagcttccagcagaaccggatctacatgcaccccgccgtgctcacggcgggccgcatctccgagatgggggtgtgcttcggcaccatcccggtcgccaaccccgacgacgccgcccagggcagcgggcacaccaagtccatcctgaacctgcggaccaacacggagaccaacaacccctgcgccaagaccatcgtgaagctgttcgagatccagaagaccggcttcaacatccaggacatggacatcgtcgcgagcgagcacctcctgcaccagtccctcgtggggaagcagagccccttccagaacgcctacaacgtgaagggcaacgccacgtccgccaacatcatctga

SEQ ID NO: 6699 - RNA, 1449 nt, synthetic construct
  misc_feature 1..1449: note = derived and/or modified CDS sequence (opt1) from CCHFV(ROS/TI28044)__AY277672.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacagcggcaccatcaagtcctgggacgagaactacgccgagctcaaggtggacgtccccaagatcgagcagctggccaactaccagcaggccgcgctgaagtggcgcaaggacatcgggttccgggtgaacgccaacacggccgccctcagcaacaaggtgctggccgagtacaaggtccccggcgagatcgtgatgtccgtgaaggagatgctgagcgacatgatccgccggcgcaacctcatcctgaaccggggcggggacgagaacccccgcggcccggtctcccgggagcacgtggagtggtgccgcgagttcgtgaaggggaagtacatcatggcgttcaacccgccctggggcgacatcaacaagcccgggcggagcggcatcgccctggtcgccaccggcctcgccaagctggccgagaccgaggggaagggcgtgttcgacgaggcgaagaagaccgtggaggccctgaacgggtacctcgacaagcaccgcgacgaggtcgacaaggcctccgccgacagcatgatcgccaacctgctgaagcacatcgcgaaggcccaggagctctacaagaactccagcgccctgcgggcccagggcgcccagatcgacacgcccttctccagcttctactggctgtacaaggcgggcgtgacccccgagaccttccccaccatcagccagttcctcttcgagctggggaagcagccccgcggcacgaagaagatgaagaaggccctgctctccaccccgatgaagtgggggaagaagctgtacgagctgttcgccgacgacagcttccagcagaaccggatctacatgcaccccgccgtgctcaccgcgggccgcatctccgagatgggggtctgcttcggcaccatccccgtggccaaccccgacgacgccgcccagggcagcgggcacacgaagtccatcctgaacctgcggaccagcaccgagaccaacaacccgtgcgccaagacgatcgtgaagctgttcgagatccagaagaccggcttcaacatccaggacatggacatcgtcgcgtccgagcacctcctgcaccagagcctcgtggggaagcagtcccccttccagaacgcctacaacgtcaagggcaacgccaccagcgccaacatcatctga

SEQ ID NO: 6700 - RNA, 1449 nt, synthetic construct
  misc_feature 1..1449: note = derived and/or modified CDS sequence (opt1) from CCHFV(7001)__AF415236.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagcgggggctggagtggttcgagaagaacgccggcaccatcaagagctgggacgagtcctacacggagctcaaggtcgaggtgcccaagatcgagcagctggccgactaccagcaggccgcgctgaagtggcgcaaggacatcgggttccgggtgaacgccaacaccaccgccctcagccacaaggtcctggccgagtacaaggtgcccggcgagatcgtgatgtccgtcaaggagatgctgagcgacatgatccgccggcgcaacctcatcctgaaccggggcggggacgagagcccccgcggcccggtgtcccgggagcacgtggagtggtgccgcgagttcgtcaaggggaagtacatcatggccttcaacccgccctggggcgacatcaacaagtccgggcggagcggcatcgcgctggtggccaccggcctcgccaagctggccgagacggaggggaagggcgtgttcgacgaggccaagaagaccgtcgaggcgctgaacgggtacctcaacaagcacaaggacgaggtggacaaggcctccgccgacagcatgatcaccaacctgctgaagcacatcgccaaggcccaggagctctacaagaactccagcgcgctgcgcgcccagggcgcccagatcgacaccgccttcagctcctactactggctgtacaaggccggcgtgacgcccgagaccttccccaccgtcagccagttcctcttcgagctggggaagcagccccggggcaccaagaagatgaagaaggcgctgctctccacgcccctgaagtgggggaagaagctgtacgagctgttcgccgacgacagcttccagcagaaccgcatctacatgcaccccgccgtgctgaccgccggccggatctccgagatgggggtgtgcttcggcaccatcccggtcgcgaaccccgacgacgccgcccagggcagcgggcacaccaagtccatcctgaacctccgcacgaacaccgagaccaacaacccctgccccaagaccatcgtgaagctgttcgagatccagaagacgggcttcaacatccaggacatggacatcgtcgccagcgagcacctcctccaccagtccctggtggggaagcagagcccgttccagaacgcctacaacgtgaagggcaacgcgacctccgccaacatcatctga

SEQ ID NO: 6701 - RNA, 1449 nt, synthetic construct
  misc_feature 1..1449: note = derived and/or modified CDS sequence (opt1) from CCHFV(79121M18)__GU477494.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagcgggggctggagtggttcgagaagaacgccggcaccatcaagagctgggacgagtcctacacggagctcaaggtcgaggtgcccaagatcgagcagctggccgactaccagcaggccgcgctgaagtggcgcaaggacatcgggttccgggtgaacgccaacaccaccgccctcagccacaaggtcctggccgagtacaaggtgcccggcgagatcgtgatgtccgtcaaggagatgctgagcgacatgatccgccggcgcaacctcatcctgaaccggggcggggacgagagcccccgcggcccggtgtcccgggagcacgtggagtggtgccgcgagttcgtcaaggggaagtacatcatggccttcaacccgccctggggcgacatcaacaagtccgggcggagcggcatcgcgctggtggccaccggcctcgccaagctggccgagacggaggggaagggcgtgttcgacgaggccaagaagaccgtcgaggcgctgaacgggtacctcaacaagcacaaggacgaggtggacaaggcctccgccgacagcatgatcaccaacctgctgaagcacatcgccaaggcccaggagctctacaagaactccagcgcgctgcgcgcccagggcgcccagatcgacaccgccttcagctcctactactggctgtacaaggccggcgtgacgcccgagaccttccccaccgtcagccagttcctcttcgagctggggaagcagccccggggcaccaagaagatgaagaaggcgctgctctccacgcccctgaagtgggggaagaagctgtacgagctgttcgccgacgacagcttccagcagaaccgcatctacatgcaccccgccgtgctgaccgccggccggatctccgagatgggggtgtgcttcggcaccatcccggtcgcgaaccccgacgacgccgcccagggcagcgggcacaccaagtccatcctgaacctccgcacgaacaccgagaccaacaacccctgcgccaagaccatcgtgaagctgttcgagatccagaagacgggcttcaacatccaggacatggacatcgtcgccagcgagcacctcctccaccagtccctggtggggaagcagagccccttccagaacgcgtacaacgtgaagggcaacgccacctccgccaacatcatctga

SEQ ID NO: 6702 - RNA, 1449 nt, synthetic construct
  misc_feature 1..1449: note = derived and/or modified CDS sequence (opt1) from CCHFV(AP92)__DQ211638.1__N
  source 1..1449: mol_type = other RNA
atggagaacaagatcgaggtgaacagcaaggacgacctgaacaagtggttcgaggagttcaagaagggcaacgggctcgtcgacaccttcaccaactcctacagcttctgcgagaacgtgcccaacctggaccgcttcgtgtaccagatggcctccgccacggacgacgcgcagaaggacagcatctacgcctccgccctggtcgaggccaccaagtactgcgccccgatctacgagtgcgcgtgggtgagctccaccggcatcgtgaagaaggggctcgagtggttcgagaagaacaccagcacgatcaagtcctgggacgagagctacaccgagctgaaggtcgacatccccaagatcgagcagctgtccagctaccagcaggccgccctcaagtggcggaaggacatcggcttccgcatcaacgccaacaccaccgcgctgtccaacaaggtgctggccgagtacaaggtgcccggggagatcctcgtccccgtgaaggagatgctgagcgacatgatccggcgccggaacatcatcctgaaccgcggctccgacgagaacccgcggggccccgtgagccacgagcacatcgagtggtgccgcgagttcatcaaggggaagtacatcatggccttcaacccgccctggggcgacatcaacaagtccgggcggagcggcatcgccctcgtcgccacggggctggcgaagctggccgagaccgagggcaagggcgtgttcgaggaggccaagaagaccgtggaggccctcaaggactacctggacaagcaccgcgacgaggtcgacaagacctccgccgacaacatggtgacgagcctgctcaagcacatcgcgaaggcccaggagctgtacaagaacagctccgccctgcgggcccagggggcccagatcgacacccccttcagctccttctactggctctacaaggcgggcgtgacccccgagaccttccccacggtcagccagttcctgttcgagctggggaagcagccccgcggcaccaagaagatgaagaaggccctcctgtccaccccgatgaagtggggcaagaagctgtacgagctgttcgccgacgacagcttccagcagaaccggatctacatgcaccccgccgtgctgaccgccgggcgcatctccgagatgggcgtgtgcttcgggacgatccccgtcgcgaaccccgacgacgccgcccagggcagcgggcacaccaagtccatcctgaacctccggaccaacaccgagagcaacaacccgtgcgcccgcacgatcgtgaagctgttcgagatccagaagaccggcttcgacatcaaggacatggacatcgtggcgtccgagcacctcctccaccagagcctggtcggcaagcagtcccccttccagaacgcctacaacgtgaaggggaacgccaccagcgccaacatcatctga

SEQ ID NO: 6703 - RNA, 1449 nt, synthetic construct
  misc_feature 1..1449: note = derived and/or modified CDS sequence (opt1) from CCHFV(ArD15786)__DQ211640.1__N
  source 1..1449: mol_type = other RNA
atggagaacaagatcgaggtgaacaacaaggacgagctgaacaagtggttcgaggagttcaagaagggcaacgggctcgtcgacaccttcaccaacagctactccttctgcgagaacgtgcccaacctggaccgcttcgtgttccagatggccggcgccacggacgacgcgcagaaggacagcatctacgcctccgccctggtcgaggccaccaagtactgcgccccgatctacgagtgcgcgtgggtgagctccaccgggatcgtgaagcggggcctcgagtggttcgagaagaacaccgggacgatcaagagctgggacgagtcctacaccgagctgaaggtcgacgtgcccaagatcgagcagctggccaactaccagcaggccgccctcaagtggcgcaaggacatcggcttccgggtgaacgcgaacaccgccgccctgagcaacaaggtcctgtccgagtacaaggtgcccggcgagatcgtgatgagcgtcaaggagatgctctccgacatgatccgccggcgcaacctgatcctgaaccgcgggggcgacgagaacccccgggggccggtgagcaaggagcacatcgagtggtgccgggagttcgtgaagggcaagtacatcatggccttcaacccgccctggggcgacgtcaacaagtccgggcgcagcggcatcgccctcgtggcgaccgggctggccaagctggccgagacggagggcaagggggtgttcgaggaggccaagaagaccgtcgaggccctcaaggagtacctggacaagcacaaggacgaggtggacaaggcgtccgccgacagcatggtgaccaacctgctcaagcacatcaccaaggcccaggagctgtacaagaactccagcgccctgcgggcccagggcgcgcagatcgacacgcccttctccagcttctactggctctacaaggccggcgtcacccccgagaccttccccaccgtgagccagttcctgttcgagctggggaagcagccccgcggcacgaagaagatgaagaaggccctcctgtccacccccatgaagtgggggaagaagctgtacgagctgttcgccgacgacagcttccagcagaaccggatctacatgcacccggccgtgctgaccgcgggccgcatctccgagatgggggtctgcttcggcaccatccccgtggccaaccccgacgacgccgcccagggcagcgggcacacgaagtccatcctgaacctccggaccaacagcgagaccaacaacccctgcgcgaagaccatcgtcaagctgttcgaggtgcagaagacgggcttcaacatccaggacatggacatcgtggcctccgagcacctcctccaccagagcctggtcgggaagcagtccccgttccagaacgcctacaacgtgaagggcaacgccaccagcgccaacatcatctga

SEQ ID NO: 6704 - RNA, 1449 nt, synthetic construct
  misc_feature 1..1449: note = derived and/or modified CDS sequence (opt1) from CCHFV(ArD39554)__DQ211641.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgacaagttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagcgcgggctggagtggttcgagaagaacgccggcaccatcaagagctgggacgagtcctacacggagctcaaggtcgacgtgcccaagatcgagcagctggccaactaccagcaggccgcgctgaagtggcggaaggacatcgggttccgcgtgaacgccaacaccgccgccctcagcaacaaggtcctggccgagtacaaggtgcccggcgagatcgtgatgtccgtcaaggagatgctgagcgacatgatccggcgccggaaccagatcctcaaccgcggcggggacgagaacccccggggcccggtgtcccgcgagcacgtggactggtgccgggagttcgtcaaggggaagtacatcatggcgttcaacccgccctggggcgacatcaacaagagcgggcgctccggcatcgccctggtggccaccggcctggccaagctcgccgagaccgaggggaagggcgtgttcgacgaggcgaagaagacggtcgaggccctgaacgggtacctggacaagcacaaggacgaggtggacaaggccagcgccgactccatgatcaccaacctcctgaagcacatcgccaaggcgcaggagctgtacaagaacagctccgccctccgggcccagggcgcccagatcgacaccgccttcagcagctactactggctgtacaaggcgggcgtgacccccgagacgttccccaccgtctcccagttcctgttcgagctcgggaagcagccccgcggcaccaagaagatgaagaaggccctgctgaccacgcccatgaagtgggggaagaagctctacgagctgttcgccgacgacagcttccagcagaaccggatctacatgcaccccgccgtgctgaccgcgggccgcatctccgagatgggggtgtgcttcggcaccatcccggtcgccaaccccgacgacgccgcccagggcagcgggcacaccaagtccatcctcaacctgcggacgaacaccgagaccaacaacccctgcgcccgcaccatcgtgaagctgttcgagatccagaagacgggcttcaacatccaggacatggacatcgtcgcgagcgagcacctcctgcaccagtccctggtggggaagcagagccccttccagaacgcctacaacgtgaagggcaacgccacctccgccaacatcatctga

SEQ ID NO: 6705 - RNA, 1449 nt, synthetic construct
  misc_feature 1..1449: note = derived and/or modified CDS sequence (opt1) from CCHFV(BT958)__EF123122.1__N
  source 1..1449: mol_type = other RNA
atggagaacaagatcgaggtgaacaacaaggacgagatgaaccgctggttcgaggagttcaagaaggagaacggcctggtcgacaccttcaccaacagccactccttctgcgagagcgtgcccaacctcgacaagttcgtgttccagatggcctccgccacggacgacgcgcagaaggacagcatctacgccgccgccctggtcgaggccaccaagttctgcgcgccgatctacgagtgcgcctgggtgtccagcaccgggatcgtgaagaagggcctggagtggttcgagaagaacgccgggaccatcaagtcctgggacgagagctacacggagctcaaggtcgaggtgcccaagatcgagcagctgtccaactaccagcaggccgcgctgaagtggcggaaggacatcggcttccgcgtgaacgccaacaccgccaccctcagccacaaggtcctggccgagtacaaggtgcccggggagatcgtgatgtccgtcaaggagatgctgagcgacatgatccggcgccggaacctcatcctgaaccgcggcggcgacgagaacccccgggggccggtgtcccgcgagcacgtggagtggtgccgggagttcgtcaagggcaagtacatcatggccttcaacccgccctggggcgacatcaacaagagcgggcgctccgggatcgcgctggtggccaccggcctcgccaagctggccgaggccgagggcaagggggtgttcgacgaggcgaagaagacggtcgaggccctgaacggctacctcgacaagcacaaggacgaggtggacaagagctccgccgacagcatgatcaccaacctgctgaagcacatcgccaaggcccaggagctctaccggaactccagcgcgctgcgcgcccagggggcccagatcgacaccgccttcagctcctactactggctgtacaaggccggcgtgacccccgagacgttccccaccgtcagccagttcctcttcgagctgggcaagcagccccgggggaccaagaagatgaagaaggcgctgctctccacccccatgaagtggggcaagaagctgtacgagctgttcgccgacgacagcttccagcagaaccgcatctacatgcaccccgccgtgctcacggccgggcggatctccgagatgggcgtgtgcttcgggaccatcccggtcgcgaaccccgacgacgccgccctgggcagcggccacaccaagtccatcctgaacctccgcaccagcacggaggccaacaacccctgcgccaagaccatcgtgaagctgttcgagatccagaagaaggggttcgtcatcaaggacatggacatcgtggcgtccgagcacctcctgcaccagagcctggtgggcaagcagtcccccttccagaacgcctacaacgtcaaggggaacgccaccagcgccaacatcatctga

SEQ ID NO: 6706 - RNA, 1449 nt, synthetic construct
  misc_feature 1..1449: note = derived and/or modified CDS sequence (opt1) from CCHFV(C-68031)__DQ211642.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgagcgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacatcgagctcaaggtcgaggtgcccaagatcgagcagctggccaactaccagcaggccgcgctgaagtggcggaaggacatcgggttccgcgtgaacgccaacacggccgccctcagccacaaggtcctggccgagtacaaggtgcccggcgagatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaagtacatcatggcgttcaacccgccctggggcgacatcaacaagagcgggcgctccggcatcgccctggtggccaccggcctcgccaagctggccgagaccgaggggaagggcgtgttcgacgaggcgaagaagaccgtcgaggccctgaacgggtacctcgacaagcacaaggacgaggtggacaaggccagcgccgacaacatgatcacgaacctgctgaagcacatcgccaaggcgcaggagctctacaagaactccagcgccctgcgggcccagggcgcccagatcgacaccgccttctccagctactactggctgtacaaggcgggcgtgacccccgagaccttccccacggtcagccagttcctcttcgagctggggaagcagccccgcggcaccaagaagatgaagaaggccctgctctccacccccatgaagtgggggaagaagctgtacgagctgttcgccgacgacagcttccagcagaaccggatctacatgcaccccgccgtgctcaccgcgggccgcatctccgagatgggggtgtgcttcggcacgatcccggtcgccaaccccgacgacgccgcccagggcagcgggcacaccaagtccatcctgaacctgcggaccaacaccgagacgaacaacccctgcgccaagaccatcgtgaagctgttcgagatccagaagaccggcttcaacatccaggacatggacatcgtcgcgagcgagcacctcctgcaccagtccctcgtggggaagcagagccccttccagaacgcctacaacgtgaagggcaacgccacctccgccaacatcatctga

SEQ ID NO: 6707 - RNA, 1449 nt, synthetic construct
  misc_feature 1..1449: note = derived and/or modified CDS sequence (opt1) from CCHFV(China)__AF354296.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgagcgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccaactaccagcaggccgcgctgaagtggcggaaggacatcgggttccgcgtgaacgccaacaccgccgccctcagccacaaggtcctggccgagtacaaggtgcccggcgagatcgtgatgtccgtcaaggagatgctgagcgacatgatccggcgccggaacctcatcctgaactccggcggggacgagaacccccgcggcccggtgagccgggagcacgtggagtggtgccgcgagttcgtcaaggggaagtacatcatggcgttcaacccgccctggggcgacatcaacaagtccgggcggagcggcatcgccctggtggccaccggcctcgccaagctggccgagaccgggggcaagggggtgttcgacgaggcgaagaagacggtcgaggccctgaacggctacctcgacaagcacaaggacgaggtggacaaggcctccgccgacaacatgatcaccaacctgctgaagcacatcgccaaggcgcaggagctctacaagaacagctccgccctgcgcgcccagggcgcccagatcgacaccgccttcagcagctactactggctgtacaaggcgggggccacccccgagacgttccccaccgtgtcccagttcctcttcgagctgggcaagcagccccgggggaccaagaagatgaagaaggccctgctcagcacccccatgaagtggggcaagaagctgtacgagctgttcgccgacgactccttccagcagaaccgcatctacatgcaccccgcggtcctcacggccgggcggatcagcgagatgggcgtgtgcttcggcaccatcccggtggccaaccccgacgacgccgcccaggggtccggccacaccaagagcatcctgaacctgcgcaccaacacggagaccaacaacccctgcgcgaagaccatcgtccggctgttcgagatccagaagaccgggttcaacatccaggacatggacatcgtggcctccgagcacctcctgcaccagagcctcgtcggcaagcagtcccccttccagaacgcctacaacgtgaaggggaacgccacgagcgccaacatcatctga

SEQ ID NO: 6708 - RNA, 1449 nt, synthetic construct
  misc_feature 1..1449: note = derived and/or modified CDS sequence (opt1) from CCHFV(China)__AF358784.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagcgggggctggagtggttcgagaagaacgccggcaccatcaagagctgggacgagtcctacacggagctcaaggtcgaggtgcccaagatcgagcagttcgccgactaccagcaggccgcgctgaagtggcgcaaggacatcgggttccgggtgaacgccaacaccaccgccctgagccacaaggtcctcgccgagtacaaggtgcccggcgagatcgtgatgtccgtcaaggagatgctgagcgacatgatccgccggcgcaacctgatcctcaaccggggcggggacgagagcccccgcggcccggtgtcccgggagcacgtggagtggtgccgcgagttcgtcaaggggaagtacatcatggccttcaacccgccctggggcgacatcaacaagtccgggcggagcggcatcgcgctggtggccaccggcctggccaagctcgccgagacggaggggaagggcgtgttcgacgaggccaagaagaccgtcgaggcgctgaacgggtacctgaacaagcacaaggacgaggtggacaaggcctccgccgacagcatgatcaccaacctcctgaagcacatcgccaaggcccaggagctgtacaagaactccagcgcgctccgcgcccagggcgcccagatcgacaccgccttcagctcctactactggctgtacaaggccggcgtgacgcccgagaccttccccaccgtcagccagttcctgttcgagctcgggaagcagccccggggcaccaagaagatgaagaaggcgctgctgtccacgcccctcaagtgggggaagaagctgtacgagctgttcgccgacgacagcttccagcagaaccgcatctacatgcaccccgccgtgctcaccgccggccggatctccgagatgggggtgtgcttcggcaccatcccggtcgcgaaccccgacgacgccgcccagggcagcgggcacaccaagtccatcctgaacctgcgcacgaacaccgagaccaacaacccctgcgccaagaccatcgtgaagctgttcgagatccagaagacgggcttcaacatccaggacatggacatcgtcgccagcgagcacctcctgcaccagtccctcgtggggaagcagagccccttccagaacgcgtacaacgtgaagggcaacgccacctccgccaacatcatctga

SEQ ID NO: 6709 - RNA, 1449 nt, synthetic construct
  misc_feature 1..1449: note = derived and/or modified CDS sequence (opt1) from CCHFV(China)__AF362080.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgagcgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctgaccaactaccagcaggccgccctgaagtggcggaaggacatcgggttccgcgtgaacgcgaacaccgccgccctcagccacaaggtcctggccgagtacaaggtgcccggcgagatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggacctacatcatggccttcaacccgccctggggcgacatcaacaagagcgggcgctccggcatcgcgctggtggccacgggcctcgccaagctggccgagaccgaggggaagggcgtgttcgacgaggccaagaagaccgtcgaggcgctgaacgggtacctcgacaagcacaaggacgaggtggacaaggccagcgccgacaacatgatcaccaacctgctgaagcacatcgccaaggcccaggagctctacaagaactccagcgcgctgcgggcccagggcgcccagatcgacacggccttctccagctactactggctgtacaaggccggcgtgacccccgagaccttccccaccgtcagccagttcctcttcgagctggggaagcagccccgcggcacgaagaagatgaagaaggcgctgctctccacccccatgaagtgggggaagaagctgtacgagctgttcgccgacgacagcttccagcagaaccggatctacatgcaccccgccgtgctcaccgccggccgcatctccgagatgggggtgtgcttcggcaccatcccggtcgcgaaccccgacgacgccgcccagggcagcgggcacacgaagtccatcctgaacctgcggaccaacaccgagaccaacaacccctgcgccaagacgatcgtgaagctgttcgagatccagaagaccggcttcaacatccaggacatggacatcgtcgccagcgagcacctcctgcaccagtccctcgtggggaagcagagccccttccagaacgcgtacaacgtgaagggcaacgccacctccgccaacatcatctga

SEQ ID NO: 6710 - RNA, 1449 nt, synthetic construct
  misc_feature 1..1449: note = derived and/or modified CDS sequence (opt1) from CCHFV(China)__AY029157.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgagcgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccaactaccagcaggccgcgctgaagtggcggaaggacatcgggttccgcgtgaacgccaacaccgccgccctcagccacaaggtcctggccgagtacaaggtgcccggcgagatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaagtacatcatggcgttcaacccgccctggggcgacatcaacaagagcgggcgctccggcatcgccctggtggccaccggcctcgccaagctggccgagaccgaggggaagggcgtgttcgacgaggcgaagaagacggtcgaggccctgaacgggtacctcgacaagcacaaggacgaggtggacaaggccagcgccgacaacatgatcaccaacctgctgaagcacatcgccaaggcgcaggagctctacaagaactccagcgccctgcgggcccagggcgcccagatcgacaccgccttctccagctactactggctgtacaaggcgggcgtgacccccgagacgttccccaccgtcagccagttcctcttcgagctggggaagcagccccgcggcaccaagaagatgaagaaggccctgctctccacccccatgaagtgggggaagaagctgtacgagctgttcgccgacgacagcttccagcagaaccggatctacatgcaccccgccgtgctcacggcgggccgcatctccgagatgggggtgtgcttcggcaccatcccggtcgccaaccccgacgacgccgcccagggcagcgggcacaccaagtccatcctgaacctgcggaccaacacggagaccaacaacccctgcgccaagaccatcgtgaagctgttcgagatccagaagaccggcttcaacatccaggacatggacatcgtcgcgagcgagcacctcctgcaccagtccctcgtggggaagcagagccccttccagaacgcctacaacgtgaagggcaacgccacgtccgccaacatcatctga

SEQ ID NO: 6711 - RNA, 1449 nt, synthetic construct
  misc_feature 1..1449: note = derived and/or modified CDS sequence (opt1) from CCHFV(DAK 8194)__U88411.1__N
  source 1..1449: mol_type = other RNA
atggagaacaagatcgaggtgaacaacaaggacgagctgaacaagtggttcgaggagttcaagaagggcaacgggctcgtcgacaccttcaccaacagctactccttctgcgagaacatgcccaacctggaccgcttcgtgttccagatggccggcgccacggacgacgcgcagaaggacagcatctacgcctccgccctggtggaggccaccaagtactgcgccccgatctacgagtgcgcgtgggtcagctccaccgggatcgtgaagcggggcctcgagtggttcgagaagaacaccgggacgatcaagagctgggacgagtcctacaccgagctgaaggtggacgtccccaagatcgagcagctggccaactaccagcaggccgccctcaagtggcgcaaggacatcggcttccgggtgaacgcgaacaccgccgccctgagcaacaaggtgctgtccgagtacaaggtccccggcgagatcgtgatgagcgtgaaggagatgctctccgacatgatccgccggcgcaacctgatcctgaaccgcgggggcgacgagaacccccgggggccggtcagcaaggagcacatcgagtggtgccgggagttcgtgaagggcaagtacatcatggccttcaacccgccctggggcgacgtgaacaagtccgggcgcagcggcatcgccctcgtcgcgaccgggctggccaagctggccgagacggagggcaagggggtgttcgaggaggccaagaagaccgtggaggccctcaaggagtacctggacaagcacaaggacgaggtcgacaaggcgtccgccgacagcatggtgaccaacctgctcaagcacatcaccaaggcccaggagctgtacaagaactccagcgccctgcgggcccagggcgcgcagatcgacacgcccttctccagcttctactggctctacaaggccggcgtgacccccgagaccttccccaccgtcagccagttcctgttcgagctggggaagcagccccgcggcacgaagaagatgaagaaggccctcctgtccacccccatgaagtgggggaagaagctgtacgagctgttcgccgacgacagcttccagcagaaccggatctacatgcacccggccgtgctgaccgcgggccgcatctccgagatgggggtgtgcttcggcaccatccccgtcgccgaccccgacgacgccgcccagggcagcgggcacacgaagtccatcctgaacctccggaccagctccgagaccaacaacccctgcgcgaagaccatcgtgaagctgttcgaggtccagaagacgggcttcaacatccaggacatggacatcgtggccagcgagcacctcctccaccagtccctggtggggaagcagagcccgttccagaacgcctacaacgtcaagggcaacgccacctccgccaacatcatctga

SEQ ID NO: 6712 - RNA, 1449 nt, synthetic construct
  misc_feature 1..1449: note = derived and/or modified CDS sequence (opt1) from CCHFV(Drosdov)__U88412.1__N
  source 1..1449: mol_type = other RNA
atggagaacaagatcgaggtgaacagcaaggacgagatgaacaagtggttcgaggagttcaagaaggagaacggcctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccgggatcgtgaagaagggcctggagtggttcgagaagaacagcgggaccatcaagtcctgggacgagaactacacggagctcaaggtggacgtccccaagatcgagcagctggccaactaccagcaggccgccctgaagtggcgcaaggacatcggcttccgggtgaacgcgaacaccgccgccctcagcaacaaggtgctggccgagtacaaggtccccggggagatcgtgatgtccgtgaaggagatgctgagcgacatgatccgccggcgcaacctcatcctgaaccggggcggcgacgagaacccccgcgggccggtctcccgggagcacgtggagtggtgccgcgagttcgtgaagggcaagtacatcatggccttcaacccgccctggggcgacatcaacaagagcgggcggtccgggatcgcgctggtcgccaccggcctcgccaagctggccgagaccgagggcaagggggtgttcgacgaggccaagaagacggtggaggcgctgaacggctacctcgacaagcaccgcgacgaggtcgacaaggccagcgccgactccatgatcaccaacctgctgaagcacatcgccaaggcccaggagctctacaagaacagctccgcgctgcgggcccagggggcccagatcgacacccccttcagcagcttctactggctgtacaaggccggcgtgacccccgagacgttccccaccatctcccagttcctcttcgagctgggcaagcagccccgcgggaccaagaagatgaagaaggccctgctcagcacccccatgaagtggggcaagaagctgtacgagctgttcgcggacgactccttccagcagaaccggatctacatgcacccggccgtgctcacggccgggcgcatcagcgagatgggcgtctgcttcgggaccatccccgtggccaaccccgacgacgcggcccagggctccggccacaccaagagcatcctgaacctgcggacctccacggagaccaacaacccctgcgccaagaccatcgtgaagctgttcgagatccagaagaccgggttcaacatccaggacatggacatcgtcgccagcgagcacctcctgcaccagtccctcgtgggcaagcagagcccgttccagaacgcctacaacgtcaaggggaacgcgacgtccgccaacatcatctga

SEQ ID NO: 6713 - RNA, 1449 nt, synthetic construct
  misc_feature 1..1449: note = derived and/or modified CDS sequence (opt1) from CCHFV(Eskisehir23-2012)__KR092376.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacaccggcacgatcaagagctgggacgagaactacgccgagctcaaggtggacgtccccaagatcgagcagctggccaactaccagcaggccgcgctgaagtggcgcaaggacatcgggttccgggtgaacgccaacaccgccgccctctccaacaaggtgctggccgagtacaaggtccccggcgagatcgtgatgagcgtgaaggagatgctgtccgacatgatccgccggcgcaacctcatcctgaaccggggcgggggcgagaacccccgcgggccggtcagccgggagcacgtggagtggtgccgcgagttcgtgaagggcaagtacatcatggcgttcaacccgccctggggcgacatcaacaagtccgggcggagcggcatcgccctggtcgccaccgggctcgccaagctggccgagaccgagggcaagggggtgttcgacgaggcgaagcgcacggtggaggccctgaacggctacctcgacaagcaccgggacgaggtcgacaaggcctccgccgacagcatgatcaccaacctgctgaagcacatcgccaaggcgcaggagctctacaagaactccagcgccctgcgcgcccagggcgcccagatcgacacccccttctccagcttctactggctgtacaaggccggggtgacccccgagacgttccccaccatcagccagttcctcttcgagctgggcaagcagccccgggggaccaagaagatgaagaaggcgctgctctccacccccatgaagtggggcaagaagctgtacgagctgttcgccgacgacagcttccagcagaaccgcatctacatgcacccggccgtgctcacggccgggcggatctccgagatgggcgtctgcttcggcaccatccccgtggcgaaccccgacgacgccgcccaggggagcggccacaccaagtccatcctgaacctgcgcaccagcacggagaccaacaacccctgcgccaagaccatcgtgaagctgttcgagatccagaagaccgggttcaacatccaggacatggacatcgtcgcctccgagcacctcctgcaccagagcctcgtgggcaagcagtccccgttccagaacgcgtacaacgtcaaggggaacgccacgagcgccaacatcatctga

SEQ ID NO: 6714 - RNA, 1449 nt, synthetic construct
  misc_feature 1..1449: note = derived and/or modified CDS sequence (opt1) from CCHFV(Hodzha)__AY223475.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccaactaccagcaggccgcgctgaagtggcggaaggacatcgggttccgcgtgaacgccaacaccgccgccctcagccacaaggtcctgtccgagtacaaggtgcccggcgagatcgtgatgagcgtcaaggagatgctgtccgacatgatccggcgccggaacctcatcctgaaccgcggcggggacgagaacccccggggcccggtgagccgcgagcacgtggagtggtgccgggagttcgtcaaggggaagtacatcatggccttcaacccgccctggggcgacatcaacaagtccgggcgcagcggcatcgcgctggtggccaccggcctcgccaagctggccgagaccgaggggaagggcgtgttcgacgaggccaagaagacggtcgaggcgctgaacgggtacctcgacaagcacaaggacgaggtggacaaggcctccgccgacaacatgaccaccaacctgctgaagcacatcgccaaggcccaggagctctacaagaacagctccgcgctgcgggcccagggcgcccagatcgacaccgccttcagcagctactactggctgtacaaggccggcgtgacgcccgagaccttccccaccgtctcccagttcctcttcgagctggggaagcagccccgcggcaccaagaagatgaagaaggcgctgctcagcacgcccatgaagtgggggaagaagctgtacgagctgttcgccgacgactccttccagcagaaccggatctacatgcaccccgccgtgctcaccgccggccgcatcagcgagatgggggtgtgcttcggcaccgtcccggtggcggaccccgacgacgccgcccagggctccgggcacaccaagagcatcctgaacctgcggacgaacaccgagaccaacaacccctgcgccaagaccatcgtcaagctgttcgagatccagaagacgggcttcaacatccaggacatggacatcgtggcctccgagcacctcctgcaccagagcctcgtggggaagcagtcccccttccagaacgcgtacaacgtcaagggcaacgccaccagcgccaacatcatctga

SEQ ID NO: 6715 - RNA, 1449 nt, synthetic construct
  misc_feature 1..1449: note = derived and/or modified CDS sequence (opt1) from CCHFV(Iran-52)__DQ446212.1__N
  source 1..1449: mol_type = other RNA
atggagaacaagatcgaggtgaacagcaaggacgagatgaacaagtggttcgaggagttcaagaagggcaacgggctggtcgacaccttcaccaactcctacagcttctgcgagtccgtgcccaacctcgaccgcttcgtgttccagatggccagcgccacggacgacgcgcagaaggactccatctacgccagcgccctggtcgaggccaccaagttctgcgccccgatctacgagtgcgcgtgggcctccagcaccggcatcgtgaagaaggggctggagtggttcgagaagaacgccggcaccatcaagtcctgggacgagagctacacggagctcaaggtggaggtccccaagatcgagcagctgtccaactaccagcaggccgcgctgaagtggcggaaggacatcgggttccgcgtgaacgccaacaccgccgccctcagcaacaaggtgctggccgagtacaaggtccccggcgagatcgtgatgtccgtgaaggagatgctgagcgacatgatccggcgccggaacctcatcctgaaccgcggcggggacgagaacccccggggcccggtctcccgcgagcacgtggagtggtgccgggagttcgtgaaggggaagtacatcatggcgttcaacccgccctggggcgacatcaacaagagcgggcgctccggcatcgccctggtcgccaccggcctcgccaagctggccgagaccgaggggaagggcgtgttcgacgaggcgaagaagacggtggaggccctgaacgggtacctcgacaagcacaaggacgaggtcgacaaggccagcgccgactccatgatcaccaacctgctgaagcacatcgccaaggcgcaggagctctacaagaacagcagcgccctgcgggcccagggcgcccagatcgacaccgtgttctccagctactactggctgtacaaggccggcgtgacccccgacacgttccccaccgtctcccagttcctcttcgagctggggaagcagccccgcggcaccaagaagatgaagaaggcgctgctcagcacccccatgaagtgggggaagaagctgtacgagctgttcgccgacgactccttccagcagaaccggatctacatgcaccccgccgtgctcacggccggccgcatcagcgagatgggggtgtgcttcggcaccatcccggtcgcgaaccccgacgacgccgccctgggctccgggcacaccaagagcatcctgaacctccggaccaacacggagaccaacaacccctgcgcccgcaccatcgtgaagctgttcgagatccagaagaccggcttcaacatccaggacatggacatcgtcgcctccgagcacctcctgcaccagagcctggtggggaagcagtcccccttccagaacgcgtacaacgtgaagggcaacgccacgagcgccaacatcatctga

SEQ ID NO: 6716 - RNA, 1449 nt, synthetic construct
  misc_feature 1..1449: note = derived and/or modified CDS sequence (opt1) from CCHFV(Iran-53)__DQ446213.1__N
  source 1..1449: mol_type = other RNA
atggagaacaagatcgaggtgaacagcaaggacgagatgaacaagtggttcgaggagttcaagaagggcaacgggctggtcgacaccttcaccaactcctacagcttctgcgagtccgtgcccaacctcgaccgcttcgtgttccagatggccagcgccacggacgacgcgcagaaggactccatctacgccagcgccctggtcgaggccaccaagttctgcgccccgatctacgagtgcgcgtgggcctccagcaccggcatcgtgaagaaggggctggagtggttcgagaagaacgccggcaccatcaagtcctgggacgagagctacacggagctcaaggtggaggtccccaagatcgagcagctgtccaactaccagcaggccgcgctgaagtggcggaaggacatcgggttccgcgtgaacgccaacaccgccgccctcagcaacaaggtgctggccgagtacaaggtccccggcgagatcgtgatgtccgtgaaggagatgctgagcgacatgatccggcgccggaacctcatcctgaacaagggcggggacgagaacccccgcggcccggtctcccgggagcacgtggagtggtgccgcgagttcgtgaaggggaagtacatcatggcgttcaacccgccctggggcgacatcaacaagagcgggcggtccggcatcgccctggtcgccaccggcctcgccaagctggccgagaccgaggggaagggcgtgttcgacgaggcgaagaagacggtggaggccctgaacgggtacctcgacaagcacaaggacgaggtcgacaaggccagcgccgactccatgatcaccaacctgctgaagcacatcgccaaggcgcaggagctctacaagaacagcagcgccctgcgcgcccagggcgcccagatcgacaccgtgttctccagctactactggctgtacaaggccggcgtgacccccgacacgttccccaccgtctcccagttcctcttcgagctggggaagcagccccggggcaccaagaagatgaagaaggcgctgctcagcacccccatgaagtgggggaagaagctgtacgagctgttcgccgacgactccttccagcagaaccgcatctacatgcaccccgccgtgctcacggccggccggatcagcgagatgggggtgtgcttcggcaccatcccggtcgcgaaccccgacgacgccgccctgggctccgggcacaccaagagcatcctgaacctccgcaccaacacggagaccaacaacccctgcgcccggaccatcgtgaagctgttcgagatccagaagaccggcttcaacatccaggacatggacatcgtcgcctccgagcacctcctgcaccagagcctggtggggaagcagtcccccttccagaacgcgtacaacgtgaagggcaacgccacgagcgccaacatcatctga

SEQ ID NO: 6717 - RNA, 1449 nt, synthetic construct
  misc_feature 1..1449: note = derived and/or modified CDS sequence (opt1) from CCHFV(JD 206)__U88414.1__N
  source 1..1449: mol_type = other RNA
atggagaacaagatcgaggtgaacagcaaggacgagatgaacaagtggttcgaggagttcaagaagggcaacgggctggtcgacaccttcaccaactcctacagcttctgcgagaacgtgcccaacctcgaccgcttcgtgttccagatggcctccgccacggacgacgcgcagaaggacagcatctacgcctccgccctggtcgaggccaccaagttctgcgccccgatctacgagtgcgcgtgggccagctccaccggcatcgtgaagaaggggctggagtggttcgagaagaacgccggcaccatcaagagctgggacgagtcctacacggagctcaaggtggaggtccccaagatcgagcagctgagcaactaccagcaggccgcgctgaagtggcggaaggacatcgggttccgcgtgaacgccaacaccgccgccctctccaacaaggtgctggccgagtacaaggtccccggcgagatcgtgatgagcgtgaaggagatgctgtccgacatgatccggcgccggaacctcatcctgaaccgcggcggggacgagaacccccggggcccggtcagccgcgagcacgtggagtggtgccgggagttcgtgaaggggatgtacatcatggcgttcaacccgccctggggcgacatcaacaagtccgggcgcagcggcatcgccctggtcgccaccggcctcgccaagctggccgagaccgaggggaagggcgtgttcgacgaggcgaagaagacggtggaggccctgaacgggtacctcgacaagcacaaggacgaggtcgacaaggcctccgccgacagcatgatcaccaacctgctgaagcacatcgccaaggcgcaggagctctacaagaactccagcgccctgcgggcccagggcgcccagatcgacaccgtgttcagctcctactactggctgtacaaggccggcgtgacccccgacacgttccccaccgtcagccagttcctcttcgagctggggaagcagccccgcggcaccaagaagatgaagaaggcgctgctctccacccccatgaagtgggggaagaagctgtacgagctgttcgccgacgacagcttccagcagaaccggatctacatgcaccccgccgtgctcacggccggccgcatctccgagatgggggtgtgcttcggcaccatcccggtcgcgaaccccgacgacgccgccctgggcagcgggcacaccaagtccatcctgaacctccggaccaacacggagaccaacaacccctgcgccaagaccatcgtgaagctgttcgagatccagaagaccggcttcaacatccaggacatggacatcgtcgccagcgagcacctcctgcaccagtccctggtggggaagcagagccccttccagaacgcgtacaacgtgaagggcaacgccacgtccgccaacatcatctga

SEQ ID NO: 6718 - RNA, 1449 nt, synthetic construct
  misc_feature 1..1449: note = derived and/or modified CDS sequence (opt1) from CCHFV(Kashmanov)__DQ211644.1__N
  source 1..1449: mol_type = other RNA
atggagaacaagatcgaggtgaacagcaaggacgagatgaacaagtggttcgaggagttcaagaaggagaacggcctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccgggatcgtgaagaagggcctggagtggttcgagaagaacagcgggaccatcaagtcctgggacgagaactacgccgagctcaaggtggacgtccccaagatcgagcagctggccaactaccagcaggccgcgctgaagtggcgcaaggacatcggcttccgggtgaacgccaacacggccgccctcagcaacaaggtgctggccgagtacaaggtccccggggagatcgtgatgtccgtgaaggagatgctgagcgacatgatccgccggcgcaacctcatcctgaaccggggcggcgacgagaacccccgcgggccggtctcccgggagcacgtggagtggtgccgcgagttcgtgaagggcaagtacatcatggcgttcaacccgccctggggcgacatcaacaagagcgggcggtccgggatcgccctggtcgccaccggcctcgccaagctggccgagaccgagggcaagggggtgttcgacgaggcgaagaagaccgtggaggccctgaacggctacctcgacaagcaccgcgacgaggtcgacaaggccagcgccgactccatgatcacgaacctgctgaagcacatcgccaaggcgcaggagctctacaagaacagctccgccctgcgggcccagggggcccagatcgacacccccttcagcagcttctactggctgtacaaggccggcgtgacccccgagaccttccccacgatctcccagttcctcttcgagctgggcaagcagccccgcgggaccaagaagatgaagaaggcgctgctcagcacccccatgaagtggggcaagaagctgtacgagctgttcgccgacgactccttccagcagaaccggatctacatgcacccggccgtgctcaccgccgggcgcatcagcgagatgggcgtctgcttcgggacgatccccgtggcgaaccccgacgacgccgcccagggctccggccacaccaagagcatcctgaacctgcggacctccaccgagacgaacaacccctgcgccaagaccatcgtgaagctgttcgagatccagaagaccgggttcaacatccaggacatggacatcgtcgccagcgagcacctcctgcaccagtccctcgtgggcaagcagagcccgttccagaacgcgtacaacgtcaaggggaacgccacctccgccaacatcatctga

SEQ ID NO: 6719 - RNA, 1449 nt, synthetic construct
  misc_feature 1..1449: note = derived and/or modified CDS sequence (opt1) from CCHFV(NIV 10405051)__JF922681.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccaactaccagcaggccgcgctgaagtggcggaaggacatcgggttccgcgtgaacgccaacaccgccgccctcagccacaaggtcctggccgagtacaaggtgcccggcgagatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaagtacatcatggcgttcaacccgccctggggcgacatcaacaagagcgggcgctccggcatcgccctggtggccaccggcctcgccaagctggccgagaccgaggggaagggcgtgttcgacgaggcgaagaagacggtcgaggccctgaacgggtacctcgacaagcacaaggacgaggtggacaaggccagcgccgacaacatgatcaccaacctgctgaagcacatcgccaaggcgcaggagctctacaagaactccagcgccctgcgggcccagggcgcccagatcgacaccgccttctccagctactactggctgtacaaggcgggcgtgacccccgagacgttccccaccgtcagccagttcctcttcgagctggggaagcagccccgcggcaccaagaagatgaagaaggccctgctctccacccccatgcggtgggggaagaagctgtacgagctgttcgccgacgacagcttccagcagaaccgcatctacatgcaccccgccgtgctcacggcgggccggatctccgagatgggggtgtgcttcggcaccatcccggtcgccaaccccgacgacgccgcccagggcagcgggcacaccaagtccatcctgaacctgcgcaccaacacggagaccaacaacccctgcgccaagaccatcgtgaagctgttcgagatccagaagaccggcttcaacatccaggacatcgacatcgtcgcgagcgagcacctcctgcaccagtccctcgtggggaagcagagccccttccagaacgcctacaacgtgaagggcaacgccacgtccgccaacatcatctga

SEQ ID NO: 6720 - RNA, 1449 nt, synthetic construct
  misc_feature 1..1449: note = derived and/or modified CDS sequence (opt1) from CCHFV(Oman)__DQ211645.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggccagctccaccggcatcgtgaagaaggggctggagtggttcgagaagaacgccggcaccatcaagagctgggacgagtcctacacggagctcaaggtggaggtccccaagatcgagcagctgagcaactaccagcaggccgcgctgaagtggcggaaggacatcgggttccgcgtgaacgccaacaccgccgccctctccaacaaggtgctggccgagtacaaggtccccggcgagatcgtgatgagcgtgaaggagatgctgtccgacatgatccggcgccggaacctcatcctgaaccgcggcggggacgagaacccccggggcccggtcagccgcgagcacgtggagtggtgccgggagttcatcaaggggaagtacatcatggcgttcaacccgccctggggcgacatcaacaagtccgggcgcagcggcatcgccctggtggccaccggcctcgccaagctggccgagaccgaggggaagggcgtcttcgacgaggcgaagaagacggtggaggccctgaacgggtacctcgacaagcacaaggacgaggtggacaaggcctccgccgacagcatgatcaccaacctgctgaagcacatcgccaaggcgcaggagctctacaagaactccagcgccctgcgggcccagggcgcccagatcgacaccgtcttcagctcctactactggctgtacaaggccggcgtgacccccgacacgttccccaccgtgagccagttcctcttcgagctggggaagcagccccgcggcaccaagaagatgaagaaggcgctgctctccacccccatgaagtgggggaagaagctgtacgagctgttcgccgacgacagcttccagcagaaccggatctacatgcaccccgccgtcctcacggccggccgcatctccgagatgggggtgtgcttcggcaccatcccggtggcgaaccccgacgacgccgccctgggcagcgggcacaccaagtccatcctgaacctccggaccaacacggagaccaacaacccctgcgccaagaccatcgtcaagctgttcgagatccagaagaccggcttcaacatccaggacatggacatcgtggccagcgagcacctcctgcaccagtccctggtcgggaagcagagccccttccagaacgcgtacaacgtgaagggcaacgccacgtccgccaacatcatctga

SEQ ID NO: 6721 - RNA, 1449 nt, synthetic construct
  misc_feature 1..1449: note = derived and/or modified CDS sequence (opt1) from CCHFV(SCT ex Afghanistan)__JX908640.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggccagctccaccggcatcgtgaagaaggggctggagtggttcgagaagaacgccggcaccatcaagagctgggacgagtcctacacggagctcaaggtggaggtccccaagatcgagcagctgagcaactaccagcaggccgcgctgaagtggcggaaggacatcgggttccgcgtgaacgccaacaccgccgccctctccaacaaggtgctggccgagtacaaggtccccggcgagatcgtgatgagcgtgaaggagatgctgtccgacatgatccggcgccggaacctcatcctgaaccgcggcggggacgagaacccccggggcccggtcagccgcgagcacgtggagtggtgccgggagttcatcaaggggaagtacatcatggcgttcaacccgccctggggcgacatcaacaagtccgggcgcagcggcatcgccctggtggccaccggcctcgccaagctggccgagaccgaggggaagggcgtcttcgacgaggcgaagaagacggtggaggccctgaacgggtacctcgacaagcacaaggacgaggtggacaaggcctccgccgacagcatgatcaccaacctgctgaagcacatcgccaaggcgcaggagctctacaagaactccagcgccctgcgggcccagggcgcccagatcgacaccgtcttcagctcctactactggctgtacaaggccggcgtgacccccgagacgttccccaccgtgagccagttcctcttcgagctggggaagcagccccgcggcaccaagaagatgaagaaggcgctgctctccacccccatgaagtgggggaagaagctgtacgagctgttcgccgacgacagcttccagcagaaccggatctacatgcaccccgccgtcctcacggccggccgcatctccgagatgggggtgtgcttcggcaccatcccggtggcgaaccccgacgacgccgccctgggcagcgggcacaccaagtccatcctgaacctccggaccaacacggagaccaacaacccctgcgccaagaccatcgtcaagctgttcgagatccagaagaccggcttcaacatccaggacatggacatcgtggccagcgagcacctcctgcaccagtccctggtcgggaagcagagccccttccagaacgcgtacaacgtgaagggcaacgccacgtccgccaacatcatctga

SEQ ID NO: 6722 - RNA, 1449 nt, synthetic construct
  misc_feature 1..1449: note = derived and/or modified CDS sequence (opt1) from CCHFV(Semunya)__DQ076413.1__N
  source 1..1449: mol_type = other RNA
atggagaacaagatcgaggtgaccagcaaggacgagatgaaccgctggttcgaggagttcaagaagtccaacggcctggtcgacaccttcacgaacagctactccttctgcgagagcgtgcccaacctcgaccggttcgtgttccagatggcctccgccaccgacgacgcgcagaaggacagcatctacgcctccgccctggtcgaggccaccaagttctgcgccccgatctacgagtgcgcgtgggtgagctccaccgggatcgtgaagaagggcctggagtggttcgagaagaacgccgggacgatcaagagctgggacgagtcctacaccgagctcaaggtcggcgtgcccaagatcgagcagctggccaactaccagcaggccgcgctgaagtggcgcaaggacatcgggttccgggtgaacgccaacaccgccgccctcagcaacaaggtcctggccgagtacaaggtgcccggcgagatcgtgatgtccgtcaaggagatgctgagcgacatgatccgccggcgcaacctcatcctgaaccggggcggggacgagaacccccgcggcccggtgtcccgggagcacgtggagtggtgccgcgagttcgtcaaggggaagtacatcatggcgttcaacccgccctggggcgacatcaacaagagcgggcggtccggcatcgccctggtggccaccggcctcgccaagctggccgagacggaggggaagggcgtgttcgacgaggcgaagaagaccgtcgaggccctgaacgggtacctcgacaagcacaaggacgaggtggacaaggccagcgccgacggcatggtgaccaacctgctgaagcacatcgccaaggcgcaggagctctacaagaactccagcgccctgcgcgcccagggcgcccagatcgacacccccttcagctccttctactggctgtacaaggccggggtcagccccgagacgttccccaccgtgtcccagttcctcttcgagctgggcaagcagccccgggggaccaagaagatgaagaaggcgctgctcagcacccccatgaagtggggcaagaagctgtacgagctgttcgccgacgactccttccaggagaaccgcatctacatgcacccggccgtgctcacggccgggcggatcagcgagatgggcgtctgcttcggcaccatccccgtggcgaaccccgacgacgccgcccaggggtccggccacaccaagagcatcctgaacctgcgcaccaacacggagaccaacaacccctgcgccaagaccatcgtcaagctgttcgagatccagaagaccgggttcaacatccaggacatggacatcgtggcctccgagcacctcctgcaccagagcctcgtgggcaagcagtccccgttccagaacgcgtacaacgtcaaggggaacgccacgagcgccaacatcatctga

SEQ ID NO: 6723 - RNA, 1449 nt, synthetic construct
  misc_feature 1..1449: note = derived and/or modified CDS sequence (opt1) from CCHFV(SK 2015/human)__KX129738.1__N
  source 1..1449: mol_type = other RNA
atggagaacaagatcgaggtgaacaacaaggacgagatgaacaagtggttcgaggagttcaagaagggcaacgggctggtcgacacctacaccaacagctactccttctgcgagagcgtgcccaacctcgaccgcttcgtgttccagatggcctccgccacggacgacgcgcagaaggacagcatctacgcctccgccctggtcgaggccaccaagttctgcgccccgatctacgagtgcgcgtgggccagctccaccggcatcgtgaagaaggggctggagtggttcgagaagaacgccggcaccatcaagctctgggacgagagctacgccgagctgaaggtggaggtccccaagatcgagcagctgtccaactaccagcaggcggccctcaagtggcggaaggacatcgggttccgcgtgaacgccaacacggccgccctgagcaacaaggtgctggcggagtacaaggtccccggcgagatcgtgatgtccgtgaaggagatgctcagcgacatgatccggcgccggaacctgatcctgaaccgcggcggggacgagaacccccggggcccggtctcccgcgagcacgtggagtggtgccgggagttcgtgaaggggaagtacatcatggccttcaacccgccctggggcgacatcaacaagagcgggcgctccggcatcgccctcgtcgccaccggcctggccaagctggcggagaccgaggggaagggcgtgttcgacgaggccaagaagaccgtggaggccctcaacgggtacctggacaagcacaaggacgaggtcgacaaggccagcgccgactccatgatcacgaacctgctcaagcacatcgcgaaggcccaggagctgtacaagaacagctccgccctgcgggcccagggcgcccagatcgacaccgtgttcagcagctactactggctctacaaggcgggcgtgacccccgacaccttccccacggtctcccagttcctgttcgagctggggaagcagccccgcggcaccaagaagatgaagaaggccctcctgagcacccccatgaagtgggggaagaagctgtacgagctgttcgccgacgactccttccagcagaaccggatctacatgcaccccgccgtgctcaccgcgggccgcatcagcgagatgggggtgtgcttcggcacggtcccggtggccaaccccgacgacgccgccctgggctccgggcacaccaagagcatcctcaacctgcggaccaacaccgagacgaacaacccctgcgccaagaccatcgtcaagctgttcgagatccagaagaccggcttcaacatccaggacatggacatcgtggcgtccgagcacctcctgcaccagagcctggtggggaagcagtcccccttccagaacgcctacaacgtcaagggcaacgccaccagcgccaacatcatctga

SEQ ID NO: 6724 - RNA, 1449 nt, synthetic construct
  misc_feature 1..1449: note = derived and/or modified CDS sequence (opt1) from CCHFV(SPU128/81/7)__DQ076415.1__N
  source 1..1449: mol_type = other RNA
atggagaacaagatcgaggtgaacaacaagcacgagatgaacaagtggttcgaggagttcaagaagggcaacgggctggtcgacaccttcaccaacagctactccttctgcgagagcgtgcccaacctcgacaagttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagcgcgggctggagtggttcgagaagaacgccggcaccatcaagagctgggacgagtcctacacggagctcaaggtcgacgtgcccaagatcgagcagctggccaactaccagcaggccgcgctgaagtggcggaaggacatcgggttccgcgtgaacgccaacaccgccgccctcagcaacaaggtcctggccgagtacaaggtgcccggcgagatcgtgatgtccgtcaaggagatgctgagcgacatgatccggcgccggaaccagatcctcaaccgcggcggggacgagaacccccggggcccggtgtcccgcgagcacgtggactggtgccgggagttcgtcaaggggaagtacatcatggcgttcaacccgccctggggcgacatcaacaagagcgggcgctccggcatcgccctggtggccaccggcctggccaagctcgccgagaccgaggggaagggcgtgttcgacgaggcgaagaagacggtcgaggtgctgaacgggtacctggacaagcacaaggacgaggtggaccgggccagcgccgactccatgatcaccaacctcctgaagcacatcgccaaggcccaggagctgtacaagaacagctccgcgctccgcgcccagggcgcccagatcgacaccgccttcagcagctactactggctgtacaaggccggcgtcacccccgagacgttccccaccgtgtcccagttcctgttcgagctcgggaagcagccccggggcaccaagaagatgaagaaggcgctgctgagcacccccatgaagtgggggaagaagctctacgagctgttcgccgacgactccttccagcagaaccgcatctacatgcaccccgccgtgctgacggccggccggatcagcgagatgggggtctgcttcggcaccatcccggtggcgaaccccgacgacgccgcccagggctccgggcacaccaagagcatcctcaacctgcgcaccaacacggagaccaacaacccctgcgcccggaccatcgtcaagctgttcgagatccagaagaccggcttcaacatccaggacatggacatcgtggcctccgagcacctcctgcaccagagcctggtggggaagcagtcccccttccagaacgcgtacaacgtcaagggcaacgccacgagcgccaacatcatctga

SEQ ID NO: 6725 - RNA, 1449 nt, synthetic construct
  misc_feature 1..1449: note = derived and/or modified CDS sequence (opt1) from CCHFV(Sudan Al-Fulah 4-2008)__GQ862372.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgacaagttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagcgcgggctggagtggttcgagaagaacgccggcaccatcaagagctgggacgagtcctacacggagctcaaggtcgacgtgcccaagatcgagcagctggccaactaccagcaggccgcgctgaagtggcggaaggacatcgggttccgcgtgaacgccaacaccgccgccctcagcaacaaggtcctggccgagtacaaggtgcccggcgagatcgtgatgtccgtcaaggagatgctgagcgacatgatccggcgccggaaccagatcctcaaccgcggcggggacgagaacccccggggcccggtgtcccgcgagcacgtggactggtgccgggagttcgtcaaggggaagtacatcatggcgttcaacccgccctggggcgacatcaacaagagcgggcgctccggcatcgccctggtggccaccggcctggccaagctcgccgagaccgaggggaagggcgtgttcgacgaggcgaagaagacggtcgaggccctgaacgggtacctggacaagcacaaggacgaggtggaccgggccagcgccgactccatgatcaccaacctcctgaagcacatcgccaaggcgcaggagctgtacaagaacagctccgccctccgcgcccagggcgcccagatcgacaccgccttcagcagctactactggctgtacaaggcgggcgtgacccccgagacgttccccaccgtctcccagttcctgttcgagctcgggaagcagccccggggcaccaagaagatgaagaaggccctgctgagcacccccatgaagtgggggaagaagctctacgagctgttcgccgacgactccttccagcagaaccgcatctacatgcaccccgccgtgctgacggcgggccggatcagcgagatgggggtgtgcttcggcaccatcccggtcgccaaccccgacgacgccgcccagggctccgggcacaccaagagcatcctcaacctgcgcaccaacacggagaccaacaacccctgcgcccggaccatcgtgaagctgttcgagatccagaagaccggcttctccatccaggacatggacatcgtcgcgagcgagcacctcctgcaccagtccctggtggggaagcagagccccttccagaacgcctacaacgtgaagggcaacgccacgtccgccaacatcatctga

SEQ ID NO: 6726 - RNA, 1449 nt, synthetic construct
  misc_feature 1..1449: note = derived and/or modified CDS sequence (opt1) from CCHFV(TAJUK)__JN086996.1__N
  source 1..1449: mol_type = other RNA
atggagaacaagatcgaggtgaacaacaaggacgagatgaacaagtggttcgaggagttcaagaagggcaacgggctggtcgacaccttcaccaacagctactccttctgcgagagcgtgcccaacctcgaccgcttcgtgttccagatggcctccgccacggacgaggcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgaggtgcccaagatcgagcagctggccaactaccagcaggccgcgctgaagtggcggaaggacatcgggttccgcgtgaacgccaacaccgccgccctcagccacaaggtcctggccgagtacaaggtgcccggcgagatcgtgatgtccgtcaaggagatgctgagcgacatgatccggcgccggaacctcatcctgaaccgcggcggggacgagaacccccggggcccggtgtcccgcgagcacgtggagtggtgccgggagttcgtcaaggggaagtacatcatggcgttcaacccgccctggggcgacatcaacaagagcgggcgctccggcatcgccctggtggccaccggcctcgccaagctggccgagaccgaggggaagggcgtgttcgacgaggcgaagaagacggtcgaggccctgaacgggtacctcgacaagcacaaggacgaggtggacaaggccagcgccgacaacatgatcaccaacctgctgaagcacatcgccaaggcgcaggagctctacaagaactccagcgccctgcgggcccagggcgcccagatcgacaccgccttctccagctactactggctgtacaaggcgggcgtgacccccgagacgttccccaccgtcagccagttcctcttcgagctggggaagcagccccgcggcaccaagaagatgaagaaggccctgctctccacccccatgaagtgggggaagaagctgtacgagctgttcgccgacgacagcttccagcagaaccggatctacatgcaccccgccgtgctcacggcgggccgcatctccgagatgggggtgtgcttcggcaccatcccggtcgccaaccccgacgacgccgcccagggcagcgggcacaccaagtccatcctgaacctgcggaccaacacggagaccaacaacccctgcgccaagaccatcgtgaagctgttcgagatccagaagaccggcttcaacatccaggacatggacatcgtcgcgagcgagcacctcctgcaccagtccctcgtggggaagcagagccccttccagaacgcctacaacgtgaagggcaacgccacgtccgccaacatcatctga

SEQ ID NO: 6727 - RNA, 1449 nt, synthetic construct
  misc_feature 1..1449: note = derived and/or modified CDS sequence (opt1) from CCHFV(UG3010)__DQ211650.1__N
  source 1..1449: mol_type = other RNA
atggagaacaagatcgaggtgaccagcaaggacgagatgaaccgctggttcgaggagttcaagaagtccaacggcctggtcgacaccttcacgaacagctactccttctgcgagagcgtgcccaacctcgaccggttcgtgttccagatggcctccgccaccgacgacgcgcagaaggacagcatctacgcctccgccctggtcgaggccaccaagttctgcgccccgatctacgagtgcgcgtgggtgagctccaccgggatcgtgaagaagggcctggagtggttcgagaagaacgccgggacgatcaagagctgggacgagtcctacaccgagctcaaggtcggcgtgcccaagatcgagcagctggccaactaccagcaggccgcgctgaagtggcgcaaggacatcgggttccgggtgaacgccaacaccgccgccctcagcaacaaggtcctggccgagtacaaggtgcccggcgagatcgtgatgtccgtcaaggagatgctgagcgacatgatccgccggcgcaacctcatcctgaaccggggcggggacgagaacccccgcggcccggtgtcccgggagcacgtggagtggtgccgcgagttcgtcaaggggaagtacatcatggcgttcaacccgccctggggcgacatcaacaagagcgggcggtccggcatcgccctggtggccaccggcctcgccaagctggccgagacggaggggaagggcgtgttcgacgaggcgaagaagaccgtcgaggacctgaacgggtacctcgacaagcacaaggacgaggtggacaaggccagcgccgacggcatggtgaccaacctgctgaagcacatcgccaaggcccaggagctctacaagaactccagcgcgctgcgcgcccagggcgcccagatcgacacccccttcagctccttctactggctgtacaaggccggggtcagccccgagacgttccccaccgtgtcccagttcctcttcgagctgggcaagcagccccgggggaccaagaagatgaagaaggccctgctcagcacccccatgaagtggggcaagaagctgtacgagctgttcgcggacgactccttccaggagaaccgcatctacatgcacccggccgtgctcacggccgggcggatcagcgagatgggcgtctgcttcggcaccatccccgtggccaaccccgacgacgcggcccaggggtccggccacaccaagagcatcctgaacctgcgcaccaacacggagaccaacaacccctgcgccaagaccatcgtcaagctgttcgagatccagaagaccgggttcaacatccaggacatggacatcgtggcctccgagcacctcctgcaccagagcctcgtgggcaagcagtccccgttccagaacgcctacaacgtcaaggggaacgcgacgagcgccaacatcatctga

SEQ ID NO: 6728 - RNA, 1449 nt, synthetic construct
  misc_feature 1..1449: note = derived and/or modified CDS sequence (opt1) from CCHFV(UGANDA 3010)__U88416.1__N
  source 1..1449: mol_type = other RNA
atggagaacaagatcgaggtgaccagcaaggacgagatgaaccgctggttcgaggagttcaagaagtccaacggcctggtcgacaccttcacgaacagctactccttctgcgagagcgtgcccaacctcgaccggttcgtgttccagatggcctccgccaccgacgacgcgcagaaggacagcatctacgcctccgccctggtcgaggccaccaagttctgcgccccgatctacgagtgcgcgtgggtgagctccaccgggatcgtgaagaagggcctggagtggttcgagaagaacgccgggacgatcaagagctgggacgagtcctacaccgagctcaaggtcggcgtgcccaagatcgagcagctggccaactaccagcaggccgcgctgaagtggcgcaaggacatcgggttccgggtgaacgccaacaccgccgccctcagcaacaaggtcctggccgagtacaaggtgcccggcgagatcgtgatgtccgtcaaggagatgctgagcgacatgatccgccggcgcaacctcatcctgaaccggggcggggacgagaacccccgcggcccggtgtcccgggagcacgtggagtggtgccgcgagttcgtcaaggggaagtacatcatggcgttcaacccgccctggggcgacatcaacaagagcgggcggtccggcatcgccctggtggccaccggcctcgccaagctggccgagacggaggggaagggcgtgttcgacgaggcgaagaagaccgtcgaggacctgaacgggtacctcgacaagcacaaggacgaggtggacaaggccagcgccgacggcatggtgaccaacctgctgaagcacatcgccaaggcccaggagctctacaagaactccagcgcgctgctgctccagggcgcccagatcgacacccccttcagctccttctactggctgtacaaggccggggtcagccccgagacgttccccaccgtgtcccagttcctgttcgagctcggcaagcagccccgcgggaccaagaagatgaagaaggccctgctgagcacccccatgaagtggggcaagaagctctacgagctgttcgccgacgactccttccaggagaaccggatctacatgcacccggcggtgctgacggccgggcgcatcagcgagatgggcgtctgcttcggcaccatccccgtggccaaccccgacgacgccgcgcaggggtccggccacaccaagagcatcctcaacctggggaccaacacggagaccaacaacccctgcgccaagaccatcgtcaagctgttcgagatccagaagaccggcttcaacatccaggacatggacatcgtggcctccgagcacctcctgcaccagagcctggtggggaagcagtccccgttccagaacgcctacaacgtcaagggcaacgccacgagcgcgaacatcatctga

SEQ ID NO: 6729 - RNA, 1449 nt, synthetic construct
  misc_feature 1..1449: note = derived and/or modified CDS sequence (opt1) from CCHFV(UK ex Bulgaria)__KM201260.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccacccgcttctgcgccccgatctacgagtgcgcgtgggtcagctccaccggcatcgtgaagaaggggctggagtggttcgagaagaacagcggcaccatcaagtcctgggacgagaactacgccgagctcaaggtggacgtccccaagatcgagcagctggccaactaccagcaggccgcgctgaagtggcggaaggacatcgggttccgcgtgaacgccaacacggccgccctcagcaacaaggtgctggccgagtacaaggtccccggcgagatcgtgatgtccgtgaaggagatgctgagcgacatgatccggcgccggaacctcatcctgaaccgcggcggggacgagaacccccggggcccggtctcccgcgagcacgtggagtggtgccgggagttcgtgaaggggaagtacatcatggcgttcaacccgccctggggcgacatcaacaagagcgggcgctccggcatcgccctggtcgccaccggcctcgccaagctggccgagaccgaggggaagggcgtgttcgacgaggcgaagaagaccgtggaggccctgaacgggtacctcgacaagcaccgggacgaggtcgacaaggccagcgccgactccatgatcacgaacctgctgaagcacatcgccaaggcgcaggagctctacaagaacagctccgccctgcgcgcccagggcgcccagatcgacacccccttcagcagcttctactggctgtacaaggccggcgtgacccccgagaccttccccacgatctcccagttcctcttcgagctggggaagcagccccggggcaccaagaagatgaagaaggcgctgctcagcacccccatgaagtgggggaagaagctgtacgagctgttcgccgacgactccttccagcagaaccgcatctacatgcacccggccgtgctcaccgccggccggatcagcgagatgggggtctgcttcggcacgatccccgtggcgaaccccgacgacgccgcccagggctccgggcacaccaagagcatcctgaacctgcgcacctccaccgagacgaacaacccctgcgccaagaccatcgtgaagctgttcgagatccagaagaccggcttcaacatccaggacatggacatcgtcgccagcgagcacctcctgcaccagtccctcgtggggaagcagagcccgttccagaacgcgtacaacgtcaagggcaacgccacctccgccaacatcatctga

SEQ ID NO: 6730 - RNA, 1449 nt, synthetic construct
  misc_feature 1..1449: note = derived and/or modified CDS sequence (opt1) from CCHFV(Yozgat19-2012)__KR092375.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacagcggcaccatcaagtcctgggacgagaactacgccgagctcaaggtggacgtccccaagatcgagcagctggccaactaccagcaggccgcgctgaagtggcgcaaggacatcgggttccgggtgaacgccaacacggccgccctcagcaacaaggtgctggccgagtacaaggtccccggcgagatcgtgatgtccgtgaaggagatgctgagcgacatgatccgccggcgcaacctcatcctgaaccggtccggcgacgagaacccccgcgggccggtcagccgggagcacgtggagtggtgccgcgagttcgtgaagggcaagtacatcatggcgttcaacccgccctggggcgacatcaacaagtccgggcggagcgggatcgccctggtcgccaccggcctcgccaagctggccgagaccgagggcaagggggtgttcgacgaggcgaagaagaccgtggaggccctgaacggctacctcgacaagcaccgcgacgaggtcgacaaggcctccgccgacagcatgatcacgaacctgctgaagcacatcgccaaggcgcaggagctctacaagaactccagcgccctgcgggcccagggggcccagatcgacacccccttcagctccttctactggctgtacaaggccggcgtgacccccgagaccttccccacgatcagccagttcctcttcgagctgggcaagcagccccgcgggaccaagaagatgaagaaggcgctgctctccacccccatgaagtggggcaagaagctgtacgagctgttcgccgacgacagcttccagcagaaccggatctacatgcacccggccgtgctcaccgccgggcgcatctccgagatgggcgtctgcttcgggacgatccccgtggcgaaccccgacgacgccgcccagggcagcggccacaccaagtccatcctgaacctgcggaccagcaccgagacgaacaacccctgcgccaagaccatcgtgaagctgttcgagatccagaagaccgggttcaacatccaggacatggacatcgtcgcctccgagcacctcctgcaccagagcctcgtgggcaagcagtccccgttccagaacgcgtaccacgtcaaggggaacgccaccagcgccaacatcatctga

SEQ ID NO: 6731 - RNA, 1449 nt, synthetic construct
  misc_feature 1..1449: note = derived and/or modified CDS sequence (opt1) from CCHFV(Yozgat207-2011)__KR092377.1__N
  source 1..1449: mol_type = other RNA
atggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaagaacagcggcaccatcaagtcctgggacgagaactacgccgagctcaaggtggacgtccccaagatcgagcagctggccaactaccagcaggccgcgctgaagtggcgcaaggacatcgggttccgggtgaacgccaacacggccgccctcagcaacaaggtgctggccgagtacaaggtccccggcgagatcgtgatgtccgtgaaggagatgctgagcgacatgatccgccggcgcaacctcatcctgaaccggggcggggacgagaacccccgcggcccggtctcccgggagcacgtggagtggtgccgcgagttcgtgaaggggaagtacatcatggcgttcaacccgccctggggcgacatcaacaagagcgggcggtccggcatcgccctggtcgccaccggcctcgccaagctggccgagaccgaggggaagggcgtgttcgacgaggcgaagaagaccgtggaggccctgaacgggtacctcgacaagcaccgcgacgaggtcgacaaggccagcgccgactccatgatcacgaacctgctgaagcacatcgccaaggcgcaggagctctacaagaacagctccgccctgcgggcccagggcgcccagatcgacacccccttcagcagcttctactggctgtacaaggccggcgtgacccccgagaccttccccacgatctcccagttcctcttcgagctggggaagcagccccgcggcaccaagaagatgaagaaggcgctgctcagcacccccatgaagtgggggaagaagctgtacgagctgttcgccgacgactccttccagcagaaccggatctacatgcacccggccgtgctcaccgccggccgcatcagcgagatgggggtctgcttcggcacgatccccgtggcgaaccccgacgacgccgcccagggctccgggcacaccaagagcatcctgaacctgcggacctccaccgagacgaacaacccctgcgccaagaccatcgtgaagctgttcgagatccaggagaccggcttcaacatccaggacatggacatcgtcgccagcgagcacctcctgcaccagtccctcgtggggaagcagagcccgttccagaacgcgtacaacgtcaagggcaacgccacctccgccaacatcatctga

SEQ ID NO: 6732 - RNA, 1452 nt, synthetic construct
  misc_feature 1..1452: note = derived and/or modified CDS sequence (opt1) from DUGV(ArD44313)__AF434161.1__N
  source 1..1452: mol_type = other RNA
atggagaaccagatcaaggccaacaacaagaaggagttcgacgagtggttcaagcccttcagcgagaagctgcagctccgctccaacctgaccaacagcgcctccctgtgcgaccgggtgccggacctcgcgctggccgagatgaagatggccctggccaccgacgacaaggagaaggacagcatcttctccaacgccctcgtcgaggcgacgcgcttctgcgcccccatctacgagtgcgcctggacctgcagcaccggcgtggtgcagaagtccctgagctggttcgacaagaacaaggacttcatcaagctgtgggacgccaagtacatggacctcaagaaggggatccccgagcccgagcagctggtctcctaccagcaggcggcccagaagtggcggaaggacgtgggctacgagatcaaccagttcacccgcagcctgacgcacccggtggtcgccgagtacaaggtgcccggggagatcgccgtggacgtcaaggagatgctctccgacatgatccggcgccggaacgtgctgctgaacggcgacggggagaacgccggcaagaagggccccatcagccgcgagcacgtgtcctgggggcgggagctcgcgggcgggaagttccaggtcgtgttcaacccgccctggggcgacatcaacaagtgcggcaagagcgggatccccctggccgccaccgccatggtgaaggtcgccgagctggacggctccaagaagctcgaggacatccgccaggcgctgctggacctcaagaagtgggtggaggacaacaaggacgccctggaggacgggaagggcaacgagctggtgcagaccatgaccaagcacctcgcccaggccgtcgagctgagcaagaagtccaacgccctgcgggcgcagggggcccagatcgacacgcccttcagcgcctactactgggcctggtccgccggcgtgaagcccgagaccttcttcaccctcagccagttcctgttcgagatgggccagagcgcgcgcgggggcaagaagatgatcaaggccctgacctccacgccgctccggtgggggaagggcctgatcaacctgttcgccgacgacgacttcctcgggaaccgcctgtacatgcaccccgccgtgctgacccccggccggatgagcgagatgggcgcgtgcttcggggtcatccccgtggcctccccggaggacgccatcctcggcagcgggcactccaagaacatcctgaacttcaagatcgacaccagcgtgcagaacccctgcgcctccaccatcgtccagctgtaccgcatccagaagtccggcttcgacctcgagagcctggaggtggtcagcacggagcacctcctgcaccagtccttcgtggggaagcggtgccccacccagaacgcctacaaggtgcgcggcaacgcgaccaacgtcaacatcatctga

SEQ ID NO: 6733 - RNA, 1452 nt, synthetic construct
  misc_feature 1..1452: note = derived and/or modified CDS sequence (opt1) from DUGV(ArD16095)__AF434162.1__N
  source 1..1452: mol_type = other RNA
atggagaaccagatcaaggccaacaacaagaaggagttcgacgagtggttcaagcccttcagcgagaagctgcagctgcgctccaacctgaccaacagcgcctccctgtgcgaccgggtgccggacctcgcgctggccgagatgaagatggccctggccaccgacgacaaggagaaggacagcatcttctccaacgccctcgtcgaggcgacgcgcttctgcgcccccatctacgagtgcgcctggacctgcagcaccggcgtggtgcagaagtccctgagctggttcgacaagaacaaggacttcatcaagctgtgggactccaagtacatggacctccggaaggggatccccgagcccgagcagctggtcagctaccagcaggccgcgcagaagtggcgcaaggacgtgggctacgagatcaaccagttcacccggtccctgacgcacccggtggtcgccgagtacaaggtgcccggggagatcgccgtggacgtcaaggagatgctcagcgacatgatccgccggcgcaacgtgctgctgaacggcgacggggagaacgccggcaagaagggccccatctcccgggagcacgtgagctgggggcgcgagctcgccggcgggaagttccaggtcgtgttcaacccgccctggggcgacatcaacaagtgcgggaagtccggcatccccctggcggccaccgccatggtgaaggtcgccgagctggacggcagcaagaagctcgaggacatccggcaggccctgctggacctcaagaagtgggtggaggacaacaaggacgcgctggaggacgggaagggcaacgagctggtgcagaccatgaccaagcacctcgcccaggccgtcgagctgtccaagaagtccaacgccctgcgcgcccagggggcgcagatcgacacgcccttcagcgcctactactgggcctggagcgccggcgtgaagcccgagaccttcttcaccctcagccagttcctgttcgagatgggccagtccgcccgcgggggcaagaagatgatcaaggcgctgaccagcacgccgctccggtgggggaagggcctgatcaacctgttcgccgacgacgacttctccgggaaccggctctacatgcaccccgccgtgctgacccccggccgcatgagcgagatgggcgcctgcttcggggtcatccccgtggcgtccccggaggacgccatcctgggcagcgggcactccaagaacatcctcaacttcaagatcgacaccagcgtgcagaacccctgcgcctccaccatcgtccagctgtaccggatccagaagtccggcttcgacctggagagcctcgaggtggtcagcacggagcacctcctgcaccagtccttcgtggggaagcgctgccccacccagaacgcctacaaggtgcggggcaacgccaccaacgtcaacatcatctga

SEQ ID NO: 6734 - RNA, 1452 nt, synthetic construct
  misc_feature 1..1452: note = derived and/or modified CDS sequence (opt1) from DUGV(IbH11480)__AF434163.1__N
  source 1..1452: mol_type = other RNA
atggagaaccagatcaaggccaacaacaagaaggagttcgacgagtggttcaagcccttcagcgagaagctgcagctccgctccaacctgaccaacagcgcctccctgtgcgaccgggtgccggacctcgcgctggccgagatgaagatggccctggccaccgacgacaaggagaaggacagcatcttctccaacgccctcgtcgaggcgacgcgcttctgcgcccccatctacgagtgcgcctggacctgcagcaccggcgtggtgcagaagtccctgagctggttcgacaagaacaaggacttcatcaagctgtgggacgccaagtacatggacctccggaaggggatccccgagcccgagcagctggtctcctaccagcaggcggcccagaagtggcgcaaggacgtgggctacgagatcaaccagttcacccggagcctgacgcacccggtggtcgccgagtacaaggtgcccggggagatcgccgtggacgtcaaggagatgctctccgacatgatccgccggcgcaacgtgctgctgaacggcgacggggagaacgccggcaagaagggccccatcagccgggagcacgtgtcctgggggcgcgagctcgcgggcgggaagttccaggtcgtgttcaacccgccctggggcgacatcaacaagtgcggcaagagcgggatccccctggccgccaccgccatggtgaaggtcgccgagctggacggctccaagaagctcgaggacatccggcaggcgctgctggacctcaagaagtgggtggaggacaacaaggacgccctggaggacgggaagggcaacgagctggtgcagaccatgaccaagcacctcgcccaggccgtcgagctgagcaagaagtccaacgccctgcgcgcgcagggggcccagatcgacacgcccttcagcgccttctactgggcctggtccgccggcgtgaagcccgagaccttcttcaccctcagccagttcctgttcgagatgggccagagcgcgcgcgggggcaagaagatgatcaaggccctgacctccacgccgctccggtgggggaagggcctgatcaacctgttcgccgacgacgacttcctcgggaaccggctgtacatgcaccccgccgtgctgacccccggccgcatgagcgagatgggcgcgtgcttcggggtcatccccgtggcctccccggaggacgccatcctcggcagcgggcactccaagaacatcctgaacttcaagatcgacaccagcgtgcagaacccctgcgcctccaccatcgtccagctgtaccggatccagaagtccggcttcgacctcgagagcctggaggtggtcagcacggagcacctcctgcaccagtccttcgtggggaagcgctgccccacccagaacgcctacaaggtgcggggcaacgcgaccaacgtcaacatcatctga

SEQ ID NO: 6735 - RNA, 1452 nt, synthetic construct
  misc_feature 1..1452: note = derived and/or modified CDS sequence (opt1) from DUGV(IbAr1792)__AF434164.1__N
  source 1..1452: mol_type = other RNA
atggagaaccagatcaaggccaacaacaagaaggagttcgacgagtggttcaagcccttcagcgagaagctgcagctccgctccaacctgaccaacagcgcctccctgtgcgaccgggtgccggacctcgcgctggccgagatgaagatggccctggccaccgacgacaaggagaaggacagcatcttctccaacgccctcgtcgaggcgacgcgcttctgcgcccccatctacgagtgcgcctggacctgcagcaccggcgtggtgcagaagtccctgagctggttcgacaagaacaaggacttcatcaagctgtgggacgccaagtacatggacctccggaaggggatccccgagcccgagcagctggtctcctaccagcaggcggcccagaagtggcgcaaggacgtgggctacgagatcaaccagttcacccggagcctgacgcacccggtggtcgccgagtacaaggtgcccggggagatcgccgtggacgtcaaggagatgctctccgacatgatccgccggcgcaacgtgctgctgaacggcgacggggagaacgccggcaagaagggccccatcagccgggagcacgtgtcctgggggcgcgagctcgcgggcgggaagttccaggtcgtgttcaacccgccctggggcgacatcaacaagtgcggcaagagcgggatccccctggccgccaccgccatggtgaaggtcgccgagctggacggctccaagaagctcgaggacatccggcaggcgctgctggacctcaagaagtgggtggaggacaacaaggacgccctggaggacgggaagggcaacgagctggtgcagaccatgaccaagcacctcgcccaggccgtcgagctgagcaagaagtccaacgccctgcgcgcgcagggggcccagatcgacacgcccttcagcgcctactactgggcctggtccgccggcgtgaagcccgagaccttcttcaccctcagccagttcctgttcgagatgggccagagcgcgcgcgggggcaagaagatgatcaaggccctgacctccacgccgctccggtgggggaagggcctgatcaacctgttcgccgacgacgacttcctcgggaaccggctgtacatgcaccccgccgtgctgacccccggccgcatgagcgagatgggcgcgtgcttcggggtcatccccgtggcctccccggaggacgccatcctcggcagcgggcactccaagaacatcctgaacttcaagatcgacaccagcgtgcagaacccctgcgcctccaccatcgtccagctgtaccggatccagaagtccggcttcgacctcgagagcctggaggtggtcagcacggagcacctcctgcaccagtccttcgtggggaagcgctgccccacccagaacgcctacaaggtgcggggcaacgcgaccaacgtcaacatcatctga

SEQ ID NO: 6736 - RNA, 1452 nt, synthetic construct
  misc_feature 1..1452: note = derived and/or modified CDS sequence (opt1) from DUGV(KT281/75)__AF434165.1__N
  source 1..1452: mol_type = other RNA
atggagaaccagatcaaggccaacaccaagaaggagttcgacgagtggttcaagcccttcagcgacaagctgcagctgcgctccaccctgacgaacagcgcctccctgtgcgaccgggtgccggacctcgcgctggccgagatgaagatggccctggccaccgacgacaaggagaaggacagcatcttctccaacgccctcgtcgaggcgacccgcttctgcgcccccatctacgagtgcgcctggacctgcagcacgggcgtggtgcagaagtccctgagctggttcgacaagaacaaggacttcatcaagctgtgggacgccaagtacatggacctccggaaggggatccccgagcccgagcagctggtctcctaccagcaggcggcccagaagtggcgcaaggacatcggctacgagatcaaccagttcacccggagcctgacccacccggtggtggccgagtacaaggtccccggggagatcgccgtggacgtgaaggagatgctctccgacatgatccgccggcgcaacgtcctgctgaacggcgacggggagaacgccggcaagaagggccccatcagccgggagcacgtgtcctgggggcgcgagctcgcgggcgggaagttccaggtggtcttcaacccgccctggggcgacatcaacaagtgcggcaagagcgggatccccctggccgccaccgccatggtgaaggtggccgagctggacggctccaagaagctcgaggacatccggcaggcgctgctggacctcaagaagtggatcgaggacaacaaggacgccctggaggacgggaagggcaacgagctgatccagacgatgaccaagcacctcgcccaggccgtcgagctgagcaagaagtccaacgccctgcgcgcgcagggggcccagatcgacacccccttcagcgccttctactgggcctggtccgccggcgtgaagcccgagaccttcttcacgctcagccagttcctgttcgagatgggccagagcgcgcgcgggggcaagaagatgatcaaggccctgacctccaccccgctccggtgggggaagggcctgatcaacctgttcgccgacgacgacttcagcgggaaccggctctacatgcaccccgccgtgctgacccccggccgcatgtccgagatgggcgcgtgcttcggggtcatccccgtggccagcccggaggacgccatcctgggctccgggcacagcaagaacatcctcaacttcaagatcgacacgtccgtgcagaacccctgcgccagcaccatcgtccagctgtaccggatccagaagtccggcttcgacctggagagcctcgaggtggtgtccaccgagcacctcctgcaccagagcttcgtcgggaagcgctgccccacccagaacgcctacaaggtgcggggcaacgcgacgaacgtcaacatcatctga

SEQ ID NO: 6737 - RNA, 1452 nt, synthetic construct
  misc_feature 1..1452: note = derived and/or modified CDS sequence (opt1) from DUGV(NJT130)__FJ422213.2__N
  source 1..1452: mol_type = other RNA
atggagaaccagatcaaggccaacaacaagaaggagttcgacgagtggttcaagcccttcagcgacaagctgcagctgcgctccaccctgaccaacagcgcctccctgtgcgacaaggtgccggacctcgcgctggccgagatgaagatggccctggccacggacgacaaggagaaggacagcatcttctccaacgccctcgtcgaggcgacccggttctgcgcccccatctacgagtgcgcctggacctgcagcaccggcgtggtgcagaagtccctgagctggttcgacaagaacaaggacttcatcaagctgtgggacgccaagtacatggacctccgcaaggggatccccgagcccgagcagctggtctcctaccagcaggcggcccagaagtggcggaaggacatcggctacgagatcaaccagttcacgcgcagcctgacccacccggtggtggccgagtacaaggtccccggggagatcgccgtggacgtgaaggagatgctctccgacatgatccggcgccggaacgtcctgctgaacggcgacggggagaacgccggcaagaagggccccatcagccgcgagcacgtgtcctgggggcgggagctcgcggagggcaagttccaggtggtcttcaacccgccctggggcgacatcaacaagtgcggcaagagcgggatccccctggccgccaccgccatggtgaaggtggccgagctggacgggtccaagaagctcgaggacatccgccaggcgctgctggacctcaagaagtgggtcgaggacaacaaggacgccctggaggacggcaaggggaacgagctgatccagaccatgacgaagcacctcgcccaggccgtggagctgagcaagaagtccaacgccctgcgggcgcagggcgcccagatcgacacccccttcagcgccttctactgggcctggtccgccggggtgaagcccgagaccttcttcaccctcagccagttcctgttcgagatgggccagagcgcgcgcggcgggaagaagatgatcaaggccctgacgtccaccccgctccggtggggcaaggggctgatcaacctgttcgccgacgacgacttcagcggcaaccgcctctacatgcaccccgccgtcctgacccccgggcggatgtccgagatgggcgcgtgcttcggcgtgatccccgtggccagcccggaggacgccatcctggggtccggccacagcaagaacatcctcaacttcaagatcgacacctccgtccagaacccctgcgccagcacgatcgtgcagctgtaccgcatccagaagtccgggttcgacctggagagcctcgaggtggtctccaccgagcacctcctgcaccagagcttcgtgggcaagcggtgccccacccagaacgcctacaaggtccgcgggaacgcgaccaacgtgaacatcatctga

SEQ ID NO: 6738 - RNA, 1452 nt, synthetic construct
  misc_feature 1..1452: note = derived and/or modified CDS sequence (opt1) from DUGV(IbAr1792)__KU925457.1__N
  source 1..1452: mol_type = other RNA
atggagaaccagatcaaggccaacaacaagaaggagttcgacgagtggttcaagcccttcagcgagaagctgcagctccgctccaacctgaccaacagcgcctccctgtgcgaccgggtgccggacctcgcgctggccgagatgaagatggccctggccaccgacgacaaggagaaggacagcatcttctccaacgccctcgtcgaggcgacgcgcttctgcgcccccatctacgagtgcgcctggacctgcagcaccggcgtggtgcagaagtccctgagctggttcgacaagaacaaggacttcatcaagctgtgggacgccaagtacatggacctccggaaggggatccccgagcccgagcagctggtctcctaccagcaggcggcccagaagtggcgcaaggacgtgggctacgagatcaaccagttcacccggagcctgacgcacccggtggtcgccgagtacaaggtgcccggggagatcgccgtggacgtcaaggagatgctctccgacatgatccgccggcgcaacgtgctgctgaacggcgacggggagaacgccggcaagaagggccccatcagccgggagcacgtgtcctgggggcgcgagctcgcgggcgggaagttccaggtcgtgttcaacccgccctggggcgacatcaacaagtgcggcaagagcgggatccccctggccgccaccgccatggtgaaggtcgccgagctggacggctccaagaagctcgaggacatccggcaggcgctgctggacctcaagaagtgggtggaggacaacaaggacgccctggaggacgggaagggcaacgagctggtgcagaccatgaccaagcacctcgcccaggccgtcgagctgagcaagaagtccaacgccctgcgcgcgcagggggcccagatcgacacgcccttcagcgccttctactgggcctggtccgccggcgtgaagcccgagaccttcttcaccctcagccagttcctgttcgagatgggccagaacgcgcgcgggggcaagaagatgatcaaggccctgaccagcacgccgctccggtgggggaagggcctgatcaacctgttcgccgacgacgacttcctcgggaaccggctgtacatgcaccccgccgtgctgacccccggccgcatgtccgagatgggcgcgtgcttcggggtcatccccgtggccagcccggaggacgccatcctcggctccgggcacagcaagaacatcctgaacttcaagatcgacacctccgtgcagaacccctgcgccagcaccatcgtccagctgtaccggatccagaagtccggcttcgacctcgagagcctggaggtggtctccacggagcacctcctgcaccagagcttcgtggggaagcgctgccccacccagaacgcctacaaggtgcggggcaacgcgaccaacgtcaacatcatctga

SEQ ID NO: 6739 - RNA, 1449 nt, synthetic construct
  misc_feature 1..1449: note = derived and/or modified CDS sequence (opt1) from NSDV(Jilin)__NC_034386.1__N
  source 1..1449: mol_type = other RNA
atgcagaaccagatcgtggccgacaacaaggacgccatcctggcgtggcacaagacctacagcgagaagcaccgcctcaagtccgtcctgaccaacagcgcctccttctgcgagacgatccccgacctgagcggctacgaggtgtccatgcggctcgtgagctccgagagcgagaaggactccgtctacgccagcgccctggtggccgcgaccaagttctgcgccccgatcctggagtgcgcctggacctcctgcaccgggatggtggagcgcggcctcgactggttcgagaacaacaaggagacggtcaagatctgggacgccgagtacgggaagctgcggaccgaggcgcccagccccgagcagctgctcggctaccagcgcgccgccctgaagtggcggaaggacaccaagtacgggatcaaccgcaacaccgccgccctggcggccgccatcgccacggagtaccgggtgcccggctccatcgtggtcaacgtgaaggacatgctcagcgacatgatccgccggcgcaacaagatcctgaaccgggacggctccgaggacgtgccgaagcgcgggcccgtcagcaaggagcacatcgactgggcccgggacctggcgcagggcaagttcctcgtggtgttcaacccgccctggggcgacatcaacaaggccgggaagtccgggatcgccctggccgccaccggcatggcgaagctgatcgagctcgacggccccaagatcgccgaggacctgcgcgagagcctgaaggggctcgtcgcctggatcaacgcccacaaggacgaggtggagaacggcaaggaggtggtcgacgggctgaccaagcacctccagaaggccctggagctggcgaagcagtccagcgccatgcgggcccagggcgcccagatcgacaccgtgttcagctcctactactggctgtggaaggcgggcgtgacggccgagatgttccccaccgtcagccagttcctcttcgagctggggaaggtgccccgcggcaacaagaagatgaagaaggccctgtccagcatgcccctcaagtgggggaagaagctgctggccctcttcgccgacgactccttcaccgcgaaccggatctacatgcacccgggcgtgctgaccgccgggcgcatgagcgagctgggcgtctgcttcggcgccatccccgtggccaaccccgacgacgccgcggaggggtccggccacatcaagaacatcctcgcccagacgaccgacacccaggccgggaacccctgcgcccagaacatcgtcgccctgttcaacatccagaaggcgggcttcgacatcgagagcatggacatcgtggccctggagcacctcctgcaccagtccctggtggggaagcggagcccgttccagaacgcctacaacatccgcggcaacgccacctccatccagatcatctga

SEQ ID NO: 6740 - RNA, 1449 nt, synthetic construct
  misc_feature 1..1449: note = derived and/or modified CDS sequence (opt1) from NSDV(62873)__HQ286609.1__N
  source 1..1449: mol_type = other RNA
atgcagaaccagatcgtggccgacaacaaggacgccatcctggcgtggcacaagacctacagcgagaagcacaagctcaagtccgtcctgaccaacagcgcctccttctgcgagacgatccccgacctgagcggctacgaggtgtccatgcgcctcgtgagctccgagagcgagaaggactccgtctacgccagcgccctggtggccgcgaccaagttctgcgccccgatcctggagtgcgcctggacctcctgcaccgggatgatccagcggggcctcgactggttcgagaacaacggggagatggtgaagatctgggacgccgactacggcaagctgcgcacggagatccccagccccgagcagctgctcgggtaccagcgggcggccctgaagtggcgcaaggacaccaagtacggcatcaacaagaacaccgccgccctggccgcggccatcgccaccgagtaccgggtccccggctccatcgtggtgaacgtcaaggacatgctcagcgacatgatccgccggcgcaacaagatcctgaaccgggacgggtccgaggacgtgccgaagcgcggccccgtgagcaaggagcacatcgactgggcccgggacctggcccaggggaagttcctcgtcgtgttcaacccgccctggggcgacatcaacaaggcggggaagtccggcatcgccctggccgccacgggcatggccaagctgatcgagctcgacgggcccaaggtggcggaggacctgaaggagagcctgaagtccctcgtcgcctggatcaacgcccacaaggacgaggtggagaacggcaaggaggtggtcgacgggctgaccaagcacctccagaaggccctggagctggccaagcagagcagcgcgatgcgcgcccagggcgcccagatcgacaccgtgttctccagctactactggctgtggaaggccggcgtgaccgcggagatgttccccacggtctcccagttcctcttcgagctggggaaggtgccccggggcaacaagaagatgaagaaggccctgagctccatgcccctcaagtgggggaagaagctgctggccctcttcgccgacgacagcttcaccgccaaccgcatctacatgcacccgggcgtgctgaccgcggggcggatgtccgagctgggcgtctgcttcggcgccatccccgtggccaaccccgacgacgccgccgaggggagcggccacatcaagaacatcctcaactacaagaccgacacgcaggcggggaacccctgcgcccagaacatcgtcgccctgttcaacatccagaaggccggcttcgacatcgagtccatggacatcgtggccagcgagcacctcctgcaccagtccctggtggggaagcgcagcccgttccagaacgcgtacaacatccggggcaacgccacctccatccagatcatctga

SEQ ID NO: 6741 - RNA, 1449 nt, synthetic construct
  misc_feature 1..1449: note = derived and/or modified CDS sequence (opt1) from NSDV(779)__HQ286602.1__N
  source 1..1449: mol_type = other RNA
atgcagaaccagatcgtggccgacaacaaggacgccatcctggcgtggcacaagacctacagcgagaagcacaagctcaagtccgtcctgaccaacagcgcctccttctgcgagacgatccccgacctgagcggctacgaggtgtccatgcgcctcgtgagctccgagagcgagaaggactccgtctacgccagcgccctggtggccgcgaccaagttctgcgccccgatcctggagtgcgcctggacctcctgcaccgggatgatccagcggggcctcgactggttcgacaacaacggggagatggtgaagatctgggacgccgactacggcaagctgcgcacggaggtccccagccccgagcagctgctcgggtaccagcgggcggccctgaagtggcgcaaggacaccaagtacggcatcaacaagaacaccgccgccctggccgcggccatcgccaccgagtaccgggtgcccggctccatcgtggtcaacgtgaaggacatgctcagcgacatgatccgccggcgcaacaagatcctgaaccgggacgggtccgaggacgtgccgaagcgcggccccgtcagcaaggagcacatcgactgggcccgggacctggcccaggggaagttcctcgtggtgttcaacccgccctggggcgacatcaacaaggcggggaagtccggcatcgccctggccgccacgggcatggccaagctgatcgagctcgacgggcccaaggtcgcggaggacctgaaggagagcctgaagtccctcgtggcctggatcaacgcccacaaggacgaggtggagaacggcaaggaggtcgtggacgggctgaccaagcacctccagaaggccctggagctggccaagcagagcagcgcgatgcgcgcccagggcgcccagatcgacaccgtgttctccagctactactggctgtggaaggccggcgtcaccgcggagatgttccccacggtgtcccagttcctcttcgagctggggaaggtgccccggggcaacaagaagatgaagaaggccctgagctccatgcccctcaagtgggggaagaagctgctggccctcttcgccgacgacagcttcaccgccaaccgcatctacatgcacccgggcgtcctgaccgcggggcggatgtccgagctgggcgtgtgcttcggcgccatccccgtcgccaaccccgacgacgccgccgaggggagcggccacatcaagaacatcctcaactacaagaccgacacgcaggcggggaacccctgcgcccagaacatcgtggccctgttcaacatccagaaggccggcttcgacatcgagtccatggacatcgtggccagcgagcacctcctgcaccagtccctggtcgggaagcgcagcccgttccagaacgcgtacaacatccggggcaacgccacctccatccagatcatctga

SEQ ID NO: 6742 - RNA, 1449 nt, synthetic construct
  misc_feature 1..1449: note = derived and/or modified CDS sequence (opt1) from NSDV(6233)__HQ286603.1__N
  source 1..1449: mol_type = other RNA
atgcagaaccagatcgtggccgacaacaaggacgccatcctggcgtggcacaagacctacagcgagaagcacaagctcaagtccgtcctgaccaacagcgcctccttctgcgagacgatccccgacctgagcggctacgaggtgtccatgcgcctcgtgagctccgagagcgagaaggactccgtctacgccagcgccctggtggccgcgaccaagttctgcgccccgatcctggagtgcgcctggacctcctgcaccgggatgatccagcggggcctcgactggttcgacaacaacggggagatggtgaagatctgggacgccgactacggcaagctgcgcacggaggtccccagccccgagcagctgctcgggtaccagcgggcggccctgaagtggcgcaaggacaccaagtacggcatcaacaagaacaccgccgccctggccgcggccatcgccaccgagtaccgggtgcccggctccatcgtggtcaacgtgaaggacatgctcagcgacatgatccgccggcgcaacaagatcctgaaccgggacgggtccgaggacgtgccgaagcgcggccccgtcagcaaggagcacatcgactgggcccgggacctggcccaggggaagttcctcgtggtgttcaacccgccctggggcgacatcaacaaggcggggaagtccggcatcgccctggccgccacgggcatggccaagctgatcgagctcgacgggcccaaggtcgcggaggacctgaaggagagcctgaagtccctcgtggcctggatcaacgcccacaaggacgaggtggagaacggcaaggacgtcgtggacgggctgaccaagcacctccagaaggccctggagctggccaagcagagcagcgcgatgcgcgcccagggcgcccagatcgacaccgtgttctccagctactactggctgtggaaggccggcgtcaccgcggagatgttccccacggtgtcccagttcctcttcgagctggggaaggtgccccggggcaacaagaagatgaagaaggccctgagctccatgcccctcaagtgggggaagaagctgctggccctcttcgccgacgacagcttcaccgccaaccgcatctacatgcacccgggcgtcctgaccgcggggcggatgtccgagctgggcgtgtgcttcggcgccatccccgtcgccaaccccgacgacgccgccgaggggagcggccacatcaagaacatcctcaactacaagaccgacacgcaggcggggaacccctgcgcccagaacatcgtggccctgttcaacatccagaaggccggcttcgacatcgagtccatggacatcgtggccagcgagcacctcctgcaccagtccctggtcgggaagcgcagcccgttccagaacgcgtacaacatccggggcaacgccacctccatccagatcatctga

SEQ ID NO: 6743 - RNA, 1449 nt, synthetic construct
  misc_feature 1..1449: note = derived and/or modified CDS sequence (opt1) from NSDV(40350)__HQ286608.1__N
  source 1..1449: mol_type = other RNA
atgcagaaccagatcgtggccgacagcaaggacgccatcctggcgtggcacaagacctactccgagaagcacaagctcaagagcgtcctgaccaactccgccagcttctgcgagacgatccccgacctgtccggctacgaggtgagcatgcgcctcgtgtccagcgactccgagaaggacagcgtctacgcctccgccctggtggccgcgaccaagttctgcgccccgatcctggagtgcgcctggaccagctgcaccgggatgatccagcggggcctcgactggttcgagaacaacggggagatggtgaagatctgggacgccgactacggcaagctgcgcacggaggtcccctcccccgagcagctgctcgggtaccagcgggcggccctgaagtggcgcaaggacaccaagtacggcatcaacaagaacaccgccgccctggccgcggccatcgccaccgagtaccgggtgcccggcagcatcgtggtcaacgtgaaggacatgctctccgacatgatccgccggcgcaacaagatcctgaaccgggacgggagcgaggacgtgccgaagcgcggccccgtctccaaggagcacatcgactgggcccgggacctggcccaggggaagttcctcgtggtgttcaacccgccctggggcgacatcaacaaggcgggcaagagcgggatcgccctggccgccacgggcatggccaagctgatcgagctcgacgggcccaagatcgcggaggacctgaaggagtccctcaagagcctggtcgcctggatcaacgcccacaaggacgaggtggagaacggcaaggaggtggtcgacgggctgaccaagcacctccagaaggccctggagctggccaagcagagctccgcgatgcgcgcccagggcgcccagatcgacaccgtgttcagctcctactactggctgtggaaggccggcgtgaccgcggagatgttccccacggtcagccagttcctcttcgagctggggaaggtgccccggggcaacaagaagatgaagaaggccctgtccagcatgcccctcaagtgggggaagaagctgctggccctcttcgccgacgactccttcaccgccaaccgcatctacatgcacccgggcgtgctgaccgcggggcggatgagcgagctgggcgtctgcttcggcgccatccccgtggccaaccccgacgacgccgccgaggggtccggccacatcaagaacatcctcaactacaagaccgacacgcaggcggggaacccctgcgcccagaacatcgtcgccctgttcaacatccagaaggccggcttcgacatcgagagcatggacatcgtggcctccgagcacctcctgcaccagagcctggtggggaagcgctccccgttccagaacgcgtacaacatccggggcaacgccaccagcatccagatcatctga

SEQ ID NO: 6744 - RNA, 1449 nt, synthetic construct
  misc_feature 1..1449: note = derived and/or modified CDS sequence (opt1) from NSDV(616287)__HQ286605.1__N
  source 1..1449: mol_type = other RNA
atgcagaaccagatcgtggccgacaacaaggacgccatcctggcgtggcacaagacctacagcgagaagcacaagctcaagtccgtcctgaccaacagcgcctccttctgcgagacgatccccgacctgagcggctacgaggtgtccatgcgcctcgtgagctccgagagcgagaaggactccgtctacgccagcgccctggtggccgcgaccaagttctgcgccccgatcctggagtgcgcctggacctcctgcaccgggatgatccagcggggcctcgactggttcgacaacaacggggagatggtgaagatctgggacgccgactacggcaagctgcgcacggaggtccccagccccgagcagctgctcgggtaccagcgggcggccctgaagtggcgcaaggacaccaagtacggcatcaacaagaacaccgccgccctggccgcggccatcgccaccgagtaccgggtgcccggctccatcgtggtcaacgtgaaggacatgctcagcgacatgatccgccggcgcaacaagatcctgaaccgggacgggtccgaggacgtgccgaagaagggccccgtcagcaaggagcacgtggactgggcccgcgacctggcccaggggaagttcctcgtggtcttcaacccgccctggggcgacatcaacaaggcggggaagtccggcatcgccctggccgccacgggcatggccaagctgatcgagctcgacgggcccaaggtggcggaggacctgaaggagagcctgaagtccctcgtggcctggatcaacgcccacaaggacgaggtcgagaacggcaaggaggtggtggacgggctgaccaagcacctccagaaggccctggagctggccaagcagagcagcgcgatgcgggcccagggcgcccagatcgacaccgtcttctccagctactactggctgtggaaggccggcgtgaccgcggagatgttccccacggtgtcccagttcctcttcgagctggggaaggtcccccgcggcaacaagaagatgaagaaggccctgagctccatgcccctcaagtgggggaagaagctgctggccctcttcgccgacgacagcttcaccgccaaccggatctacatgcacccgggcgtgctgaccgcggggcgcatgtccgagctgggcgtctgcttcggcgccatccccgtggccaaccccgacgacgccgccgaggggagcggccacatcaagaacatcctcaactacaagaccgacacgcaggcggggaacccctgcgcccagaacatcgtggccctgttcaacatccagaaggccggcttcgacatcgagtccatggacatcgtcgccagcgagcacctcctgcaccagtccctggtggggaagcggagcccgttccagaacgcgtacaacatccgcggcaacgccacctccatccagatcatctga

SEQ ID NO: 6745 - RNA, 1449 nt, synthetic construct
  misc_feature 1..1449: note = derived and/or modified CDS sequence (opt1) from NSDV(615526)__HQ286606.1__N
  source 1..1449: mol_type = other RNA
atgcagaaccagatcgtggccgacaacaaggacgccatcctggcgtggcacaaggcctacagcgagaagcacaagctcaagtccgtcctgaccaacagcgcctccttctgcgagaccatccccgacctgagcggctacgaggtgtccatgcgcctcgtgagctccgagagcgagaaggactccgtctacgccagcgccctggtggcggccacgaagttctgcgccccgatcctggagtgcgcctggacctcctgcaccgggatgatccagcggggcctcgactggttcgacagcaacggggagatggtgaagatctgggacgcggactacggcaagctgcgcaccgaggtcccctcccccgagcagctgctcgggtaccagcgggccgccctgaagtggcgcaaggacacgaagtacggcatcaacaagaacaccgccgccctggcggccgccatcgccaccgagtaccgggtgcccggcagcatcgtggtcaacgtgaaggacatgctctccgacatgatccgccggcgcaacaagatcctgaaccgggacgggagcgaggacgtgccgaagggcgggcccgtctccaaggagcacatcgactgggcccgcgacctggcgcagggcaagttcctcgtggtgttcaacccgccctggggcgacatcaacaaggccggcaagagcgggatcgccctggccgccaccgggatggcgaagctgatcgagctcgacggccccaagatcgccgaggacctgaaggagtccctcaagagcctggtcgcctggatcaacgcccacaaggacgaggtggagaacgggaaggaggtggtcgacggcctgacgaagcacctccagaaggccctggagctggcgaagcagagctccgccatgcgggcccagggcgcccagatcgacaccgtgttcagctcctactactggctgtggaaggcgggggtgaccgccgagatgttccccaccgtcagccagttcctcttcgagctgggcaaggtgccccgcgggaacaagaagatgaagaaggccctgtccagcatgcccctcaagtggggcaagaagctgctggccctcttcgccgacgactccttcacggcgaaccggatctacatgcacccgggggtgctgaccgccggccgcatgagcgagctgggcgtctgcttcggggccatccccgtggccaaccccgacgacgccgcggagggctccgggcacatcaagaacatcctcaactacaagaccgacacccaggccggcaacccctgcgcccagaacatcgtcgccctgttcaacatccagaaggccgggttcgacatcgagagcatggacatcgtggcgtccgagcacctcctgcaccagagcctggtgggcaagcggtccccgttccagaacgcctacaacatccgcggcaacgccacgagcatccagatcatctga

SEQ ID NO: 6746 - RNA, 1449 nt, synthetic construct
  misc_feature 1..1449: note = derived and/or modified CDS sequence (opt1) from NSDV(708)__AF504293.1__N
  source 1..1449: mol_type = other RNA
atgcagaaccagatcgtggccgacaacaaggacgccatcctggcgtggcacaaggcctacagcgagaagcacaagctcaagtccgtcctgaccaacagcgcctccttctgcgaggccatccccgacctgagcggctacgaggtgtccatgcgcctcgtgagctccgacagcgagaaggactccgtctacgccagcgcgctggtggccgccaccaagttctgcgccccgatcctggagtgcgcgtggacgtcctgcaccgggatggtggagcggggcctcgactggttcgagaacaaccgcgagatggtcaagatctgggacaccgagtacgggaagctgcggaccgaggtgcccagccccgagcagctgctcggctaccagcgcgccgccctgaagtggcggaaggacacgaagtacgggatcaacaagaacaccgccgccctggcggccgccatcgccaccgagtacaaggtgcccggctccctcgtcgtgaacgtgaaggacatgctgagcgacatgatccgccggcgcaacaagatcctgaaccgggacggctccgaggacgtcccgaagcgcgggcccgtgagcaaggagcacatcgactgggcccgggacctcgcgcagggcaagttcctggtggtcttcaacccgccctggggcgacatcaacaaggccgggaagtccgggatcgccctggccgccaccggcatggcgaagctcatcgagctggacggccccaagatcgccgaggacctgaaggagagcctcaagtccctggtggcctggatcaacgcccacaaggacgaggtggagaacgggaaggaggtcgtggacagcctgacgaagtacctccagaaggccctggagctggcgaagcagagctccgccatgcgcgcccagggcgcccagatcgacaccgtgttcagctcctactactggctctggaaggcgggggtcaccgccgagatgttccccaccgtgagccagttcctgttcgagctgggcaaggtgccccggggcaacaagaagatgaagaaggccctctccagcatgcccctgaagtgggggaagaagctgctcgccctgttcgccgacgactccttcacggcgaaccgcatctacatgcacccgggcgtcctgaccgccgggcggatgagcgagctcggcgtgtgcttcggggccatccccgtcgccaaccccgacgacgccgcggacggctccggccacatcaagagcatcctgaactacaagaccgacacccaggccgggaacccctgcgcccagaacatcgtggccctgttcaacatccagaaggccggcttcgacatcgagtccatggacatcgtggcgagcgagcacctcctgcaccagtccctggtcgggaagcgcagcccgttccagaacgcctacaacatccggggcaacgccacgtccatccagatcatctga

SEQ ID NO: 6747 - RNA, 702 nt, synthetic construct
  misc_feature 1..702: note = derived and/or modified CDS sequence (opt1) from BUNV__NC_001927.1__N
  source 1..702: mol_type = other RNA
atgatcgagctggagttccacgacgtggccgccaacaccagctccaccttcgaccccgaggtcgcgtacgccaacttcaagcgcgtgcacacgaccggcctcagctacgaccacatccggatcttctacatcaaggggcgcgagatcaagacctccctggccaagcggagcgagtgggaggtgaccctgaacctcggcgggtggaagatcacggtctacaacaccaacttcccgggcaaccgcaacaaccccgtgcccgacgacgggctgaccctgcaccggctctccggcttcctggcccgctacctgctcgagaagatgctgaaggtgagcgagcccgagaagctgatcatcaagtccaagatcatcaacccgctcgccgagaagaacggcatcacctggaacgacggggaggaggtctacctgagcttcttccccggctccgagatgttcctggggacgttccggttctaccccctcgcgatcggcatctacaaggtgcagcgcaaggagatggagcccaagtacctggagaagaccatgcggcagcgctacatggggctggaggccgccacctggaccgtgagcaagctcacggaggtccagtccgccctgaccgtggtgagctccctgggctggaagaagaccaacgtcagcgcggccgcccgggacttcctcgccaagttcggcatcaacatgtga

SEQ ID NO: 6748 - RNA, 702 nt, synthetic construct
  misc_feature 1..702: note = derived and/or modified CDS sequence (opt1) from BUNV(SFCrEq231)__KP063894.1__N
  source 1..702: mol_type = other RNA
atgatcgagctggagttcaacgacgtggccgccaacaccagctccaccttcgaccccgaggtcgcgtacatcaacttcaagcgcatctacacgaccggcctcagctacgaccacatccggatcttctacatcaaggggcgcgagatcaagacctccctgaccaagcggagcgagtgggaggtgacgctgaacctcggcgggtggaaggtgaccgtcttcaacaccaacttcccgggcaaccgcaactcccccgtgcccgacgacgggctgaccctgcaccggctcagcggcttcctggcccgctacctgctcgagaagatcctgaaggtgtccgagcccgagaagctgatcatcaagagcaagatcatcaacccgctcgccgagaagaacggcatcacgtggtccgacggggaggaggtctacctgagcttcttccccggctccgagatgttcctggggaccttcaagttctaccccctcgccatcggcatctacaaggtgcagcggaaggagatggagcccaagtacctggagaagaccatgcgccagcggtacatggggctggaggccagcacctggacggtgtccaaggtcaacgaggtgcagagcgcgctcaccgtggtctccggcctgggctggaagaagaccaacgtgagcgccgccgcccgcgagttcctggcgaagttcgggatcaacatgtga

SEQ ID NO: 6749 - RNA, 702 nt, synthetic construct
  misc_feature 1..702: note = derived and/or modified CDS sequence (opt1) from BUNV(AMH001130)__JF961342.1__N
  source 1..702: mol_type = other RNA
atgatcgagctggagttccacgacgtggccgccaacaccagctccaccttcgaccccgaggtcgcgtacgccaacttcaagcgcgtgcacacgaccggcctcagctacgaccacatccggatcttctacatcaaggggcgcgaggtgaagacctccctggccaagcggagcgagtgggaggtcaccctgaacctcggcgggtggaagatcacggtgtacaacaccaacttcccgggcaaccgcaacaaccccgtgcccgacgacgggctgaccctgcaccggctctccggcttcctggcccgctacctgctcgagaagatgctgaaggtcagcgagcccgagaagctgatcatcaagtccaagatcatcaacccgctcgccgagaagaacggcatcacctggaacgacggggaggaggtgtacctgagcttcttccccggctccgagatgttcctggggacgttccggttctaccccctcgcgatcggcatctacaaggtgcagcgcaaggagatggagcccaagtacctggagaagaccatgcggcagcgctacatggggctggaggccgccacctggaccgtcagcaagctcacggaggtgcagtccgccctgaccgtggtcagctccctgggctggaagaagaccaacgtgagcgcggccgcccgggacttcctcgccaagttcggcatcaacatgtga

SEQ ID NO: 6750 - RNA, 702 nt, synthetic construct
  misc_feature 1..702: note = derived and/or modified CDS sequence (opt1) from BUNV(ArB29051)__AM709778.1__N
  source 1..702: mol_type = other RNA
atgatcgagctggagttccacgacgtggccgccaacaccagctccaccttcgaccccgaggtcgcgtacgccaacttcaagcgcgtgcacacgaccggcctcagctacgaccacatccggatcttctacatcaaggggcgcgagatcaagacctccctggccaagcggagcgagtgggaggtgaccctgaacctcggcgggtggaagatcacggtctacaacaccaacttcccgggcaaccgcaacaaccccgtgcccgacgacgggctgaccctgcaccggctctccggcttcctggcccgctacctgctcgagaagatgctgaagctgagcgagcccgagaagctcatcatcaagtccaagatcatcaacccgctggccgagaagaacggcatcacctggaacgacggggaggaggtgtacctgagcttcttccccggctccgagatgttcctcgggacgttccggttctaccccctggcgatcggcatctacaaggtccagcgcaaggagatggagcccaagtacctggagaagaccatgcggcagcgctacatggggctcgaggccgccacctggaccgtgagcaagctgacggaggtgcagtccgccctgaccgtcgtgagctccctcggctggaagaagaccaacgtgagcgcggccgcccgggacttcctggccaagttcggcatcaacatgtga

SEQ ID NO: 6751 - RNA, 702 nt, synthetic construct
  misc_feature 1..702: note = derived and/or modified CDS sequence (opt1) from BUNV(ArB28215)__AM711130.1__N
  source 1..702: mol_type = other RNA
atgatcgagctggagttcaacgacgtggccgtcaacaccagctccagcttcgaccccgaggccgcgtacgccaacttcaagcgcgtgcacaccacgggcctctcctacgaccacatccggatcttctacatcaaggggcgcgagatcaaggtgagcctgtccaagcggagcgagtgggaggtcaccatcaacctgggcgggtggaagatcgccgtgtacaacaccaacttcccgggcaaccgcaactcccccgtgcccgacgacgggctcaccctgcaccggctgagcggcttcctcgcccgcttcctgctggagaagatgctcaagatgtccgagcccgagaagctgatcatcaaggccaagatcatcaacccgctggcggagaagaaccggatcacgtggaacgacggcgaggaggtctacctcagcttcttccccgggtccgagatgttcctgggcaccttcaagttctaccccctggccatcgggatctacaaggtgcagcgcaaggagatggagcccaagtacttcgagaagaccatgcggcagcgctacatgggcctcgaggccagctcctggaccgtgagcaagctgacggacgtccagtccgccctgaccgtggtgagcgggctcggctggaagaagaccaacgtctccgcggccgcccgggacttcctggccaagttcggcatcaacatgtga

SEQ ID NO: 6752 - RNA, 702 nt, synthetic construct
  misc_feature 1..702: note = derived and/or modified CDS sequence (opt1) from BUNV(Peurto Almendras)__AJ697960.1__N
  source 1..702: mol_type = other RNA
atgagcgagatcgccttcgacgacatcggccagatcgccgcgtccaccttcaaccccgacaaccagtacatcgggttcaagaaggtgttcaccatcggcctgacgtacgaccagatccgcatcttcttcctcaacgggaagaaggccaaggagaccctgagcaagcggtccgaggagaccgtcaccctgaacttcggcgggtggcgcatcccgatcgtgaacacgcacttccccggcaaccggaacatcgacctcgccgacgacgccctgaccctgcaccgcgtgagcggctacctcgcccggtacctgctggagaaggtcctctccgcgcaggagcccgagaaggtgatcatcaagacccgcatcatcaaccccatcgccgccagcaacgggatcacctgggacgacggctacgaggtgtacctgtccttcttcccggggagcgagtgcttcctggaggccttcaagttctaccccctcgcgatcggcatctacaaggtccagaaggggatgatggacgtgaagttcctggagaagacgatgcggcagaagtacgccggcctggacgccaccgtgtggacccagcagaagtacaccgacgtcatcaacgccctcctggtggtgaacggcctggggtggaagaagtccaacgtcagcgccgcggccaaggacttcctctccaagttcggcatccagatctga

SEQ ID NO: 6753 - RNA, 702 nt, synthetic construct
  misc_feature 1..702: note = derived and/or modified CDS sequence (opt1) from BUNV__AF325122.1__N
  source 1..702: mol_type = other RNA
atgatcgagctggagttcaacgacgtggccgccaacaccagctccaccttcgaccccgaggtcgcgtacatcaacttcaagcgcctctacacgaccggcctgagctacgaccacatccggatcttctacatcaaggggcgcgagatcaagacctccctggccaagcggagcgagtgggaggtgaccctcaacctgggcgggtggaaggtgacggtcttcaacaccaacttcccgggcaaccgcaactcccccgtgcccgacgacgggctgaccctccaccggctgagcggctacctggcccgctacctcctggagaagatcctgaaggtgtccgaccccgagaagctcatcatcaagagcaagatcatcaacccgctggccgagaagaacggcatcacctggtccgacggggaggaggtctacctgagcttcttccccggctccgagatgttcctcgggacgttccggttctaccccctggccatcggcatctacaaggtgcagcgcaaggagatggagcccaagtacctggagaagaccatgcggcagcgctacatggggctcgaggcgagcacctggaccgtgtccaagctgaacgaggtccagagcgccctgacggtggtgtccggcctcggctggaagaagaccaacgtcagctccgccgcccgggagttcctggcgaagttcgggatcagcatgtga

SEQ ID NO: 6754 - RNA, 702 nt, synthetic construct
  misc_feature 1..702: note = derived and/or modified CDS sequence (opt1) from Ab-BUNV(Cu20-XJ)__KJ710424.1__N
  source 1..702: mol_type = other RNA
atgctggagctcgagttcgaggacgtgcccaccaacatcggcagcaccttcgacccggagtccgggtacatcaacttccagcgcaactacctgcccggcgtcacgctggaccagatccggatcttctacatcaaggggcgcgagatcaagaacagcctcgccaagcggtccgagtgggaggtgaccctgaacctgggcgggtggaaggtgcccgtcctcaacaccaacttccccggcaaccgcagcaacgccgtgccggactacggcctgaccttccaccggatctccgggtacctggcgcgctacctcctgggcaagtacctggccgagacggagcccgagaagctcatcatgcggaccaagatcatcaaccccctggccgagaagaacgggatcacctgggagagcggccccgaggtgtacctgtccttcttcccgggggccgagatgttcctcggcaccttcaagttctaccccctggccatcggcatctacaaggtccagcgcaaggagatggaccccaagttcctggagaagacgatgcggcagcgctacctcgggctggacgcgcagacctggaccaccacgaagctggacgaggtggagcgggccctcaaggtggtcagcggcctggggtggaagaagaccaacgtgtccaacgccgcccgcgagttcctgagcaagttcggcatccggatgtga

SEQ ID NO: 6755 - RNA, 702 nt, synthetic construct
  misc_feature 1..702: note = derived and/or modified CDS sequence (opt1) from ANADV(2513 Irkutsk)__KT313716.1__N
  source 1..702: mol_type = other RNA
atgatcgagctggagttcaacgacgtggccgccaacaccagctccaccttcgaccccgaggtcgcgtacatcaacttcaagcgcatctacacgaccggcctcagctacgaccacatccggatcttctacatcaaggggcgcgagatcaagacctccctggccaagcggagcgagtgggaggtgaccctgaacctcggcgggtggaaggtgacggtcttcaacaccaacttcccgggcaaccgcaactcccccgtgcccgacgacgggctgaccctgcaccggctcagcggcttcctggcccgctacctgctcgagaagatcctgaaggtgtccgaccccgagaagctgatcatcaagagcaagatcatcaacccgctcgccgagaagaacggcatcacctgggccgacggggaggaggtctacctgtccttcttccccggcagcgagatgttcctggggacgttccggttctaccccctcgcgatcggcatctacaaggtgcagcgcaaggagatggagcccaagtacctggagaagaccatgcggcagcgctacatggggctggaggcctccacctggaccgtgagcaagctcaacgaggtccagtccgccctgacggtggtgagcggcctgggctggaagaagaccaacgtctccagcgccgcgcgggagttcctcgcccgcttcgggatcaacatgtga

SEQ ID NO: 6756 - RNA, 702 nt, synthetic construct
  misc_feature 1..702: note = derived and/or modified CDS sequence (opt1) from ANADV(EIV-23263Tyum)__KT313761.1__N
  source 1..702: mol_type = other RNA
atgatcgagctggagttcaacgacgtggccgccaacaccagctccaccttcgaccccgaggtcgcgtacatcaacttcaagcgcatctacacgaccggcctcagctacgaccacatccggatcttctacatcaaggggcgcgagatcaagacctccctggccaagcggagcgagtgggaggtgaccctgaacctcggcgggtggaagatcacggtgttcaacaccaacttcccgggcaaccgcaactcccccgtccccgacgacgggctgaccctgcaccggctcagcggcttcctggcccgctacctgctcgagaagatcctgaaggtgtccgaccccgagaagctgatcatcaagagcaagatcatcaacccgctcgccgagaagaacggcatcacctgggccgacggggaggaggtgtacctgtccttcttccccggcagcgagatgttcctggggacgttccggttctaccccctcgcgatcggcatctacaaggtccagcgcaaggagatggagcccaagtacctggagaagaccatgcggcagcgctacatggggctggaggcctccacctggaccgtgagcaagctcaacgaggtgcagtccgccctgacggtcgtgagcggcctgggctggaagaagaccaacgtgtccagcgccgcgcgggagttcctcgcccgcttcgggatcaacatgtga

SEQ ID NO: 6757 - RNA, 702 nt, synthetic construct
  misc_feature 1..702: note = derived and/or modified CDS sequence (opt1) from BATV__X73464.1__N
  source 1..702: mol_type = other RNA
atgatcgagctggagttcaacgacgtggccgccaacaccagctccaccttcgaccccgaggtcgcgtacatcaacttcaagcgcatctacacgaccggcctcagctacgacaacatccggatcttctacatcaaggggcgcgagatcaagacctccctgagcaagcggtccgagtgggaggtgaccctgaacctcggcgggtggaaggtgacggtcttcaacaccaacttcccgggcaaccgcaacagccccgtgcccgacgacgggctgaccctgcaccggctctccggcttcctggcccgctacctgctcgagaagatcctgaaggtgagcgaccccgagaagctgatcatcaagtccaagatcgtcaacccgctcgccgagaagaacggcatcacctgggccgacggggaggaggtgtacctgagcttcttccccggctccgagatgttcctggggacgttccggttctaccccctcgccatcggcatctacaaggtgcagcgcaaggagatggagcccaagtacctggagaagaccatgcggcagcgctacatggggctggaggcgagcacctggaccgtctccaagctcaacgaggtgcagagcgccctgacggtggtctccggcctgggctggaagaagaccaacgtgagctccgccgcccgggagttcctcgcgaagttcgggatcagcatgtga

SEQ ID NO: 6758 - RNA, 702 nt, synthetic construct
  misc_feature 1..702: note = derived and/or modified CDS sequence (opt1) from BATV(668)__KT313687.1__N
  source 1..702: mol_type = other RNA
atgatcgagctggagttcaacgacgtggccgccaacaccagctccaccttcgaccccgaggtcgcgtacctcaacttcaagcgcatctacacgaccggcctgagctacgacaacatccggatcttctacatcaaggggcgcgagatcaaggtgtccctggccaagcggagcgagtgggaggtgaccctcaacctgggcgggtggaaggtcaccgtgttcaacacgaacttcccgggcaaccgcaactcccccgtgcccgacgacgggctgaccctccaccggctgagcggcttcctggcccgctacctcctggagaagatcctgaaggtctccgaccccgagaagctcatcatcaagagcaagatcatcaacccgctggccgagaagaacggcatcacctggtccgacggggaggaggtgtacctgagcttcttccccggctccgagatgttcctcgggaccttccggttctaccccctggccatcggcatctacaaggtgcagcgcaaggagatggagcccaagtacctggagaagacgatgcggcagcgctacatggggctcgaggcgagcacctggaccgtctccaagctgaacgaggtgcagagcgccctgaccgtggtctccggcctcggctggaagaagacgaacgtgagctccgccgcccgggagttcctggcgaagttcgggatcaacatgtga

SEQ ID NO: 6759 - RNA, 702 nt, synthetic construct
  misc_feature 1..702: note = derived and/or modified CDS sequence (opt1) from BATV(804922)__FJ436805.1__N
  source 1..702: mol_type = other RNA
atgatcgagctggagttcaacgacgtggccgccaacaccagctccaccttcgaccccgaggtcgcgtacatcaacttcaagcgcatctacacgaccggcctcagctacgacaacatccggatcttctacatcaaggggcgcgagatcaagacctccctggccaagcggagcgagtgggaggtgaccctgaacctcggcgggtggaaggtgacggtcttcaacaccaacttcccgggcaaccgcaactcccccgtgcccgacgacgggctgaccctgcaccggctcagcggcttcctggcccgctacctgctcgagaagatcctgaaggtgtccgaccccgagaagctgatcatcaagagcaagatcgtcaacccgctcgccgagaagaacggcatcacctgggccgacggggaggaggtgtacctgtccttcttccccggcagcgagatgttcctggggacgttccggttctaccccctcgcgatcggcatctacaaggtgcagcgcaaggagatggagcccaagtacctggagaagaccatgcggcagcgctacatggggctggaggcctccacctggaccgtcagcaagctcaacgaggtgcagtccgccctgacggtggtcagcggcctgggctggaagaagaccaacgtgtccagcgccgcgcgggagttcctcgccaagttcgggatctccatgtga

SEQ ID NO: 6760 - RNA, 702 nt, synthetic construct
  misc_feature 1..702: note = derived and/or modified CDS sequence (opt1) from BATV(8627-11)__FJ436802.1__N
  source 1..702: mol_type = other RNA
atgatcgagctggagttcaacgacgtggccgccaacaccagctccaccttcgaccccgaggtcgcgtacatcaacttcaagcgcatctacacgaccggcctcagctacgacaacatccggatcttctacatcaaggggcgcgagatcaagacctccctggccaagcggagcgagtgggaggtgaccctgaacctcggcgggtggaaggtgacggtcttcaacaccaacttcccgggcaaccgcaactcccccgtgcccgacgacgggctgaccctgcaccggctcagcggcttcctggcccgctacctgctcgagaagatcctgaaggtgtccgaccccgagaagctgatcatcaagagcaagatcgtcaacccgctcgccgagaagaacggcatcacctgggccgacggggaggaggtgtacctgtccttcttccccggcagcgagatgttcctggggacgttccggttctaccccctcgcgatcggcatctacaaggtgcagcgcaaggagatggagcccaagtacctggagaagaccatgcggcaccgctacatggggctggaggcctccacctggaccgtcagcaagctcaacgaggtgcagtccgccctgacggtggtcagcggcctgggctggaagaagaccaacgtgtccagcgccgcgcgggagttcctcgccaagttcgggatctccatgtga

SEQ ID NO: 6761 - RNA, 702 nt, synthetic construct
  misc_feature 1..702: note = derived and/or modified CDS sequence (opt1) from BATV(G-20217)__FJ436806.1__N
  source 1..702: mol_type = other RNA
atgatcgagctggagttcaacgacgtggccgccaacaccagctccaccttcgaccccgaggtcgcgtacatcaacttcaagcgcatctacacgaccggcctcagctacgacaacatccggatcttctacatcaaggggcgcgagatcaagacctccctggccaagcggagcgagtgggaggtgaccctgaacctcggcgggtggaaggtgacggtcttcaacaccaacttcccgggcaaccgcaactcccccgtgcccgacgacgggctgaccctgcaccggctcagcggcttcctggcccgctacctgctcgagaagatcctgaaggtgtccgaccccgagaagctgatcatcaagagcaagatcgtcaacccgctcgccgagaagaacggcatcacctgggccgacggggaggaggtgtacctgtccttcttccccggcagcgagatgttcctggggacgttccggttctaccccctctccatcggcatctacaaggtgcagcgcaaggagatggagcccaagtacctggagaagaccatgcggcagcgctacatggggctggaggcgagcacctggaccgtctccaagctcaacgaggtgcagagcgccctgacggtggtctccggcctgggctggaagaagaccaacgtgagctccgccgcccgggagttcctcgcgaagttcgggatcagcatgtga

SEQ ID NO: 6762 - RNA, 702 nt, synthetic construct
  misc_feature 1..702: note = derived and/or modified CDS sequence (opt1) from BATV(MS50)__JX846604.1__N
  source 1..702: mol_type = other RNA
atgatcgagctggagttcaacgacgtggccgccaacaccagctccaccttcgaccccgaggtcgcgtacgccaacttcaagcgcgtgcacacgaccggcctcagctacgaccacgtgcggatcttctacatcaaggggcgcgagatcaagacctccctgagcaagcggtccgagtgggaggtcaccctgaacctcggcgggtggaagatcgccgtgtacaacacgaacttcccgagcaaccgcaacaaccccgtgcccgacgacggcctgaccctgcaccggctctccgggtacctggcccgctacctgttcgagaagatcgtcaaggtgagcgagcccgagaagctcctgatcaagtccaagatcatcaacccgctggccgagaagaacggcatcacctgggcggacggcgaggagatctacctcagcttcttccccgggtccgagatgttcctgggcaccttcaagttctaccccctggccatcgggatctacaaggtgcagcggaaggagatggagcccaagtacctcgagaagacgatgcgccagcggtacatgggcctggaggccgggacctggaccgtcagcaaggtgaacgaggtgcaggccgcggtcaacgtggtgtccaccctgggctggaagaagacgaacgtcagcgccgccgcccgcgagttcctcgccaagttcggcatcgcgatgtga

SEQ ID NO: 6763 - RNA, 702 nt, synthetic construct
  misc_feature 1..702: note = derived and/or modified CDS sequence (opt1) from BATV(ON-1/E/94)__AB257761.1__N
  source 1..702: mol_type = other RNA
atgatcgagctggagttcaacgacgtggccgccaacaccagctccaccttcgaccccgaggtcgcgtacatcaacttcaagcgcgtgtacacgaccggcctcagctacgacaacatccggatcttctacatcaaggggcgcgagatcaagacctccctggccaagcggagcgagtgggaggtgaccctgaacctcggcgggtggaaggtcacggtgttcaacaccaacttcccgggcaaccgcaactcccccgtgcccgacgacgggctgaccctgcaccggctcagcggcttcctggcccgctacctgctcgagaagatcctgaaggtctccgaccccgagaagctgatcatcaagagcaagatcgtgaacccgctcgccgagaagaacggcatcacctgggccgacggggaggaggtgtacctgtccttcttccccggcagcgagatgttcctggggacgttccggttctaccccctcgcgatcggcatctacaaggtccagcgcaaggagatggagcccaagtacctggagaagaccatgcggcagcgctacatggggctggaggcctccacctggaccgtgagcaagctcaacgaggtgcagtccgccctgacggtcgtgagcggcctgggctggaagaagaccaacgtgtccagcgccgcgcgggagttcctcgccaagttcgggatctccatgtga

SEQ ID NO: 6764 - RNA, 702 nt, synthetic construct
  misc_feature 1..702: note = derived and/or modified CDS sequence (opt1) from BATV(UgMP-6830)__JX846601.1__N
  source 1..702: mol_type = other RNA
atgatcgagctggagttcaacgacgtggccgccaacaccagctccaccttcgaccccgaggtcgcgtacatcaacttcaagcgcatctacacgaccggcctcagctacgacaacatccggatcttctacatcaaggggcgcgagatcaagacctccctggccaagcggagcgagtgggaggtgaccctgaacctcggcgggtggaaggtgacggtcttcaacaccaacttcccgggcaaccgcaactcccccgtgcccgacgacgggctgaccctgcaccggctcagcggcttcctggcccgctacctgctcgagaagatcctgaaggtgtccgaccccgagaagctgatcatcaagagcaagatcatcaacccgctcgccgagaagaacggcatcacctgggccgacggggaggaggtctacctgtccttcttccccggcagcgagatgttcctggggacgttccggttctaccccctcgcgatcggcatctacaaggtgcagcgcaaggagatggagcccaagtacctggagaagaccatgcggcagcgctacatggggctggaggcctccacctggaccgtgagcaagctcaacgaggtccagtccgccctgacggtggtgagcggcctgggctggaagaagaccaacgtctccagcgccgcgcgggagttcctcgccaagttcgggatctccatgtga

SEQ ID NO: 6765 - RNA, 702 nt, synthetic construct
  misc_feature 1..702: note = derived and/or modified CDS sequence (opt1) from BIRV(ArB2198)__AM711131.1__N
  source 1..702: mol_type = other RNA
atgatcgagctggagttccaccacgtggccgccaacaccagctccaccttcgaccccgaggtcgcgtacgccaacttcaagcgcatccacacgaacggcctcagctacgacaacatccggatcttctacatcaaggggcgcgagatcaagacctccctggccaagcggagcgagtgggaggtgaccctgaacctcggcgggtggaaggtggccgtctacaacaccaacttcccgggcaaccgcaacaaccccgtgcccgacgacgggctgacgctgcaccggctctccggcttcctggcccgctacctgctcgagaagatgctgaaggtgagcgagcccgagaagctgatcatcaagaccaagatcatcaacccgctcgcggagaagaacggcatcacctggaaggacggggaggaggtctacctgtccttcttccccggcagcgagatgttcctggggaccttcaagttctaccccctcgccatcggcatctacaaggtgcagaagaaggagatggaccccaagtacctggagaagacgatgcggcagcgctacatggggctggaggcctccacctggaccgtgagcaaggtctccgaggtgcagagcgccctcaccgtggtctccagcctgggctggaagaagacgaacgtgaccgcggccgcccgggacttcttcgccaagttcggcatcaacatgtga

SEQ ID NO: 6766 - RNA, 702 nt, synthetic construct
  misc_feature 1..702: note = derived and/or modified CDS sequence (opt1) from BOZOV(ArB13529)__AM711132.1__N
  source 1..702: mol_type = other RNA
atgatcgagctggagttcaacgacgtggccgccaacaccagctccaccttcgaccccgaggcggcctacgccaacttcaagcgcgtccacacgaccggcctcacctacgaccacatccggatcttctacatcaaggggagcgagatcaagacctccctggccaagcgcagcgagtgggaggtgacgctgaacctcggcgggtggaagatcaccgtgtacaacaccaacttcccgggcaaccggaacaacccctcccccgacgacgggctgaccctgcacttcttctgcggcttcctcgccaagagcctgctggagaagatgctcaaggtctccgcgcccgagaagctgatcatcaagagcaagatcacgtccccgctggccgagaagaacggcatcacctggaacgacggggaggaggtgtacctcagcttcttccccggctccgagatgttcctggggaccttccacttctaccccctgcccatcggcatctaccaggggctccgccgggacctggagccgaagtacttcggcaagaccctgcgcctcatgtacatgggcctggaggccagctcctggacggtgagcaagctgaccgaggggcagtccgccctcaccgtcgtgagcggcctggggtggaagaagaccaacgtgtccgcggccgcccgggacttcctggccaagttcggcatcaacatgtga

SEQ ID NO: 6767 - RNA, 702 nt, synthetic construct
  misc_feature 1..702: note = derived and/or modified CDS sequence (opt1) from CVV__X73465.1__N
  source 1..702: mol_type = other RNA
atgatcgagctggagttcaacgacgtggccgccaacaccagctccaccttcgaccccgagatcgcgtacgtcaacttcaagcgcatccacacgaccggcctcagctacgaccacatccggatcttctacatcaaggggcgcgagatcaagacctccctgaccaagcggagcgagtgggaggtgacgctgaacctcggcgggtggaaggtgaccgtcttcaacaccaacttcccgggcaaccgcaactcccccgtgcccgacgacgggctgaccctgcaccggctcagcggctacctggcccgctacctgctcgagaagatcctgaaggtgtccgaccccgagaaggtcatcatcaagagcaagatcatcaacccgctggccgagaagaacggcatcacgtggtccgacggggaggaggtgtacctcagcttcttccccggctccgagatgttcctggggaccttcaagttctaccccctggccatcggcatctacaaggtgcagcggaaggagatggagcccaagtacctcgagaagaccatgcgccagcggtacatggggctggaggccagcacctggacgatctccaaggtcaacgaggtgcaggcggccctgaccgtggtcagcggcctcggctggaagaagaccaacgtgtccgccgccgcgcgcgagttcctggccaagttcgggatcagcatgtga

SEQ ID NO: 6768 - RNA, 702 nt, synthetic construct
  misc_feature 1..702: note = derived and/or modified CDS sequence (opt1) from CVV(10081)__KP835932.1__N
  source 1..702: mol_type = other RNA
atgatcgagctggagttcaacgacgtggccgccaacaccagctccaccttcgaccccgagatcgcgtacgtcaacttcaagcgcatctacacgaccggcctcagctacgaccacatccggatcttctacatcaaggggcgcgagatcaagacctccctgaccaagcggagcgagtgggaggtgacgctgaacctcggcgggtggaagatcaccgtgttcaacaccaacttcccgggcaaccgcaactcccccgtccccgacgacgggctgaccctgcaccggctcagcggctacctggcccgctacctgctcgagaagatcctgaaggtgtccgaccccgagaaggtgatcatcaagagcaagatcatcaacccgctggccgagaagaacggcatcacgtggtccgacggggaggaggtctacctcagcttcttccccggctccgagatgttcctggggaccttcaagttctaccccctggccatcggcatctacaaggtgcagcggaaggagatggagcccaagtacctcgagaagaccatgcgccagcggtacatggggctggaggccagcacctggacgatctccaaggtgaacgaggtccaggcggccctgaccgtggtgagcggcctcggctggaagaagaccaacgtctccgccgccgcgcgcgagttcctggccaagttcgggatcagcatgtga

SEQ ID NO: 6769 - RNA, 702 nt, synthetic construct
  misc_feature 1..702: note = derived and/or modified CDS sequence (opt1) from CHLV(CHLV-Mex07)__EU879062.3__N
  source 1..702: mol_type = other RNA
atgatcgagctggagttcaacgacgtggccgccaacaccagctccaccttcgaccccgagatcgcgtacgtcaacttcaagcgcatctacacgaccggcctcagctacgaccacatccggatcttctacatcaaggggcgcgagatcaagacctccctgaccaagcggagcgagtgggaggtgacgctgaacctcggcgggtggaaggtgaccgtcttcaacaccaacttcccgggcaaccgcaactcccccgtgcccgacgacgggctgaccctgcaccggctcagcggctacctggcccgctacctgctcgagaagatcctgaaggtgtccgaccccgagaaggtcatcatcaagagcaagatcatcaacccgctggccgagaagaacggcatcacgtggtccgacggggaggaggtgtacctcagcttcttccccggctccgagatgttcctggggaccttcaagttctaccccctggccatcggcatctacaaggtgcagcggaaggagatggagcccaagtacctcgagaagaccatgcgccagcggtacatggggctggaggccagcacctggacggtctccaaggtgaacgaggtgcaggcggccctgaccgtcgtgagcggcctcggctggaagaagaccaacgtgtccgccgccgcgcgcgagttcctggccaagttcgggatcagcatgtga

SEQ ID NO: 6770 - RNA, 702 nt, synthetic construct
  misc_feature 1..702: note = derived and/or modified CDS sequence (opt1) from GERV__M19420.1__N
  source 1..702: mol_type = other RNA
atgctggagctcgagttcgaggacgtgcccaacaacatcggcagcaccttcgacccggagtccgggtacaccaacttccagcgcaactacctgcccggcgtcacgctggaccagatccggatcttctacatcaaggggcgcgagatcaagaacagcctctccaagcggagcgagtgggaggtgaccctgaacctgggcgggtggaaggtgcccgtcctcaacaccaacttccccggcaaccgcaacaacgccgtgccggactacggcctgaccttccaccggatctccgggtacctggcccgctacctcctgggcaagtacctggcggagacggagcccgagaagctcatcatgcggaccaagatcgtgaaccccctggccgagaagaacgggatcacctgggagagcggccccgaggtctacctgtccttcttcccgggggccgagatgttcctcggcaccttccgcttctaccccctggccatcggcatctacaaggtgcagcggaaggagatggaccccaagttcctggagaagacgatgcgccagcggtacctcgggatcgacgcccagacctggaccaccacgaagctgggcgaggtggaggcggccctgaaggtcgtgagcgggctcggctggaagaagaccaacgtgtccagcgccgcccgcgagttcctgtccaagttcggcatccggatgtga

SEQ ID NO: 6771 - RNA, 702 nt, synthetic construct
  misc_feature 1..702: note = derived and/or modified CDS sequence (opt1) from IACOV(BeAn314206)__JN572067.1__N
  source 1..702: mol_type = other RNA
atgagcgagatcatcttcgacgacgtgggccagatcacctccagcaccttcaaccccgacgtccagtacatcaacttcaagaagaaccacacgaccgggctgaactacgaccagatccgcgtgttcttcctcaacggcaagaaggccaaggagaccctggccaagcggtccgaggagagcctgcagctcaacttcgggggctggcgcgtggtcgtgatgaacacccacttcccggggaaccggaacatgctgatccccgacgaggcgatgacgctgcaccgcctctccggctacctggcccggtacctgctcgagcgcatcctgagcggccccgagcacgagaaggtggtcatcacctccaagatcgtgaaccccatcgccgccagcaacgggatcacctggaccgacggcccggaggtgtacctgtccttcttccccgggacggagatgttcctcgagagcttcaagttctaccccctggccatcggcatctacaaggtccagaagaagatgatggagtccaagtacctggagaaggcgatgcggcagaagtacagcgggatggacgccaccctctggacccagcagaagtacgccgaggtgaccaacgccctggcggtggtctccaacctgggctggaagaagtccaacgtgagcgccgccgcccgcgacttcctcgccaagttcggcatccagctgtga

SEQ ID NO: 6772 - RNA, 702 nt, synthetic construct
  misc_feature 1..702: note = derived and/or modified CDS sequence (opt1) from ILEV(ArB16282)__AM709780.1__N
  source 1..702: mol_type = other RNA
atgatcgagctggagttccacgacgtgaccgccaacaccagctccacgttcgaccccgaggtcgcctacgcgaacttcaagcgcatccacaccaacggcctcaactacgaccacatccggatcttctacatcaaggggcgcgagatcaagaccagcctggccaagcggtccgagtgggaggtgaccctgaacctcggcgggtggaagatcagcgtgtacaacacgaagttcccgggcaaccgcaacaaccccgtccccgacgacgggctgaccctgcaccggctctccggcttcctggcccgctacctgctcgagaagatgctgaaggtgagcgagcccgagaagctgatcatcaagtccaagatcatcaacccgctcgccgagaagaacggcatcacctggtacgacggggaggaggtgtacctgagcttcttccccggctccgagatgtgcctggggacccaggacttctaccccatggccatcgagttctaccaggtccagcggaaggagatggagcccaagttcctcgagaagacgctgaagcagcgcagcctgggcctcgagccgtccacctggaccatcagccagctggtgaagctgcagtccgcgctcaccgtggtcagcgggctgggctggaagaagacgaacgtgggcgccgccgcccggaacttcctggcgaagttcgggatcaacatgtga

SEQ ID NO: 6773 - RNA, 702 nt, synthetic construct
  misc_feature 1..702: note = derived and/or modified CDS sequence (opt1) from ILEV(HB80P125)__AM709779.1__N
  source 1..702: mol_type = other RNA
atgatcgagctggagttccacgacgtgaccgccaacaccagctccacgttcgaccccgaggtcgcctacgcgaacttcaagcgcatccacaccaacggcctcaactacgaccacatccggatcttctacatcaaggggcgcgagatcaagaccagcctggccaagcggtccgagtgggaggtgaccctgaacctcggcgggtggaagatcgccgtgtacaacacgaacttcccgggcaaccgcaacaaccccgtccccgacgacgggctgaccctgcaccggctcagcggctacctggcccgctgcctgctcgagaagatgctgaaggtgtccgagcccgagaagcagatcatcaagagcaagatcatcaacccgctggccgagaagaacggcatcacctgggacgacggggaggaggtgtacctctccttcttccccggcagcgagatgttcctggggaccttccggttctaccccctggcgatcggcatctacaaggtccagcgcaaggagatggagcccaagtacctcgagaagacgatgcggcagcgctacatggggctggaggcctccacctggaccatcagcaagctggccgaggtgcagtccgccctcaccgtggtcagcggcctgggctggaagaagacgaacgtgtccgcggccgcccgggacttcctggccaagttcgggatcaacatgtga

SEQ ID NO: 6774 - RNA, 702 nt, synthetic construct
  misc_feature 1..702: note = derived and/or modified CDS sequence (opt1) from ILEV(ILESHA/8e)__KC608151.1__N
  source 1..702: mol_type = other RNA
atgatcgagctggagttccacgacgtgaccgccaacaccagctccacgttcgaccccgaggtcgcctacgcgaacttcaagcgcatccacaccaacggcctcaactacgaccacatccggatcttctacatcaaggggcgcgagatcaagaccagcctggccaagcggtccgagtgggaggtgaccctgaacctcggcgggtggaagatcgccgtgtacaacacgaacttcccgggcaaccgcaacaaccccatccccgacgacgggctgaccctgcaccggctcagcggctacctggcccgctacctgctcgagaagatgctgaaggtctccgagcccgagaagcagatcatcaagagcaagatcatcaacccgctggccgagaagaacggcatcacctgggacgacggggaggaggtgtacctctccttcttccccggcagcgagatgttcctggggaccttccggttctaccccctggcgatcggcatctacaaggtgcagcgcaaggagatggagcccaagtacctcgagaagacgatgcggcagcgctacatggggctggaggcctccacctggaccatcagcaagctggccgaggtccagtccgccctcaccgtggtgagcggcctgggctggaagaagacgaacgtctccgcggccgcccgggacttcctggccaagttcgggatcaacatgtga

SEQ ID NO: 6775 - RNA, 702 nt, synthetic construct
  misc_feature 1..702: note = derived and/or modified CDS sequence (opt1) from ILEV(R5964)__AY729651.1__N
  source 1..702: mol_type = other RNA
atgatcgagctggagttccacgacgtgaccgccaacaccagctccacgttcgaccccgaggtcgcctacgcgaacttcaagcgcatccacaccaacggcctcaactacgaccacatccggatcttctacatcaaggggcgcgagatcaagaccagcctggccaagcggtccgagtgggaggtgaccctgaacctcggcgggtggaagatcgccgtgtacaacacgaacttcccgggcaaccgcaacaaccccatccccgacgacgggctgaccctgcaccggctcagcggctacctggcccgctacctgctcgagaagatgctgaaggtctccgagcccgagaagcagatcatcaagagcaagatcatcaacccgctggccgagaagaacggcatcacctgggacgacggggaggaggtgtacctctccttcttccccggcagcgagatgttcctggggaccttccggttctaccccctggcgatcggcatctacaaggtgcagcgcaaggagatggagcccaagtacctcgagaagacgatgcggcagcgctacatggggctggaggcctccacctggaccatcagcaagctggccgaggtccagtccgccctcaccgtggtgagcggcctgggctggaagaagacgaacgtctccgcgccggcccgggacttcctggccaagttcgggatcaacatgtga

SEQ ID NO: 6776 - RNA, 702 nt, synthetic construct
  misc_feature 1..702: note = derived and/or modified CDS sequence (opt1) from MAGV__D13783.1__N
  source 1..702: mol_type = other RNA
atgatcgagctggagttcaacgacgtggccgccaacaccagctccaccttcgaccccgagatcgcgtacgtcaacttcaagcgcatccacacgaccggcctcagctacgaccacatccgggtgctgtacatcaaggggcgcgagatcaagacctccctgaccaagcggagcgagtgggaggtgacgctcaacctgggcgggtggaaggtcgccgtgttcaacaccaacttcccgggcaaccgcaactcccccgtgcccgacgacgggctgaccctccaccggctgagcggcttcctggcccgctacctcctggagaagatcctgaaggtctccgaccccgagaagctcatcatcaagagcaagatcatcaacccgctggccgagaagaacggcatcacctgggccgacggggaggaggtgtacctgtccttcttccccggcagcgagatgttcctcgggacgttcaagttctaccccctggcgatcggcatctacaaggtgcagaagaaggagatggagcccaagtacctggagaagaccatgcggcagcgctacatggggctcgaggccgccacctggaccgtctccaaggtgaacgaggtgcaggccgcgctgacggtcgtgagcggcctgggctggaagaagaccaacgtgtccgccgccgcccgggagttcctcgccaagttcgggatcaacatgtga

SEQ ID NO: 6777 - RNA, 702 nt, synthetic construct
  misc_feature 1..702: note = derived and/or modified CDS sequence (opt1) from MAGV(7272)__KX100103.1__N
  source 1..702: mol_type = other RNA
atgatcgagctggagttcaacgacgtggccgccaacaccagctccaccttcgaccccgagatcgcgtacgtcaacttcaagcgcatccacacgaccggcctcagctacgaccacatccgggtgctgtacatcaaggggcgcgagatcaagacctccctgaccaagcggagcgagtgggaggtgacgctcaacctgggcgggtggaaggtcgccgtgttcaacaccaacttcccgggcaaccgcaactcccccgtgcccgacgacgggctgaccctccaccggctgagcggcttcctggcccgctacctcctggagaagatcctgaaggtctccgaccccgagaagctcatcatcaagagcaagatcatcaacccgctggccgagaagaacggcatcacctgggccgacggggaggaggtgtacctgtccttcttccccggcagcgagatgttcctcgggacgttcaagttctaccccctggcgatcggcatctacaaggtgcagcggaaggagatggagcccaagtacctggagaagaccatgcgccagcggtacatggggctcgaggccgccacctggaccgtctccaaggtgaacgaggtgcaggccgcgctgacggtcgtgagcggcctgggctggaagaagaccaacgtgtccgccgccgcccgcgagttcctcgccaagttcgggatcaacatgtga

SEQ ID NO: 6778 - RNA, 702 nt, synthetic construct
  misc_feature 1..702: note = derived and/or modified CDS sequence (opt1) from MAGV(3363)__KX100106.1__N
  source 1..702: mol_type = other RNA
atgatcgagctggagttcaacgacgtggccgccaacaccagctccaccttcgaccccgagatcgcgtacgtcaacttcaagcgcatctacacgaccggcctcagctacgaccacatccggatcttctacatcaaggggcgcgagatcaagacctccctgaccaagcggagcgagtgggaggtgacgctgaacctcggcgggtggaaggtgaccgtcttcaacaccaacttcccgggcaaccgcaactcccccgtgcccgacgacgggctgaccctgcaccggctcagcggctacctggcccgctacctgctcgagaagatcctgaaggtgtccgaccccgagaaggtcatcatcaagagcaagatcatcaacccgctggccgagaagaacggcatcacgtggtccgacggggaggaggtgtacctcagcttcttccccggctccgagatgttcctggggaccttcaagttctaccccctggccatcggcatctacaaggtgcagcggaaggagatggagcccaagtacctcgagaagaccatgcgccagcggtacatggggctggaggccagcacctggacgatctccaaggtcaacgaggtgcaggcggccctgaccgtggtcagcggcctcggctggaagaagaccaacgtgtccgccgccgcgcgcgagttcctggccaagttcgggatcagcatgtga

SEQ ID NO: 6779 - RNA, 702 nt, synthetic construct
  misc_feature 1..702: note = derived and/or modified CDS sequence (opt1) from NRIV(DakArY357/6e)__AY593727.1__N
  source 1..702: mol_type = other RNA
atgatcgagctggagttccacgacgtgaccgccaacaccagctccacgttcgaccccgaggtcgcctacgcgaacttcaagcgcatccacaccaacggcctcaactacgactacatccggatcttctacatcaaggggcgcgagatcaagaccagcctggccaagcggtccgagtgggaggtgaccctgaacctcggcgggtggaagatcgccgtgtacaacacgaacttcccgggcaaccgcaacaaccccatccccgacgacgggctgaccctgcaccggctcagcggctacctggcccgctacctgctcgagaagatgctgaaggtctccgagcccgagaagcagatcatcaagagcaagatcatcaacccgctggccgagaagaacggcatcacctgggacgacggggaggaggtgtacctctccttcttccccggcagcgagatgttcctggggaccttccggttctaccccctggcgatcggcatctacaaggtgcagcgcaaggagatggagcccaagtacctcgagaagacgatgcggcagcgctacatggggctggaggcctccacctggaccatcagcaagctggccgaggtccagtccgccctcaccgtggtgagcggcctgggctggaagaagacgaacgtctccgcggccgcccgggacttcctggccaagttcgggatcaacatgtga

SEQ ID NO: 6780 - RNA, 702 nt, synthetic construct
  misc_feature 1..702: note = derived and/or modified CDS sequence (opt1) from NORV__X73470.1__N
  source 1..702: mol_type = other RNA
atgatcgagctggagttcaacgacgtggccgccaacaccagctccaccttcgaccccgaggtcgcgtacatcaacttcaagcgcgtgtacacgaccggcctcagctacgaccacatccggatcttctacatcaaggggcgcgagatcaagacctccctgaccaagcggagcgagtgggaggtgacgctgaacctcggcgggtggaaggtcaccgtgttcaacaccaacttcccgggcaaccgcaactcccccgtgcccgacgacgggctgaccctgcaccggctcagcggcttcctggcccgctacctgctcgagaagatcctgaaggtctccgagcccgagaagctgatcatcaagagcaagatcatcaacccgctcgccgagaagaacggcatcacgtggaccgacggggaggaggtgtacctgtccttcttccccggcagcgagatgttcctggggaccttcaagttctaccccctcgccatcggcatctacaaggtgcagcggaaggagatggagcccaagtacctggagaagaccatgcgccagcggtacatggggctggaggcctccacgtggaccatcagcaaggtcaacgaggtgcaggcggccctcaccgtggtctccggcctgggctggaagaagaccaacgtgagcgccgccgcgcgcgagttcctggccaagttcgggatcaacatgtga

SEQ ID NO: 6781 - RNA, 702 nt, synthetic construct
  misc_feature 1..702: note = derived and/or modified CDS sequence (opt1) from POTV(89-3380)__AY729652.1__N
  source 1..702: mol_type = other RNA
atgatcgagctggagttcaacgacgtggccgccgacaccagctccaccttcgaccccgagatcgcgtacgtcaacttcaagcgcatccacacgaccggcctcagctacgaccacatccggatcttctacatcaaggggcgcgagatcaagacctccctgaccaagcggagcgagtgggaggtgacgctgaacctcggcgggtggaagatcaccgtgttcaacaccaacttcccgggcaaccgcaactcccccgtccccgacgacgggctgaccctgcaccggctcagcggctacctggcccgctacctgctcgagaagatcctgaaggtgtccgaccccgagaaggtgatcatcaagagcaagatcatcaacccgctggccgagaagaacggcatcacgtggtccgacggggaggaggtctacctcagcttcttccccggctccgagatgttcctggggaccttcaagttctaccccctggccatcggcatctacaaggtgcagcggaaggagatggagcccaagtacctcgagaagaccatgcgccagcggtacatggggctggaggccagcacctggacggtgtccaaggtcaacgaggtgcaggcggccctgaccgtggtcagcggcctcggctggaagaagaccaacgtgtccgccgccgcgcgcgagttcctggccaagttcgggatcagcatgtga

SEQ ID NO: 6782 - RNA, 702 nt, synthetic construct
  misc_feature 1..702: note = derived and/or modified CDS sequence (opt1) from SHOV(4042)__EU564831.1__N
  source 1..702: mol_type = other RNA
atgatcgagctggagttccacgacgtggccgccaacaccagctccaccttcgaccccgaggtcgcgtacgccaacttcaagcgcgtgcacacgaccggcctcagctacgaccacatccggatcttctacatcaaggggcgcgagatcaagacctccctggccaagcggagcgagtgggaggtgaccctgaacctcggcgggtggaagatcacggtctacaacaccaacttcccgggcaaccgcaacaaccccgtgcccgacgacgggctgaccctgcaccggctctccggcttcctggcccgctacctgctcgagaagatgctgaaggtgagcgagcccgagaagctgatcatcaagtccaagatcatcaacccgctcgccgagaagaacggcatcacctggacggacggggaggaggtctacctgagcttcttccccggcgcggagatgttcctggggaccttcaagttctaccccctcgccatcggcatctacaaggtgcagcggaaggagatggagcccaagtacctggagaagaccatgcgccagcggtacatggggctggaggccgccacctggacggtgtccaagctcaccgaggtccaggcggccctgaccgtggtgagcggcctgggctggaagaagaccaacgtctccgccgccgcccgcgacttcctcgcgaagttcgggatcagcatgtga

SEQ ID NO: 6783 - RNA, 702 nt, synthetic construct
  misc_feature 1..702: note = derived and/or modified CDS sequence (opt1) from TENV(TSV-FE3-66FB)__FJ943505.1__N
  source 1..702: mol_type = other RNA
atgatcgagctggagttcaacgacgtggccgccaacaccagctccaccttcgaccccgaggtcggctacgtgaacttcaagcgcgtgcacacgaccgggctcagctacgaccacatccggatcttctacatcaagggccgcgagatcaagacctccctgaccaagcggagcgagtgggaggtcacgctgaacctcgggggctggaaggtgaccgtgttcaacaccaacttcccggggaaccgcaactcccccgtccccgacgacggcctgaccctgcaccggctcagcggcttcctggcgcgctacctgctcgagaagatcctgaaggtgtccgaccccgagaagctgatcatcaagagcaagatcatcaacccgctcgccgagaagaacgggatcacgtgggccgacggcgaggaggtgtacctgtccttcttccccgggagcgagatgttcctgggcaccttcaagttctaccccctcgccatcgggatctacaaggtccagcggaaggagatggagcccaagtacctggagaagaccatgcgccagcggtacatgggcctggaggccgcgacctggacgatctccaaggtgaacgaggtgcagagcgccctcaccgtcgtgtccggcctggggtggaagaagaccaacgtgagcgccgccgcgcgcgagttcctggccaagttcggcatcaacatgtga

SEQ ID NO: 6784 - RNA, 702 nt, synthetic construct
  misc_feature 1..702: note = derived and/or modified CDS sequence (opt1) from XINV(BeH388464)__EU564830.1__N
  source 1..702: mol_type = other RNA
atgctggagctcgagttcaacgacgtggccgccaacaccagctccaccttcgaccccgaggtcggctacgcgaacttcaagcgcatccacacgaacgggctgagctacgacaacatccggatcttctacatcaagggccgcgagatcaagacctccctggccaagcggagcgagtgggaggtgaccctcaacctcgggggctggaagatcaccgtgtacaacacgaacttcccggggaaccgcaaccaccccatccccgacgacggcctgaccatccaccggctgtccggctacctggcccgctacctgctcgagaagatcctgaaggtcagcgaccccgagaagctgctcatcaagaccaagatcatcaacccgctggccgagaagaacgggatcacctggaacgacggcgaggaggtgtacctgtccttcttccccgggagcgagatgttcctcggcacgttcaagttctaccccctggccatcgggatctacaaggtgcagcggaaggagatggagcccaagtacctggagaaggcgatgcgccagcggtacatgggcctcgagtccgccacctggaccgtcagcaagctgaacgaggtgcagtccgccctgaccgtggtcagcggcctcgggtggaagaagacgaacgtgtccgccgcggcccgcgagttcctggccaagttcggcatcaacatgtga

SEQ ID NO: 6785 - RNA, 702 nt, synthetic construct; identical to SEQ ID NO: 6747
  misc_feature 1..702: note = derived and/or modified CDS sequence (opt1) from NRIV(9800535)__JX857328.1__N
  source 1..702: mol_type = other RNA

SEQ ID NO: 6786 - RNA, 702 nt, synthetic construct
  misc_feature 1..702: note = derived and/or modified CDS sequence (opt1) from NRIV(Adrar)__KJ716848.1__N
  source 1..702: mol_type = other RNA
atgatcgagctggagttccacgacgtggccgccaacaccagctccaccttcgaccccgaggtcgcgtacgccaacttcaagcgcatctacacgaccggcctcagctacgaccacatccggatcttctacatcaaggggcgcgagatcaagacctccctggccaagcggagcgagtgggaggtgaccctgaacctcggcgggtggaagatcacggtgtacaacaccaacttcccgggcaaccgcaacaaccccgtccccgacgacgggctgaccctgcaccggctctccggcttcctggcccgctacctgctcgagaagatgctgaaggtgagcgagcccgagaagctgatcatcaagtccaagatcatcaacccgctcgccgagaagaacggcatcacctggaacgacggggaggaggtgtacctgagcttcttccccggctccgagatgttcctggggacgttccggttctaccccctcgcgatcggcatctacaaggtccagcgcaaggagatggagcccaagtacctggagaagaccatgcggcagcgctacatggggctggaggccgccacctggaccgtgagcaagctcacggaggtgcagtccgccctgaccgtcgtgagctccctgggctggaagaagaccaacgtgagcgcggccgcccgggacttcctcgccaagttcggcatcaacatgtga

SEQ ID NO: 6787 - RNA, 702 nt, synthetic construct
  misc_feature 1..702: note = derived and/or modified CDS sequence (opt1) from NRIV(D28542/4e)__KC608154.1__N
  source 1..702: mol_type = other RNA
atgatcgagctggagttccacgacgtggccgccaacaccagctccaccttcgaccccgaggtcgcgtacgccaacttcaagcgcgtgtacacgaccggcctcagctacgaccacatccggatcttctacatcaaggggcgcgagatcaagacctccctggccaagcggagcgagtgggaggtgaccctgaacctcggcgggtggaagatcacggtctacaacaccaacttcccgggcaaccgcaacaaccccgtgcccgacgacgggctgaccctgcaccggctctccggcttcctggcccgctacctgctcgagaagatgctgaaggtgagcgagcccgagaagctgatcatcaagtccaagatcatcaacccgctcgccgagaagaacggcatcacctggaacgacggggaggaggtctacctgagcttcttccccggctccgagatgttcctggggacgttccggttctaccccctcgcgatcggcatctacaaggtgcagcgcaaggagatggagcccaagtacctggagaagaccatgcggcagcgctacatggggctggaggccgccacctggaccgtgagcaagctcacggaggtccagtccgccctgaccgtggtgagctccctgggctggaagaagaccaacgtcagcgcggccgcccgggacttcctcgccaagttcggcatcaacatgtga

SEQ ID NO: 6788 - RNA, 702 nt, synthetic construct
  misc_feature 1..702: note = derived and/or modified CDS sequence (opt1) from NRIV(SUD-HKV141)__JX857322.1__N
  source 1..702: mol_type = other RNA
atgatcgagctggagttccacgacgtggccgccaacaccagctccaccttcgaccccgaggtcgcgtacgccaacttcaagcgcgtgcacacgaccggcctcagctacgaccacatccggatcttctacatcaaggggcgcgagatcaagacctccctggccaagcggagcgagtgggaggtgaccctgaacctcggcgggtggaaggtcacggtgtacaacaccaacttcccgggcaaccgcaacaaccccgtgcccgacgacgggctgaccctgcaccggctctccggcttcctggcccgctacctgctcgagaagatgctgaaggtcagcgagcccgagaagctgatcatcaagtccaagatcatcaacccgctcgccgagaagaacggcatcacctggaacgacggggaggaggtgtacctgagcttcttccccggctccgagatgttcctggggacgttccggttctaccccctcgcgatcggcatctacaaggtgcagcgcaaggagatggagcccaagtacctggagaagaccatgcggcagcgctacatggggctggaggccgccacctggaccgtcagcaagctcacggaggtgcagtccgccctgaccgtggtcagctccctgggctggaagaagaccaacgtgagcgcggccgcccgggacttcctcgccaagttcggcatcaacatgtga

SEQ ID NO: 6789 - RNA, 705 nt, synthetic construct
  misc_feature 1..705: note = derived and/or modified CDS sequence (opt1) from BWAV(M459)__NC_034480.1__N
  source 1..705: mol_type = other RNA
atgagcgacctgatcttctacgacgtggactccgtcaacgccaacgagttcgaccccgacaccggctacctcgacttcaagaacaactacccgggggccctgaacaccaacacggcgcgcaccttcttcctgaacgccgccaaggccaagaacgtgctccggaacaagcccgacaagaaggtgaaccccaagttcggcaactgggaggtcgaggtggtgaacaaccacttccccgggaaccgcaacaacccgatcggcaaggacgacctgaccctgcaccggatcagcgggtacctcgcccgctggatcctggaggagtacaagcgggacgacgagtccgagaaggagatcatcgagagcaccgtcatcaaccccatcgcggagtccaacggcatccgctggagcgacggcgccgagatctacctgtccttcttccccgggacggagatgttcctcgagcccttcaagttctacccgctggccatcggcatctaccgggtgaagcacaagatgatggacgcccagttcctgaagaaggcgctccgccagcggtacgggaagatgaccgccgagaagtggatgagcaccaaggtgaagaccatcggcgaggccgtccgcaacgtggagaagctgaagtgggggaagggcggcctgtccgacgccgcccggaacttcctcaagaagttcgacatcgcgatgatctga

SEQ ID NO: 6790 - RNA, 705 nt, synthetic construct
  misc_feature 1..705: note = derived and/or modified CDS sequence (opt1) from BWAV(M459)__EU564827.1__N
  source 1..705: mol_type = other RNA
atgagcgacctgatcttctacgacgtggactccgtcaacgccaacgagttcgaccccgacaccggctacctcgacttcaagaacaactacccgggggccctgaacaccaacacggcgcgcaccttcttcctgaacgccgccaaggccaagaacgtgctccggaacaagcccgacaagaaggtgaaccccaagttcggcaactgggaggtcgaggtggtgaacaaccacttccccgggaaccgcaacaacccgatcggcaaggacgacctgaccctgcaccggatcagcgggtacctcgcccgctggatcctggaggagtacaagcgggacgacgagtccgagaaggagatcatcgagagcaccgtcatcaaccccatcgcggagtccaacggcatccgctggagcgacggcgccgagatctacctgtccttcttccccgggacggagatgttcctcgagcccttcaagttctacccgctggccatcggcatctaccgggtgaagcacaagatgatggacgcccagttcctgaagaaggcgctccgccagcggtacgggaagatgaccgccgagaagtggatgagcaccaaggtgaaggccatcggcgaggccgtccgcaacgtggagaagctgaagtgggggaagggcggcctgtccgacgccgcgcggaacttcctcaagaagttcgacatcgccatgatctga

SEQ ID NO: 6791 - RNA, 705 nt, synthetic construct
  misc_feature 1..705: note = derived and/or modified CDS sequence (opt1) from BWAV(UgAr1888)__KJ867185.1__N
  source 1..705: mol_type = other RNA
atgagcgacctgatcttctacgacgtggactccgtcaacgccaacgagttcgaccccgacaccggctacctcgacttcaagaacaactacccgggggccctgaacaccaacacggcgcgcaccttcttcctgaacgccgccaaggccaagaacgtgctccggaacaagcccgacaagaaggtgaaccccaagttcggcaactgggaggtcgagatcgtgaacaaccacttccccgggaaccgcaacaacccgatcggcaaggacgacctgaccctgcaccggatcagcgggtacctcgcccgctggatcctggaggagtacaagcgggacgacgagtccgagaaggagatcatcgagagcaccgtgatcaaccccatcgcggagtccaacggcatccgctggagcgacggcgccgagatctacctgtccttcttccccgggacggagatgttcctcgagcccttcaagttctacccgctggccatcggcatctaccgggtcaagcacaagatgatggacgcccagttcctgaagaaggcgctccgccagcggtacgggaagatgaccgccgagaagtggatgagcaccaaggtgaaggccatcggcgaggccgtgcgcaacgtcgagaagctgaagtgggggaagggcggcctgtccgacgccgcgcggaacttcctcaagaagttcgacatcgccatgatctga

SEQ ID NO: 6792 - RNA, 708 nt, synthetic construct
  misc_feature 1..708: note = derived and/or modified CDS sequence (opt1) from BWAV/PGAV(SAAr1)__EU564828.1__N
  source 1..708: mol_type = other RNA
atgagcggcgacctggtgttctacgacgtcgactccgtgaacagcaacgccttcgaccccgacgccgggtacgtggcgttctccaacaaccacccgggcgccctcaacatcaccaccgcccgcacgttcttcctgaacgccgccaaggcgaagggggtcctgcggaacaagcccgacaagaaggtgaagcccaagttcggcgactgggaggtggagatcgtcaacaaccacttccccgggaaccgcaacaacaccatcggcgaggacgacctcaccctgcaccggatcagcggctacctggcccgctgggtgctcgaggagcactccaaggacgacgagagcgagaaggagctgatcgagtccaccatcgtgaacccgatcgccgagagcaacgggatcaagtggtccgacggcgccgcgatctacctgagcttcttccccgggacggagatgttcctcgagcccttcaagttcttccccctggccatcggcatctaccgggtcaagcacaagatgatggacgcccagttcctgaagaaggccctccgccagcggtacgggaagctgaccgccgagaagtggatggcgaccaaggtgaagtccatcggcgaggccgtgcgcgccgtcgagaagctgaagtggggcaagggcgggatcagcgacgccgcccggaccttcctcaagaagttcgacatcgcgctgatctga

SEQ ID NO: 6793 - RNA, 708 nt, synthetic construct; identical to SEQ ID NO: 6792
  misc_feature 1..708: note = derived and/or modified CDS sequence (opt1) from BWAV/PGAV(191B-07)__KJ867179.1__N
  source 1..708: mol_type = other RNA

SEQ ID NO: 6794 - RNA, 708 nt, synthetic construct
  misc_feature 1..708: note = derived and/or modified CDS sequence (opt1) from CEV(283)__KX817314.1__N
  source 1..708: mol_type = other RNA
atgagcgacctggtgttctacgacgtcgcctccaccggcgccaacgggttcgaccccgacgcgggctacgtggacttctgcgccaagtacggggagagcatcaacctcgccgccgtgcgcatcttcttcctgaacgccgcgaaggccaaggccgccctgtcccggaagccggagcgcaaggcgaaccccaagttcggcgagtggcaggtcgaggtggtgaacaaccacttccccgccaaccggaacaaccccatcgggaacaacgacctcaccatccaccgcatcagcggctacctggcccggtgggtcctggagcagtacaaggagaacgaggacgagtcccagcgcgagctcgtgaagacgaccgtgatcaacccgatcgccgagagcaacggcatccggtgggagaacggggccgagatctacctggcgttcttccccggcaccgagatgttcctggagaccttcaagttctaccccctcacgatcgggatctaccgcgtcaagaacggcatgatggactcccagtacctgaagaaggccctgcggcagcgctacgggagcctcaccgccgagaagtggatgtcccagaagaccggcatgatcgccaagagcctgaaggaggtggagcagctgaagtggggccgcgggggcctctccgacaccgcccggacgttcctgcagaagttcgggatcaagctgccctga

SEQ ID NO: 6795 - RNA, 708 nt, synthetic construct
  misc_feature 1..708: note = derived and/or modified CDS sequence (opt1) from CEV(BFS-283)__U12797.1__N
  source 1..708: mol_type = other RNA
atgagcgacctggtgttctacgacgtcgcctccaccggcgccaacgggttcgaccccgacgcgggctacgtggacttctgcgccaagcacggggagagcatcaacctcgccgccgtgcgcatcttcttcctgaacgccgcgaaggccaaggccgccctgtcccggaagccggagcgcaaggcgaaccccaagttcggcgagtggcaggtcgaggtggtgaacaaccacttccccgccaaccggaacaaccccatcgggaacaacgacctcaccatccaccgcatcagcggctacctggcccggtgggtcctggagcagtacaaggagaacgaggacgagtcccagcgcgagctcgtgaagacgaccgtgatcaacccgatcgccgagagcaacggcatccggtgggagaacggggccgagatctacctggcgttcttccccggcaccgagatgttcctggagaccttcaagttctaccccctcacgatcgggatctaccgcgtcaagaacggcatgatggactcccagtacctgaagaaggccctgcggcagcgctacgggagcctcaccgccgagaagtggatgtcccagaagaccggcatgatcgccaagagcctgaaggaggtggagcagctgaagtggggccgcgggggcctctccgacaccgcccggacgttcctgcagaagttcgggatcaagctgccctga

SEQ ID NO: 6796 - RNA, 708 nt, synthetic construct
  misc_feature 1..708: note = derived and/or modified CDS sequence (opt1) from CHATV(Mohko ILO8-3)__KF719221.1__N
  source 1..708: mol_type = other RNA
atgagcgacctggtgttctacgacgtcgcctccaccggcgccaacgggttcgaccccgacgagggctacatggcgttctgcgtgaagcacgccgagagcatctccctcgccgccgtgcgcatcttcttcctgaacgccgcgaaggccaaggccgccctggcgcggaagccggagaagaaggccagccccaagttcggggagtggcaggtcgagatcgtgaacaaccacttccccggcaaccgcaacaaccccatcgggaacaacgacctcaccgtgcaccggctgtccggctacctggcccgctgggtcctcgagcagtacaaggagaacgaggacgagagccagcgggagctgatcaagacgaccgtgatcaacccgatcgccgagtccaacggcgtgcgctgggacagcgggcccgagatctacctgtccttcttccccggcaccgagatgttcctcgagaccttcaagttctaccccctgacgatcgggatctaccgggtcaagcagggcatgatggacccgcagtacctgaagaaggccctccgccagcggtacgggaccctgaccgcggacaagtggatgagccagaaggtgaccgccatcgccaagtccctgaaggaggtggagcagctcaagtggggccgcggcgggctgagcgacacggcccggaccttcctgcagaagttcggcatccgcctcccctga

SEQ ID NO: 6797 - RNA, 708 nt, synthetic construct
  misc_feature 1..708: note = derived and/or modified CDS sequence (opt1) from CHATV(Mohko M07-1)__KF719224.1__N
  source 1..708: mol_type = other RNA
atgagcgacctggtgttctacgacgtcgcctccaccggcgccaacgggttcgaccccgacgagggctacatggcgttctgcgtgaagcacgccgagagcatcaacctcgccgccgtgcgcatcttcttcctgaacgccgcgaaggccaaggccgccctggcgcggaagccggagaagaaggcctcccccaagttcggggagtggcaggtcgagatcgtgaacaaccacttccccggcaaccgcaacaaccccatcgggaacaacgacctcaccgtgcaccggctgagcggctacctggcccgctgggtcctcgagcagtacaaggagaacgaggacgagtcccagcgggagctgatcaagacgaccgtgatcaacccgatcgccgagagcaacggcgtgcgctgggactccgggcccgagatctacctgagcttcttccccggcaccgagatgttcctcgagaccttcaagttctaccccctgacgatcgggatctaccgggtcaagcagggcatgatggacccgcagtacctgaagaaggccctccgccagcggtacgggaccctgaccgcggacaagtggatgtcccagaaggtgaccgccatcgccaagagcctgaaggaggtggagcagctcaagtggggccgcggcgggctgtccgacacggcccggaccttcctgcagaagttcggcatccgcctcccctga

SEQ ID NO: 6798 - RNA, 708 nt, synthetic construct
  misc_feature 1..708: note = derived and/or modified CDS sequence (opt1) from CHATV(Mohko S07-2)__KF719233.1__N
  source 1..708: mol_type = other RNA
atgagcgacctggtgttctacgacgtcgcctccaccggcgccaacgggttcgaccccgacgagggctacatggcgttctgcgtgaagcacgccgagagcatcaacctcgccgccgtgcgcatcttcttcctgaacgccgcgaaggccaaggccgccctggcgcggaagccggagaagaaggcctcccccaagttcggggagtggcaggtcgagatcgtgaacaaccacttccccggcaaccgcaacaaccccatcgggaacaacgacctcaccgtgcaccggctgagcggctacctggcccgctgggtcctcgagcagtacaaggagaacgaggacgagtcccagcgggagctgatcaagacgaccgtgatcaacccgatcgccgagagcaacggcgtgcgctgggactccgggcccgagatctacctgagcttcttccccggcaccgagatgttcctcgagaccttcaaggtctaccccctgacgaccgggatctaccgggtgaagcagggcatgatggacccgcagtacctgaagaaggccctccgccagcggtacgggaccctgaccgcggacaagtggatgtcccagaaggtgacggccatcgccaagagcctgaaggaggtcgagcagctcaagtggggccgcggcgggctgtccgacaccgcccggaccttcctgcagaagttcggcatccgcctcccctga

SEQ ID NO: 6799 - RNA, 708 nt, synthetic construct
  misc_feature 1..708: note = derived and/or modified CDS sequence (opt1) from CHATV(LEIV-11483)__FJ853592.1__N
  source 1..708: mol_type = other RNA
atgagcgacctggtgttctacgacgtcgcctccaccggcgccaacgggttcgaccccgacgagggctacatggcgttctgcgtgaagcacgggcagagcgtgaacctcgccgccgtccgcatcttcttcctgaacgccgccaaggcgaaggccgccctggcccggaagccggagaagaaggcgtcccccaagttcggcgagtggcaggtcgagatcgtgaacaaccacttccccgggaaccgcaacaaccccatcggcaacaacgacctcaccatccaccggctgagcggctacctggcccgctgggtgctcgagcagtacaaggagaacgaggacgagtcccagcgggagctgatcaagacgaccgtgatcaacccgatcgccgagagcaacggggtgcgctgggactccggcgccgagatctacctgagcttcttccccgggaccgagatgttcctcgagaccttcaagttctaccccctgacgatcggcatctaccgggtcaagcaggggatgatggacccccagtacctgaagaaggccctccgccagcggtacggcaccctgaccgcggacaagtggatgtcccagaaggtgaccgccatcgccaagagcctgaaggaggtggagcagctcaagtggggccgcgggggcctgtccgacacggcccggaccttcctgcagaagttcgggatccgcctcccgtga

SEQ ID NO: 6800 - RNA, 708 nt, synthetic construct
  misc_feature 1..708: note = derived and/or modified CDS sequence (opt1) from CHATV(LEIV-11552)__EU479702.1__N
  source 1..708: mol_type = other RNA
atgagcgacctggtgttctacgacgtcgcctccaccggcgccaacgggttcgaccccgacgagggctacatggcgttctgcgtgaagcacgggcagagcgtgaacctcgccgccgtccgcatcttcttcctgaacgccgccaaggcgaaggccgccctggcccggaagccggagaagaaggcgtcccccaagttcggcgagtggcaggtcgagatcgtgaacaaccacttccccgggaaccgcaacaaccccatcggcaacaacgacctcaccatccaccggctgagcggctacctggcccgctggatcctcgagcagtacaaggagaacgaggacgagtcccagcgggagctgatcaagacgaccgtgatcaacccgatcgccgagagcaacggggtgcgctgggactccggcgccgagatctacctgagcttcttccccgggaccgagatgttcctcgagaccttcaagttctaccccctgacgatcggcatctaccgggtgaagcaggggatgatggacccccagtacctgaagaaggccctccgccagcggtacggcaccctgaccgcggacaagtggatgtcccagaaggtcaccgccatcgccaagagcctgaaggaggtggagcagctcaagtggggccgcgggggcctgtccgacacggcccggaccttcctgcagaagttcgggatccgcctcccgtga

SEQ ID NO: 6801 - RNA, 708 nt, synthetic construct
  misc_feature 1..708: note = derived and/or modified CDS sequence (opt1) from CHATV(LEIV-13107)__FJ946829.1__N
  source 1..708: mol_type = other RNA
atgagcgacctggtgttctacgacgtcgcctccaccggcgccaacgggttcgaccccgacgagggctacatggcgttctgcgtgaagcacgggcagagcgtgaacctcgccgccgtccgcatcttcttcctgaacgccgccaaggcgaaggccgccctggcccggaagccggagaagaaggcgaaccccaagttcggcgagtggcaggtcgagatcgtgaacaaccacttccccgggaaccgcaacaaccccatcggcaacaacgacctcaccatccaccggctgtccggctacctggcccgctgggtgctcgagcagtacaaggagaacgaggacgagagccagcgggagctgatcaagacgaccgtgatcaacccgatcgccgagtccaacggggtgcgctgggacagcggcgccgaggtctacctgtccttcttccccgggaccgagatgttcctcgagaccttcaagttctaccccctgacgatcggcatctaccgggtgaagcaggggatgatggacccccagtacctgaagaaggccctccgccagcggtacggcaccctgaccgcggacaagtggatgagccagaaggtgaccgccatcgccaagtccctgaaggaggtcgagcagctcaagtggggccgcgggggcctgagcgacacggcccggaccttcctgcagaagttcgggatccgcctcccgtga

SEQ ID NO: 6802 - RNA, 708 nt, synthetic construct
  misc_feature 1..708: note = derived and/or modified CDS sequence (opt1) from CHATV(LEIV-17794)__FJ913879.1__N
  source 1..708: mol_type = other RNA
atgagcgacctggtgttctacgacgtcgcctccaccggcgccaacgggttcgaccccgacgagggctacatggcgttctgcgtgaagcacgggcagagcgtgaacctcgccgccgtccgcatcttcttcctgaacgccgccaaggcgaaggccgccctggcccggaagccggagcgcaaggcgtcccccaagttcggcgagtggcaggtcgagatcgtgaacaaccacttccccgggaaccggaacaaccccatcggcaacaacgacctcaccatccaccgcctgagcggctacctggcccggtgggtgctcgagcagtacaaggagaacgaggacgagtcccagcgcgagctgatcaagacgaccgtgatcaacccgatcgccgagagcaacggggtgcggtgggactccggcgccgagatctacctgagcttcttccccgggaccgagatgttcctcgagaccttcaagttctaccccctgacgatcggcatctaccgcgtcaagcaggggatgatggacccccagtacctgaagaaggccctccggcagcgctacggcaccctgaccgcggacaagtggatgtcccagaaggtgaccgccatcgccaagagcctgaaggaggtggagcagctcaagtggggccgcgggggcctgtccgacacggcccggaccttcctgcagaagttcgggatccggctcccgtga

SEQ ID NO: 6803 - RNA, 708 nt, synthetic construct
  misc_feature 1..708: note = derived and/or modified CDS sequence (opt1) from CHATV(LEIV-17827)__GQ330475.1__N
  source 1..708: mol_type = other RNA
atgagcgacctggtgttctacgacgtcgcctccaccggcgccaacgggttcgaccccgacgagggctacatggcgttctgcgtgaagtacggggagagcatcaacctcgccgccgtgcgcatcttcttcctgaacgccgccaaggcgaaggccgccctggcccggaagccggagaagaaggcgaaccccaagttcggcgagtggcaggtcgagatcgtgaacaaccacttccccgggaaccgcaacaaccccatcggcaacaacgacctcaccatccaccggctgtccggctacctggcccgctgggtgctcgagcagtacaaggagaacgaggacgagagccagcgggagctgatcaagacgaccatcatcaacccgatcgccgagtccaacggggtccgctgggagagcggcgccgaggtgtacctgtccttcttccccgggaccgagatgttcctcgagatcttcaagttctaccccctgaccatcggcatctaccgggtgaagcaggggatgatggacccccagtacctgaagaaggccctccgccagcggtacggcacgctgaccgcggacaagtggatgagccagaaggtcaccgccatcgccaagtccctgaaggaggtggagcagctcaagtggggccgcgggggcctgagcgacaccgcccggacgttcctgcagaagttcgggatccgcctcccgtga

SEQ ID NO: 6804 - RNA, 708 nt, synthetic construct
  misc_feature 1..708: note = derived and/or modified CDS sequence (opt1) from CHATV(LEIV-17829)__GQ330476.1__N
  source 1..708: mol_type = other RNA
atgagcgacctggtgttctacgacgtcgcctccaccggcgccaacgggttcgaccccgacgagggctacatggcgttctgcgtgaagtacggggagagcatcaacctcgccgccgtgcgcatcttcttcctgaacgccgccaaggcgaaggccgccctggcccggaagccggagaagaaggcgaaccccaagttcggcgagtggcaggtcgagatcgtgaacaaccacttccccgggaaccgcaacaaccccatcggcaacaacgacctcaccatccaccggctgtccggctacctggcccgctgggtgctcgagcagtacaaggagaacgaggacgagagccagcgggagctgatcaagacgaccatcatcaacccgatcgccgagtccaacggggtccgctgggacagcggcgccgaggtgtacctgtccttcttccccgggaccgagatgttcctcgagatcttcaagttctaccccctgaccatcggcatctaccgggtgaagcaggggatgatggacccccagtacctgaagaaggccctccgccagcggtacggcacgctgaccgcggacaagtggatgagccagaaggtcaccgccatcgccaagtccctgaaggaggtggagcagctcaagtggggccgcgggggcctgagcgacaccgcccggacgttcctgcagaagttcgggatccgcctcccgtga

SEQ ID NO: 6805 - RNA, 708 nt, synthetic construct
  misc_feature 1..708: note = derived and/or modified CDS sequence (opt1) from CHATV(LEIV-18733)__HQ734824.1__N
  source 1..708: mol_type = other RNA
atgagcgacctggtgttctacgacgtcgcctccaccggcgccaacgggttcgaccccgacgagggctacatggcgttctgcgtgaagtacggggagagcatcaacctcgccgccgtgcgcatcttcttcctgaacgccgccaaggcgaaggccgccctggcccggaagccggagaagaaggcgaaccccaagttcggcgagtggcaggtcgagatcatcaacaaccacttccccgggaaccgcaacaaccccatcggcaacaacgacctcaccatccaccggctgtccggctacctggcccgctgggtgctcgagcagtacaaggagaacgaggacgagagccagcgggagctgatcaagacgaccatcatcaacccgatcgccgagtccaacggggtgcgctgggacagcggcgccgaggtctacctgtccttcttccccgggaccgagatgttcctcgagatcttcaagttctaccccctgaccatcggcatctaccgggtgaagcaggggatgatggacccccagtacctgaagaaggccctccgccagcggtacggcacgctgaccgcggacaagtggatgagccagaaggtgaccgccatcgccaagtccctgaaggaggtcgagcagctcaagtggggccgcgggggcctgagcgacaccgcccggacgttcctgcagaagttcgggatccgcctcccgtga

SEQ ID NO: 6806 - RNA, 708 nt, synthetic construct
  misc_feature 1..708: note = derived and/or modified CDS sequence (opt1) from CHATV(LEIV-18895)__GQ330482.1__N
  source 1..708: mol_type = other RNA
atgagcgacctggtgttctacgacgtcgcctccaccggcgccaacgggttcgaccccgacgagggctacatggcgttctgcgtgaagtacggggagagcatcaacctcgccgccgtgcgcatcttcttcctgaacgccgccaaggcgaaggccgccctggcccggaagccggagcgcaaggcgaaccccaagttcggcgagtggcaggtcgagatcgtgaacaaccacttccccgggaaccggaacaaccccatcggcaacaacgacctcaccatccaccgcctgtccggctacctggcccggtgggtgctcgagcagtacaaggagaacgaggacgagagccagcgcgagctgatcaagacgaccatcatcaacccgatcgccgagtccaacggggtccggtgggacagcggcgccgaggtgtacctgtccttcttccccgggaccgagatgttcctcgagatcttcaagttctaccccctgaccatcggcatctaccgcgtgaagcaggggctgatggacccccagtacctcaagaaggccctgcggcagcgctacggcacgctgaccgcggacaagtggatgagccagaaggtcaccgccatcgccaagtccctcaaggaggtggagcagctgaagtggggccgcgggggcctgagcgacaccgcccggacgttcctccagaagttcgggatccggctgccgtga

SEQ ID NO: 6807 - RNA, 708 nt, synthetic construct
  misc_feature 1..708: note = derived and/or modified CDS sequence (opt1) from CHATV(LEIV-22712)__HQ734825.1__N
  source 1..708: mol_type = other RNA
atgagcgacctggtgttctacgacgtcgcctccaccggcgccaacgggttcgaccccgacgagggctacatggcgttctgcgtgaagcacggggagagcatcaacctcgccgccgtgcgcatcttcttcctgaacgccgccaaggcgaaggccgccctggcccggaagccggagaagaaggcgtcccccaagttcggcgagtggcaggtcgagatcatcaacaaccacttccccgggaaccgcaacaaccccatcggcaacaacgacctcaccatccaccggctgagcggctacctggcccgctgggtgctcgagcagtacaaggagaacgaggacgagtcccagcgggagctgatcaagacgaccgtgatcaacccgatcgccgagagcaacggggtccgctgggactccggcgccgagatctacctgagcttcttccccgggaccgagatgttcctcgagaccttcaagttctaccccctgacgatcggcatctaccgggtgaagcaggggatgatggacccccagtacctgaagaaggccctccgccagcggtacggcaccctgaccgcggacaagtggatgtcccagaaggtgaccgccatcgccaagagcctgaaggaggtcgagcagctcaagtggggccgcgggggcctgtccgacacggcccggaccttcctgcagaagttcgggatccgcctcccgtga

SEQ ID NO: 6808 - RNA, 708 nt, synthetic construct
  misc_feature 1..708: note = derived and/or modified CDS sequence (opt1) from CHATV(LEIV-23500)__EU479701.1__N
  source 1..708: mol_type = other RNA
atgagcgacctggtgttctacgacgtcgcctccaccggcgccaacgggttcgaccccgacgcgggctacatggccttctgcgtgaagcacggggagagcatcaacctcgccgccgtgcgcatcttcttcctgaacgccgcgaaggccaaggccgccctggcgcggaagccggagaagaaggccaaccccaagttcggcgagtggcaggtcgagatcgtgaacaaccacttccccgggaaccgcaacaaccccatcggcaacaacgacctcaccatccaccggctgtccggctacctggcccgctgggtgctcgagcagtacaaggagaacgaggacgagagccagcgggagctgatcaagacgaccgtcatcaacccgatcgccgagtccaacggggtgcgctgggagaacggcgccgaggtgtacctgagcttcttccccgggaccgagatgttcctcgagaccttcaagttctaccccctgacgatcggcatctaccgggtcaagcaggggatgatggacccccagtacctgaagaaggcgctccgccagcggtacggcaccctgaccgccgacaagtggatgtcccagaaggtgaccgccatcgccaagagcctgaaggaggtggagcagctcaagtggggccgcgggggcctgtccgacacggcccggaccttcctgcagaagttcgggatccgcctcccgtga

SEQ ID NO: 6809 - RNA, 708 nt, synthetic construct
  misc_feature 1..708: note = derived and/or modified CDS sequence (opt1) from INKV__Z68496.1__N
  source 1..708: mol_type = other RNA
atgggcgacctggtgttctacgacgaggccagcaccggggccaacggcttcgaccccgacgcggggttcgtcgccttcatggccgaccacggcgagtccatcaacctcgccgccgtgcgcatcttcttcctgaacgcggccaaggccaaggccgcgctggcccggaagccggagcgcaaggccacccccaagttcggggagtggcaggtcgagatcgtgaacaaccacttccccggcaaccggaacaaccccatcggcaacaacgacctcacgatccaccgcctgagcgggtacctggcccggtgggtgctcgagcacttcaccgaggacgacgacgagtcccagcgcgagctgatccggagcaccatcatcaacccgatcgccgagtccaacggcatccactggaacaacgggcccgagatctacctgagcttcttccccggcaccgagatgttcctcgaggtgttcaagttctaccccctgacgatcgggatctaccgcgtcaagcacggcatgatggacccgcagtacctgaagaaggcgctccggcagcgctacggcaccctgaccgccgagaagtggatggcccagaagaccgtgctgatcgccaagtccctcaaggacgtggagcagctgaagtgggggcggggcgggctgagcgacgccgcgcgcacgttcctcatcaagttcggcgtcaagctgccctga

SEQ ID NO: 6810 - RNA, 708 nt, synthetic construct
  misc_feature 1..708: note = derived and/or modified CDS sequence (opt1) from INKV(KN3641)__U47137.1__N
  source 1..708: mol_type = other RNA
atgggcgacctggtgttctacgacgtcgccagcaccggggccaacggcttcgaccccgacgcggggttcgtggccttcatggccgaccacggcgagtccatcaacctcgccgccgtgcgcatcttcttcctgaacgcggccaaggccaaggccgcgctggcccggaagccggagcgcaaggccacccccaagttcggggagtggcaggtcgagatcgtgaacaaccacttccccggcaaccggaacaaccccatcggcaacaacgacctcacgatccaccgcctgagcgggtacctggcccggtgggtgctcgagcacttcaccgaggacgacgacgagtcccagcgcgagctgatccggagcaccatcatcaacccgatcgccgagtccaacggcatccactggaacaacgggcccgagatctacctgagcttcttccccggcaccgagatgttcctcgaggtcttcaagttctaccccctgacgatcgggatctaccgcgtgaagcacggcatgatggacccgcagtacctgaagaaggcgctccggcagcgctacggcaccctgaccgccgagaagtggatggcccagaagaccgtgctgatcgccaagtccctcaaggacgtcgagcagctgaagtgggggcggggcgggctgagcgacgccgcgcgcacgttcctcatcaagttcggcgtgaagctgccctga

SEQ ID NO: 6811 - RNA, 708 nt, synthetic construct
  misc_feature 1..708: note = derived and/or modified CDS sequence (opt1) from INKV(Lovanger)__KU302751.1__N
  source 1..708: mol_type = other RNA
atgggcgacctggtgttctacgacgtcgccagcaccggggccaacggcttcgaccccgacgcggggttcgtggccttcatggccgaccacggcgagtccatcaacctcgccgccgtgcgcatcttcttcctgaacgcggccaaggccaaggccgcgctggcccggaagccggagcgcaaggccacccccaagttcggggagtggcaggtcgagatcgtgaacaaccacttccccggcaaccggaacaaccccatcggcaacaacgacctcacgatccaccgcctgagcgggtacctggcccggtgggtgctcgagcacttcaccgaggacgacgacgagtcccagcgcgagctgatccggagcaccatcatcaacccgatcgccgagtccaacggcatccactggaacaacgggcccgagatctacctgagcttcttccccggcaccgagatgttcctcgaggtcttcaagttctaccccctgacgatcgggatctaccgcgtgaagcacggcatgatggacccgcagtacctgaagaaggcgctccggcagcgctacggcaccctgaccgccgagaagtggatgacccagaagacggtgctgatcgccaagtccctcaaggacgtcgagcagctgaagtgggggcggggcgggctgagcgacgccgcccgcaccttcctcatcaagttcggcgtgaagctgccctga

SEQ ID NO: 6812 - RNA, 708 nt, synthetic construct
  misc_feature 1..708: note = derived and/or modified CDS sequence (opt1) from INKV(SW AR 83-161)__U47138.1__N
  source 1..708: mol_type = other RNA
atgggcgacctggtgttctacgacgtcgccagcaccggggccaacggcttcgaccccgacgcggggttcgtggccttcatggccgaccacggcgagtccatcaacctcgccgccgtgcgcatcttcttcctgaacgcggccaaggccaaggccgcgctggcccggaagccggagcgcaaggccacccccaagttcggggagtggcaggtcgagatcgtgaacaaccacttccccggcaaccggaacaaccccatcggcaacaacgacctcacgatccaccgcctgagcgggtacctggcccggtgggtgctcgagcacttcaccgaggacgacgacgagtcccagcgcgagctgatccggagcaccatcatcaacccgatcgccgagtccaacggcatccactggaacaacgggcccgagatctacctgagcttcctccccggcaccgagatgttcctggaggtcttcaagttctaccccctgacgatcgggatctaccgcgtgaagcacggcatgatggacccgcagtacctcaagaaggcgctgcggcagcgctacggcaccctgaccgccgagaagtggatggcccagaagaccgtgctcatcgccaagtccctgaaggacgtcgagcagctgaagtgggggcggggcgggctcagcgacgccgcgcgcacgttcctgatcaagttcggcgtgaagctgccctga

SEQ ID NO: 6813 - RNA, 708 nt, synthetic construct
  misc_feature 1..708: note = derived and/or modified CDS sequence (opt1) from LUMV__X73468.1__N
  source 1..708: mol_type = other RNA
atgagcgacctggtgttctacgacgtcgcctccaccggcgccaacgggttcgaccccgacgcgggctacgtggacttctgcgtgaagcacggggagagcatcaacctccactccgtccgcatcttcttcctgaacgccgccaaggccaaggccgcgctggcccggaagccggagcgcaaggccagccccaagttcggcgagtggcaggtcgagatcgtgaacaaccacttccccgggaaccggaacaaccccatcgacaacaacgacctcaccatccaccgcctgtccggctacctggcccggtgggtgctcgagcagttcaaggagaacgaggacgcggcccagcgcgagctgatcaagacgaccgtgatcaacccgatcgccgagagcaacggcatccggtgggacaacggggccgagatctacctggccttcttccccggcaccgagatgttcctcgagaccttcaacttctaccccctgacgatcgggatctaccgcgtgaagcacggcatgatggacccccagtacctgaagaaggcgctccggcgccggtacgggtccctgaccgccgacaagtggatgagccagaagaccgtcgccatcgccaagtccctgaaggacgtggagcagctcaagtggggccgcggcgggctgagcgacaccgcccgggtgttcctgcagaagttcggcatcaagctcccgtga

SEQ ID NO: 6814 - RNA, 708 nt, synthetic construct
  misc_feature 1..708: note = derived and/or modified CDS sequence (opt1) from LUMV(SAAr 1881)__KX817326.1__N
  source 1..708: mol_type = other RNA
atgagcgacctggtgttctacgacgtcgcctccaccggcgccaacgggttcgaccccgacgcgggctacgtggacttctgcgtgaagcacggggagagcatcaacctccactccgtccgcatcttcttcctgaacgccgccaaggccaaggccgcgctggcccggaagccggagcgcaaggccagccccaagttcggcgagtggcaggtcgagatcgtgaacaaccacttccccgggaaccggaacaaccccatcgacaacaacgacctcaccatccaccgcctgtccggctacctggcccggtgggtgctcgagcagttcaaggagaacgaggacgcggcccagcgcgagctgatcaagacgaccgtgatcaacccgatcgccgagagcaacggcatccggtgggacaacggggccgagatctacctggccttcttccccggcaccgagatgttcctcgagaccttcaacttctaccccctgacgatcgggatctaccgcgtgaagcacggcatgatggacccccagtacctgaagaaggcgctccggcagcgctacgggtccctgaccgccgacaagtggatgagccagaagaccgtcgccatcgccaagtccctgaaggacgtggagcagctcaagtggggccggggcgggctgagcgacaccgcccgcgtgttcctgcagaagttcggcatcaagctcccgtga

SEQ ID NO: 6815 - RNA, 708 nt, synthetic construct
  misc_feature 1..708: note = derived and/or modified CDS sequence (opt1) from MELV(TRVL 9375)__KX817329.1__N
  source 1..708: mol_type = other RNA
atgggcgacctgatcttctacgacgtggccagcaccggggccaacggcttcgaccccgacgcggggtacctcgccttcaccatcgcccacggcgaggccatcaacctgtccgccgtccgcatcttcttcctgaacgcggccaaggccaaggccgcgctcagccggaagccggagcgcaaggccacgcccaagttcggggactggcaggtcgagatcgtgaacaaccacttccccggcaaccggaacaaccccatcggcaacaacgacctgaccatccaccgcctgtccgggtacctcgcccggtgggtgctggacctgttcaaggagaacgaggacgagagccagaaggagctcatccagtccaccatcatcaacccgatcgccgagagcaacggcatccactgggccaacggggtggagatctacctgtccttcttccccggcaccgagatgttcctggaggcgttccgcttctaccccctcacgatcgggatctaccgggtgaagcacggcctgatggacccccagtacctgaagaaggccctccgccagcggtacggcaccctgaccgccgacaagtggatggcccagaagaccacgatgatcgccaagagcctgaaggacgtcgagcagctcaagtgggggaagggcgggctgtccgacgcggcccgcaccttcctgcagaagttcggcgtgcggctcccgtga

SEQ ID NO: 6816 - RNA, 708 nt, synthetic construct
  misc_feature 1..708: note = derived and/or modified CDS sequence (opt1) from MBV__U31989.1__N
  source 1..708: mol_type = other RNA
atgagcgacctggtgttctacgacgtcgcctccaccggcgccaacgggttcgaccccgacgcgggctacgtggacttctgcgccaagcacggggagagcatcaacctcgccgccgtgcgcatcttcttcctgaacgccgcgaaggccaaggccgccctgtcccggaagccggagcgcaaggcgaaccccaagttcggcgagtggcaggtcgagatcgtgaacaaccacttccccgccaaccggaacaaccccatcgggaacaacgacctcaccatccaccgcatcagcggctacctggcccggtgggtgctggagcagtaccgcgagaacgaggacgagtcccagcgggagctcgtcaagacgaccgtgatcaacccgatcgccgagagcaacggcatccgctgggagaacgggcccgagatctacctggccttcttccccggcaccgagatgttcctggagaccttcaagttctaccccctcacgatcgggatctaccgggtgaagcacggcatgatggacccgcagtacctgaagaaggcgctgcgccagcggtacgggtccctcaccgccgagaagtggatgagccagaagaccggcatgatcgccaagtccctgaaggaggtcgagcagctgaagtggggccgcgggggcctcagcgacaccgcccggacgttcctgcagaagttcgggatccgcctgccctga

SEQ ID NO: 6817 - RNA, 708 nt, synthetic construct
  misc_feature 1..708: note = derived and/or modified CDS sequence (opt1) from SAV(VR723)__U47139.1__N
  source 1..708: mol_type = other RNA
atgagcgagctggtgttctacgacgtcgcctccaccggcgccaacgggttcgaccccgacgcgggctacctcgccttctgcgtgaagcacggggagagcatctccctgagctccgtgcgcatcttcttcctgaacgccgccaaggccaaggcggccctcagccggaagccggagcgcaaggccaaccccaagttcggcgagtggcaggtcgagatcgtgaacaaccacttccccgggaaccggaacaaccccatcgacaacctggacctgaccatccaccgcctctccggctacctggcccggtgggtgctggagcagttcatcgagaacgaggacgagagccagcgcgagctcatcaagacgaccgtcatcaacccgatcgcggagtccaacggcatcaagtgggagaacggggccgagatctacctgagcttcttccccggcaccgagatgttcctggagatcttcaagttctaccccctcaccatcgggatctaccgggtgaagcagggcatgatggacccccagtacctgaagaaggccctgcgccagcggtacgggtccctcacggccgacaagtggatgagccagaaggtgggcgccatcgcgaagtccctgaaggacatcgagcagctgaagtggggcaagggcgggctcagcgacaccgcccgcaccttcctgcagaagttcgggatcaagctgccgtga

SEQ ID NO: 6818 - RNA, 708 nt, synthetic construct
  misc_feature 1..708: note = derived and/or modified CDS sequence (opt1) from SDNV(BeAr 103645)__U47140.1__N
  source 1..708: mol_type = other RNA
atgggcgacctggtgttctacgacgtcgccagcaccggggccaacggcttcgaccccgacgcggggttcgtggccttcatggccggccacggggagtccatcaacctcaccgccgtgcgcatcttcttcctgaacgccgcgaaggccaaggccgccctgagccggaagccggagcgcaaggcgacgcccaagttcggcgactggcaggtcgagatcgtgaacaaccacttccccggcaaccggaacaaccccatcgggaacaacgacctcaccatccaccgcatctccggctacctggcccggtggaccctggagcacttccgcgagggcggggacgaggcccagaaggagctcatccggaccacgatcatcaacccgatcgccgagagcaacgggatccactgggccaacggcgcggagatctacctgtccttcttccccggcaccgagatgttcctggaggccttcaagttctaccccctcaccatcgggatctaccgcgtgaagcacggcatgatggacgcccagtacctgaagaaggccctgcggcagcgctacgggaccctcacggccgacgagtggatggcgcagaagaccgtcctgatcaccaagagcctgaaggacgtggagcagctcaagtggggccggggcgggctgtccgacgccgcccgcaccttcctgagcaagttcggcgtgaagctcccctga

SEQ ID NO: 6819 - RNA, 708 nt, synthetic construct
  misc_feature 1..708: note = derived and/or modified CDS sequence (opt1) from SDNV(BeAr 103645)__KX817335.1__N
  source 1..708: mol_type = other RNA
atgggcgacctggtgttctacgacgtcgccagcaccggggccaacggcttcgaccccgacgcggggttcgtggccttcatggccggccacggggagtccatcaacctcaccgccgtgcgcatcttcttcctgaacgccgcgaaggccaaggccgccctgagccggaagccggagcgcaaggcgacgcccaagttcggcgactggcaggtcgagatcgtgaacaaccacttccccggcaaccggaacaaccccatcgggaacaacgacctcaccatccaccgcatctccggctacctggcccggtggaccctggagcacttccgcgagggggaggacgaggcccagaaggagctcatccggaccacgatcatcaacccgatcgccgagagcaacggcatccactgggccaacggggcggagatctacctgtccttcttccccggcaccgagatgttcctggaggccttcaagttctaccccctcaccatcggcatctaccgcgtgaagcacgggatgatggacgcccagtacctgaagaaggccctgcggcagcgctacggcaccctcacggccgacaagtggatggcgcagaagaccgtcctgatcaccaagagcctgaaggacgtggagcagctcaagtgggggcggggcggcctgtccgacgccgcccgcaccttcctgagcaagttcggggtgaagctcccctga

SEQ ID NO: 6820 - RNA, 708 nt, synthetic construct
  misc_feature 1..708: note = derived and/or modified CDS sequence (opt1) from SSHV__EU294510.1__N
  source 1..708: mol_type = other RNA
atgagcgacctggtgttctacgacgtcgcctccaccggcgccaacgggttcgaccccgacgcgggctacatggccttctgcgtgaagtacgccgagagcgtgaacctcgccgccgtccgcatcttcttcctgaacgcggccaaggccaaggccgcgctgtcccggaagccggagcgcaaggccaaccccaagttcggggagtggcaggtcgaggtggtgaacaaccacttccccggcaaccggaacaaccccatcaacagcgacgacctcaccatccaccgcctgtccgggtacctggcccggtgggtgctcgagcagtacaaggagaacgaggacgagagccgccgggagctgatcaagacgaccatcatcaacccgatcgccgagtccaacggcgtgcgctgggacagcggcgccgagatctacctgtccttcttccccgggaccgagatgttcctcgagaccttcaagttctaccccctgacgatcggcatctaccgggtcaagcaggggatgatggacccccagtacctgaagaaggcgctccgccagcggtacggcagcctgaccgccgacaagtggatgtcccagaaggtgaccgccatcgccaagagcctgaaggaggtggagcagctcaagtgggggcgcggcggcctgtccgacaccgcccggagcttcctgcagaagttcgggatccgcctcccgtga

SEQ ID NO: 6821 - RNA, 708 nt, synthetic construct
  misc_feature 1..708: note = derived and/or modified CDS sequence (opt1) from SSHV(F10838)__KM215563.1__N
  source 1..708: mol_type = other RNA
atgagcgacctggtgttctacgacgtcgcctccaccggcgccaacgggttcgaccccgacgcgggctacatggccttctgcgtgaagtacgccgagagcgtgaacctcgccgccgtccgcatcttcttcctgaacgcggccaaggccaaggccgcgctgtcccggaagccggagcgcaaggccaaccccaagttcggggagtggcaggtcgaggtggtgaacaaccacttccccggcaaccggaacaaccccatcaacagcgacgacctcaccatccaccgcctgtccgggtacctggcccggtgggtgctcgagcagtacaaggagaacgaggacgagagccgccgggagctgatcaagacgaccatcatcaacccgatcgccgagtccaacggcgtgcgctgggacagcggcgccgagatctacctgtccttcttccccgggaccgagatgttcctcgagaccttcaagttctaccccctgacgatcggcatctaccgggtcaagcaggggatgatggacccccagtacctgaagaaggcgctccgccagcggtacggcagcctgaccgccgacaagtggatgtcccagaaggtgaccgccatcgccaagagcctgaaggaggtggagcagctcaagtgggggcgcggcggcctgtccgacaccgcccggagcctgctccagaagttcgggatccgcctgccgtga

SEQ ID NO: 6822 - RNA, 708 nt, synthetic construct
  misc_feature 1..708: note = derived and/or modified CDS sequence (opt1) from SORV(SORV-252)__GU018050.2__N
  source 1..708: mol_type = other RNA
atgggcgacctggtgttctacgacgtcgccagcaccggggccaacggcttcgaccccgacgcggggttcgtggccttcatggccgaccacggcgagtccatcagcctctccgccgtgcgcatcttcttcctgaacgccgcgaaggccaaggccgccctggcgcggaagccggagcgcaaggccaaccccaagttcggggagtggcaggtcgagatcgtgaacaaccacttccccggcaaccggaacaaccccatcggcaacaacgacctcaccatccaccgcctgagcgggtacctggcccggtgggtgctcgagcacttcacggaggacgaggacgagtcccagcgcgagctgatccggagcaccatcatcaacccgatcgccgagtccaacggcatccgctggaacaacgggcccgagatctacctgagcttcttccccggcaccgagatgttcctcgaggccttcaagttctaccccctgaccatcgggatctaccgggtcaagcacggcctgatggacccgcagtacctcaagaaggcgctgcgccagcggtacggcacgctgaccgccgagaagtggatggcccagaagaccgtgctcatcgccaagtccctgaaggacgtggagcagctgaagtgggggcgcggcgggctcagcgacgccgcgcggaccttcctgatcaagttcggcgtcaagctgccctga

SEQ ID NO: 6823 - RNA, 708 nt, synthetic construct
  misc_feature 1..708: note = derived and/or modified CDS sequence (opt1) from SORV(NJO 94F)__U47141.1__N
  source 1..708: mol_type = other RNA
atgggcgacctggtgttctacgacgtcgccagcaccggggccaacggcttcgaccccgacgcggggttcgtggccttcatggccgaccacggcgagtccatcaacctcagcgccgtgcgcatcttcttcctgaacgccgcgaaggccaaggccgccctggcgcggaagccggagcgcaaggccaaccccaagttcggggagtggcaggtcgagatcgtgaacaaccacttccccggcaaccggaacaaccccatcggcaacaacgacctcaccatccaccgcctgtccgggtacctggcccggtgggtgctcgagcacttcacggaggacgaggacgagagccagcgcgagctgatccggtccaccatcatcaacccgatcgccgagagcaacggcatccactggaacaacgggcccgagatctacctgtccttcttccccggcaccgagatgttcctcgaggccttcaagttctaccccctgaccatcgggatctaccgcgtcaagcacggcatgatggacccgcagtacctgaagaaggcgctccggcagcgctacggcacgctgaccgccgagaagtggatggcccagaagaccgtgctgatcgccaagagcctcaaggacgtggagcagctgaagtgggggcggggcgggctgtccgacgccgcgcgcaccttcctcatcaagttcggcgtcaagctgccctga

SEQ ID NO: 6824 - RNA, 708 nt, synthetic construct
  misc_feature 1..708: note = derived and/or modified CDS sequence (opt1) from SORV(NJO-94F)__KX817338.1__N
  source 1..708: mol_type = other RNA
atgggcgacctggtgttctacgacgtcgccagcaccggggccaacggcttcgaccccgacgcggggttcgtggccttcatggccgaccacggcgagtccatcaacctcagcgccgtgcgcatcttcttcctgaacgccgcgaaggccaaggccgccctggcgcggaagccggagcgcaaggccaaccccaagttcggggagtggcaggtcgagatcgtgaacaaccacttccccggcaaccggaacaaccccatcggcaacaacgacctcaccatccaccgcctgtccgggtacctggcccggtgggtgctcgagcacttcacggaggacgaggacgagagccagcgcgagctgatccggtccaccatcatcaacccgatcgccgagagcaacggcatccactggaacaacgggcccgagatctacctgtccttcttccccggcaccgagatgttcctcgaggccttcaagttctaccccctgaccatcgggatctaccgcgtcaagcacggcctgatggacccgcagtacctcaagaaggcgctgcggcagcgctacggcacgctgaccgccgagaagtggatggcccagaagaccgtgctcatcgccaagagcctgaaggacgtggagcagctgaagtgggggcggggcgggctctccgacgccgcgcgcaccttcctgatcaagttcggcgtcaagctgccctga

SEQ ID NO: 6825 - RNA, 708 nt, synthetic construct
  misc_feature 1..708: note = derived and/or modified CDS sequence (opt1) from TAHV__Z68497.1__N
  source 1..708: mol_type = other RNA
atgagcgacctggtgttctacgacgtcgcctccaccggcgccaacgggttcgaccccgacgcgggctacgtggacttctgcatcaagcacggggaggccatcaacctccacagcgtgcgcatcttcttcctgaacgccgccaaggccaaggcggccctggcccggaagccggagcgcaaggcctcccccaagttcggcgagtggcaggtcgaggtggtgaactaccacttccccgggaaccggaacaaccccatcgacaacaacgacctcaccatccaccgcctgtacggctacctggcgcggtgggtcctcgagcagttcaaggagaacgaggacgccgcccagcgcgagctgatcaagacgaccgtgatcaacccgatcgccgagagcaacggcatccggtgggacaacggggccgagatctacctggcgttcttccccggcaccgagatgttcctcgagaccttcaacttctaccccctgacgatcgggatctaccgcgtgaagcagggcatgatggacccccagtacctgaagaaggccctccggcagcgctacgggtccctgaccgccgacaagtggatgagccagaagaccaccgccatcgccaagtccctgaaggacgtcgagcagctcaagtggggccggggcgggctgagcgacacggcgcgcaccttcctgcagaagttcggcatccggctcccgtga

SEQ ID NO: 6826 - RNA, 708 nt, synthetic construct
  misc_feature 1..708: note = derived and/or modified CDS sequence (opt1) from TAHV(22595-6)__HM036217.1__N
  source 1..708: mol_type = other RNA
atgagcgacctggtgttctacgacgtcgcctccaccggcgccaacgggttcgaccccgacgcgggctacgtggacttctgcatcaagcacggggaggccatcaacctccacagcgtgcgcatcttcttcctgaacgccgccaaggccaaggcggccctggcccggaagccggagcgcaaggcctcccccaagttcggcgagtggcaggtcgaggtggtgaacaaccacttccccgggaaccggaacaaccccatcgacaacaacgacctcaccatccaccgcctgagcggctacctggcgcggtgggtcctcgagcagttcaaggagaacgaggacgccgcccagcgcgagctgatcaagacgaccgtgatcaacccgatcgccgagtccaacggcatccggtgggacaacggggccgagatctacctggcgttcttccccggcaccgagatgttcctcgagaccttcaacttctaccccctgacgatcgggatctaccgcgtgaagcagggcatgatggacccccagtacctgaagaaggccctccggcagcgctacgggagcctgaccgccgacaagtggatgtcccagaagaccaccgccatcgccaagagcctgaaggacgtcgagcagctcaagtggggccggggcgggctgtccgacacggcgcgcaccttcctgcagaagttcggcatccggctcccgtga

SEQ ID NO: 6827 - RNA, 708 nt, synthetic construct
  misc_feature 1..708: note = derived and/or modified CDS sequence (opt1) from TAHV(NM08003)__HQ541823.1__N
  source 1..708: mol_type = other RNA
atgagcgacctggtgttctacgacgtcgcctccaccggcgccaacgggttcgaccccgacgcgggctacgtggacttctgcatcaagcacggggaggccatcaacctccacagcgtgcgcatcttcttcctgaacgccgccaaggccaaggcggccctggcccggaagccggagcgcaaggcctcccccaagttcggcgagtggcaggtcgaggtggtgaacaaccacttccccgggaaccggaacaaccccatcgacaacaacgacctcaccatccaccgcctgagcggctacctggcgcggtgggtcctcgagcagttcaaggagaacgacgacgccgcccagcgcgagctgatcaagacgaccgtgatcaacccgatcgccgagtccaacggcatccggtgggacaacggggccgagatctacctggcgttcttccccggcaccgagatgttcctcgagaccttcaacttctaccccctgacgatcgggatctaccgcgtgaagcagggcatgatggacccccagtacctgaagaaggccctccggcagcgctacgggagcctgaccgccgacaagtggatgtcccagaagaccaccgccatcgccaagagcctgaaggacgtcgagcagctcaagtggggccggggcgggctgtccgacacggcgcgcaccttcctgcagaagttcggcatccggctcccgtga

SEQ ID NO: 6828 - RNA, 708 nt, synthetic construct
  misc_feature 1..708: note = derived and/or modified CDS sequence (opt1) from TAHV(XJ0625)__EU622820.2__N
  source 1..708: mol_type = other RNA
atgagcgacctggtgttctacgacgtcgcctccaccggcgccaacgggttcgaccccgacgcgggctacgtggacttctgcgtgaagtacggggaggccatcaacctccacagcgtccgcatcttcttcctgaacgccgccaaggccaaggcggccctggcccggaagccggagcgcaaggcctcccccaagttcggcgagtggcaggtcgaggtggtgaacaaccacttccccgggaaccggaacaaccccatcgacaacaacgacctcaccatccaccgcctgagcggctacctggcgcggtgggtgctcgagcagttcaaggagaacgaggacgccgcccagcgcgagctgatcaagacgaccgtgatcaacccgatcgccgagtccaacggcatccggtgggacaacggggccgagatctacctggcgttcttccccggcaccgagatgttcctcgagaccttcaacttctaccccctgacgatcgggatctaccgcgtcaagcagggcatgatggacccccagtacctgaagaaggccctccggcagcgctacgggccgctgaccgccgacaagtggatgagccagaagaccgtggccatcgccaagtccctgaaggacgtggagcagctcaagtggggccggggcgggctgagcgacaccgcgcgcacgttcctgcagaagttcggcatccggctcccctga

SEQ ID NO: 6829 - RNA, 708 nt, synthetic construct
  misc_feature 1..708: note = derived and/or modified CDS sequence (opt1) from TAHV(XJ0708)__HM243139.1__N
  source 1..708: mol_type = other RNA
atgagcgacctggtgttctacgacgtcgcctccaccggcgccaacgggttcgaccccgacgcgggctacgtggacttctgcgccaagtacggggaggccatcaacctccacagcgtgcgcatcttcttcctgaacgccgccaaggcgaaggccgccctggcccggaagccggagcgcaaggcgtcccccaagttcggcgagtggcaggtcgaggtggtgaacaaccacttccccgggaaccggaacaaccccatcgacaacaacgacctcaccatccaccgcctgagcggctacctggcccggtgggtcctcgagcagttcaaggagaacgaggacgccgcccagcgcgagctgatcaagacgaccgtgatcaacccgatcgccgagtccaacggcatccggtgggacaacggggcggagatctacctggccttcttccccggcaccgagatgttcctcgagaccttcaacttctaccccctgacgatcgggatctaccgcgtgaagcagggcatgatggacccccagtacctgaagaaggccctccggcagcgctacgggccgctgaccgccgacaagtggatgagccagaagaccgtcgccatcgcgaagtccctgaaggacgtggagcagctcaagtggggccggggcgggctgagcgacaccgcccgcacgttcctgcagaagttcggcatccggctcccctga

SEQ ID NO: 6830 - RNA, 708 nt, synthetic construct
  misc_feature 1..708: note = derived and/or modified CDS sequence (opt1) from TVTV(AR42)__KX891323.1__N
  source 1..708: mol_type = other RNA
atgagcgagctggtgttctacgacgccccctccaccggcgccaacgggttcgacccggacgcgggctacgtcgccttcatcgccgcccacgccgggagctacgacctctccgcggtgcgcatcttcttcctgaacgccgccaaggccaagaacgcgctgagccggaagcccgagggcaaggtgtccatcaagttcggggagtggagcgtcgaggtggtgaacaaccacttccccggcaaccgcaacaaccccatcggcaacaacgacctcaccatccaccggatctccgggtacctggcccgctgggtcctggaggagttcaagggccaggacgacgaggcccagaaggacatcatccggagcacgatcgtgaacccgatcgccgagtccaacgggatccactgggacagcggcgccgacgcgtacctctccttcttccccgggaccgagatgttcctggagagcttcgacttcctgcccctcgccatcggcatctaccgcgtgaagaacggcatgatggacgtccagtacctgaagaaggccctgcggcagcgctacgggaccatgaccgccgacaagtggatgtccacgaagaccaccgtgatcgccaagaccctcaagcgggtggagagcttcaagtggggcaagggcgggctgtccgaggcggcccgcgccttcctgagcaagttcaacgtcaagatcccctga

SEQ ID NO: 6831 - RNA, 708 nt, synthetic construct
  misc_feature 1..708: note = derived and/or modified CDS sequence (opt1) from TVTV(ND3374)__KM215564.1__N
  source 1..708: mol_type = other RNA
atgagcgagctggtgttctacgacgccccctccaccggcgccaacgggttcgacccggacgcgggctacgtcgccttcatcgccgcccacgccgggagctacgacctctccgcggtgcgcatcttcttcctgaacgccgccaaggccaagaacgcgctgagccggcgccccgagggcaaggtgtccatcaagttcggggagtggagcgtcgaggtggtgaacaaccacttccccggcaaccggaacaaccccatcggcaacaacgacctcaccatccaccgcatctccgggtacctggcccggtgggtcctggaggagttcaagggccaggacgacgaggcccagaaggacatcatccgcagcacgatcgtgaacccgatcgccgagtccaacgggatccactgggacagcggcgccgacgcgtacctctccttcttccccgggaccgagatgttcctggagagcttcgacttcctgcccctcgccatcggcatctaccgggtgaagaacggcatgatggacgtccagtacctgaagaaggccctgcgccagcggtacgggaccatgaccgccgacaagtggatgtccacgaagaccaccgtgatcgccaagaccctcaagcgcgtggagagcttcaagtggggcaagggcgggctgtccgaggcggcccgggccttcctgagcaagttcaacgtcaagatcccctga

SEQ ID NO: 6832 - RNA, 708 nt, synthetic construct
  misc_feature 1..708: note = derived and/or modified CDS sequence (opt1) from JCV(3324-04)__HM007356.1__N
  source 1..708: mol_type = other RNA
atgggcgacctggtgttctacgacgtcgccagcaccggggccaacggcttcgaccccgacgcggggttcgtggccttcatggccgaccacggcgagtccgtgagcctctccgccgtccgcatcttcttcctgaacgccgcgaaggccaaggccgccctggcgcggaagccggagcgcaaggccacccccaagttcggggagtggcaggtcgagatcgtgaacaaccacttccccggcaaccggaacaaccccatcggcaacaacgacctcacgatccaccgcctgagcgggtacctggcccggtgggtgctcgagcacttcaccaccgacgacgacgagtcccagcgcgagctgatccggagcaccatcatcaacccgatcgccgagtccaacggcatccactggaacaacgggcccgagatctacctgagcttcttccccggcacggagatgttcctcgagatcttcaagttctaccccctgaccatcgggatctaccgcgtgaagcacggcatgatggacccgcagtacctgaagaaggccctccggcagcgctacggcaccctgaccgcggagaagtggatggcccagaagacggtgctgatcgccaagtccctcaaggacgtcgagcagctgaagtgggggcggggcgggctgagcgacgccgcccgcaccttcctcatcaagttcggcgtgaagctgccctga

SEQ ID NO: 6833 - RNA, 708 nt, synthetic construct
  misc_feature 1..708: note = derived and/or modified CDS sequence (opt1) from JCV(61v2235)__U12796.1__N
  source 1..708: mol_type = other RNA
atgggcgacctggtgttctacgacgtcgccagcaccggggccaacggcttcgaccccgacgcggggttcgtggccttcatggccgaccacggcgagtccatcaacctcagcgccgtgcgcatcttcttcctgaacgccgcgaaggccaaggccgccctggcgcggaagccggagcgcaaggccacccccaagttcggggagtggcaggtcgagatcgtgaacaaccacttctccggcaaccggaacaaccccatcggcaacaacgacctcacgatccaccgcctgagcgggtacctggcccggtgggtgctcgagcacttcaactccgacgacgacgagagccagcgcgagctgatccggtccaccatcatcaaccccatcgccgagagcaacggcatccactggaacaacgggccggagatctacctgtccttcttccccggcaccgagatgttcctcgagatcttcaagttctaccccctgaccatcgggatctaccgcgtcaagcacggcatgatggacccccagtacctgaagaaggccctccggcagcgctacggcacgctgaccgcggagaagtggatggcccagaagaccgtgctgatcgccaagagcctcaaggacgtggagcagctgaagtgggggcggggcgggctgtccgacgccgcccgcaccttcctcatcaagttcggcgtcaagctgccgtga

SEQ ID NO: 6834 - RNA, 708 nt, synthetic construct
  misc_feature 1..708: note = derived and/or modified CDS sequence (opt1) from JCV(1064-03)__EF681816.1__N
  source 1..708: mol_type = other RNA
atgggcgacctggtgttctacgacgtcgccagcaccggggccaacggcttcgaccccgacgcggggttcgtggccttcatggccgaccacggcgaggccatcaacctcgccgcggtgcgcatcttcttcctgaacgccgccaaggccaaggcggccctggcccggaagccggagcgcaaggccacccccaagttcggggagtggcaggtcgagatcgtgaacaaccacttccccggcaaccggaacaaccccatcggcaacaacgacctcacgatccaccgcctgtccgggtacctggcccggtgggtgctcgagcacttcaccgaggacgacgacgagagccagcgcgagctgatccggtccaccatcatcaacccgatcgcggagagcaacggcatccactggaacaacgggcccgagatctacctgtccttcttccccggcaccgagatgttcctcgaggtcttcaagttctaccccctgacgatcgggatctaccgcgtgaagcacggcatgatggacccgcagtacctgaagaaggccctccggcagcgctacggcaccctgaccgccgagaagtggatggcccagaagaccgtgctgatcgccaagagcctcaaggacgtcgagcagctgaagtgggggcggggcgggctgtccgacgcggcccgcacgttcctcatcaagttcggcgtgaagctgccctga

SEQ ID NO: 6835 - RNA, 708 nt, synthetic construct
  misc_feature 1..708: note = derived and/or modified CDS sequence (opt1) from JCV(33909)__EF681853.1__N
  source 1..708: mol_type = other RNA
atgggcgacctggtgttctacgacgtcgccagcaccggggccaacggcttcgaccccgacgcggggttcgtggccttcatggccgaccacggcgaggtgatcaacctcgccgccgtccgcatcttcttcctgaacgcggccaaggccaaggccgcgctggcccggaagccggagcgcaaggccacccccaagttcggggagtggcaggtcgagatcgtgaacaaccacttccccggcaaccggaacaaccccatcggcaacaacgacctcacgatccaccgcctgtccgggtacctggcccggtgggtgctcgagcacttcaccgaggacgacgacgagagccagcgcgagctgatccggtccaccatcatcaacccgatcgccgagagcaacggcatccactggaacaacgggcccgagatctacctgtccttcttccccggcaccgagatgttcctcgaggtgttcaagttctaccccctgacgatcgggatctaccgcgtgaagcacggcatgatggacccgcagtacctgaagaaggcgctccggcagcgctacggcaccctgaccgccgagaagtggatggcccagaagaccgtcctgatcgccaagagcctcaaggacgtggagcagctgaagtgggggcggggcgggctgtccgacgccgcgcgcacgttcctcatcaagttcggcgtgaagctgccctga

SEQ ID NO: 6836 - RNA, 708 nt, synthetic construct
  misc_feature 1..708: note = derived and/or modified CDS sequence (opt1) from JCV(2179-00)__EF681808.1__N
  source 1..708: mol_type = other RNA
atgggcgacctggtgttctacgacgtcgccagcaccggggccaacggcttcgaccccgacgcggggttcgtggccttcatggccgaccacggcgagtccgtgagcctctccgccgtccgcatcttcttcctgaacgccgcgaaggccaaggccgccctggcgcggaagccggagcgcaaggccacccccaagttcggggagtggcaggtcgagatcgtgaacaaccacttccccggcaaccggaacaaccccatcggcaacaacgacctcacgatccaccgcctgagcgggtacctggcccggtgggtgctcgagcacttcaccaccgacgacgacgagtcccagcgcgagctgatccggagcaccatcatcaacccgatcgccgagtccaacggcatccactggaacaacgggcccgagatctacctgagcttcttccccggcacggagatgttcctcgagatcttcaagttctaccccctgaccatcgggatctaccgcgtgaagcacggcatgatggacccgcagtacctgaagaaggccctccggcagcgctacggcatcctgaccgcggagaagtggatggcccagaagaccgtgctgatcgccaagtccctcaaggacgtcgagcagctgaagtgggggcggggcgggctgagcgacgccgcccgcacgttcctcatcaagttcggcgtgaagctgccctga

SEQ ID NO: 6837 - RNA, 708 nt, synthetic construct
  misc_feature 1..708: note = derived and/or modified CDS sequence (opt1) from JCV(2989-06)__EF681849.1__N
  source 1..708: mol_type = other RNA
atgggcgacctgatcttctacgacgtggccagcaccggggccaacggcttcgaccccgacgcggggttcgtcgccttcatggccgaccacggcgagtccgtgagcctctccgccgtgcgcatcttcttcctgaacgccgcgaaggccaaggccgccctggcgcggaagccggagcgcaaggccacccccaagttcggggagtggcaggtcgagatcgtgaacaaccacttccccggcaaccggaacaaccccatcggcaacaacgacctcacgatccaccgcctgagcgggtacctggcccggtgggtgctcgagcacttcaccaccgacgacgacgagtcccagcgcgagctgatccggagcaccatcatcaacccgatcgccgagtccaacggcatccactggaacaacgggcccgagatctacctgagcttcttccccggcacggagatgttcctcgagatcttcaagttctaccccctgaccatcgggatctaccgcgtcaagcacggcatgatggacccgcagtacctgaagaaggccctccggcagcgctacggcaccctgaccgcggagaagtggatggcccagaagacggtgctgatcgccaagtccctcaaggacgtggagcagctgaagtgggggcggggcgggctgagcgacgccgcccgcaccttcctcatcaagttcggcgtcaagctgccctga

SEQ ID NO: 6838 - RNA, 708 nt, synthetic construct
  misc_feature 1..708: note = derived and/or modified CDS sequence (opt1) from JCV(5592-02)__EF681804.1__N
  source 1..708: mol_type = other RNA
atgggcgacctggtgttctacgacgtcgccagcaccggggccaacggcttcgaccccgacgcggggttcgtggccttcatggccgaccacggcgagtccgtgagcctctccgccgtccgcatcttcttcctgaacgccgcgaaggccaaggccgccctggcgcggaagccggagcgcaaggccacccccaagttcggggagtggcaggtcgagatcgtgaacaaccacttccccggcaaccggaacagccccatcggcaacaacgacctcacgatccaccgcctgtccgggtacctggcccggtgggtgctcgagcacttcaccaccgacgacgacgagagccagcgcgagctgatccggtccaccatcatcaacccgatcgccgagagcaacggcatccactggaacaacgggcccgagatctacctgtccttcttccccggcacggagatgttcctcgagatcttcaagttctaccccctgaccatcgggatctaccgcgtgaagcacggcatgatggacccgcagtacctgaagaaggccctccggcagcgctacggcaccctgaccgcggagaagtggatggcccagaagacggtgctgatcgccaagagcctcaaggacgtcgagcagctgaagtgggggcggggcgggctgtccgacgccgcccgcaccttcctcatcaagttcggcgtgaagctgccctga

SEQ ID NO: 6839 - RNA, 708 nt, synthetic construct
  misc_feature 1..708: note = derived and/or modified CDS sequence (opt1) from JCV(F5609)__KM215546.1__N
  source 1..708: mol_type = other RNA
atgggcgacctggtgttctacgacgtcgccagcaccggggccaacggcttcgaccccgacgcggggttcgtggccttcatggccgaccacggcgagtccgtgagcctctccgccgtccgcatcttcttcctgaacgccgcgaaggccaaggccgccctggcgcggaagccggagcgcaaggccacccccaagttcggggagtggcaggtcgagatcgtgaacaaccacttccccggcaaccggaacaaccccatcggcaacaacgacctcacgatccaccgcctgagcgggtacctggcccggtgggtgctcgagcacttcaccaccgacgacgacgagtcccagcgcgagctgatccggagcaccatcatcaacccgatcgccgagtccaacggcatccactggaacaacgggcccgagatctacctgagcttcttccccggcacggagatgttcctcgagatcttcaagttctaccccctgaccatcgggatctaccgcgtgaagcacggcatgatggacccgcagtacctgaagaaggccctccggcagcgctacggcaccctgaccgcggagaagtggatggcccagaagacggtgctgatcgccaagtccctcaaggacgtcgagcagctgaagtgggggcggggcgggctgagcgacgccgcccgcaccttcctcaccaagttcggcgtgaagctgccctga

SEQ ID NO: 6840 - RNA, 708 nt, synthetic construct
  misc_feature 1..708: note = derived and/or modified CDS sequence (opt1) from JCV(F6577)__KM215557.1__N
  source 1..708: mol_type = other RNA
atgggcgacctggtgttctacgacgtcgccagcaccggggccaacggcttcgaccccgacgcggggttcgtggccttcatggccgaccacggcgagtccgtgagcctctccgccgtccgcatcttcttcctgaacgccgcgaaggccaaggccgccctgagccggaagccggagcgcaaggcgacccccaagttcggggagtggcaggtcgagatcgtgaacaaccacttccccggcaaccggaacaaccccatcggcaacaacgacctcacgatccaccgcctgtccgggtacctggcccggtgggtgctcgagcacttcaccaccgacgacgacgagagccagcgcgagctgatccggtccaccatcatcaacccgatcgccgagagcaacggcatccactggaacaacgggcccgagatctacctgtccttcttccccggcacggagatgttcctcgagatcttcaagttctaccccctgaccatcgggatctaccgcgtgaagcacggcatgatggacccgcagtacctgaagaaggccctccggcagcgctacggcaccctgaccgccgagaagtggatggcgcagaagacggtgctgatcgccaagagcctcaaggacgtcgagcagctgaagtgggggcggggcgggctgtccgacgccgcccgcaccttcctcatcaagttcggcgtgaagctgccctga

SEQ ID NO: 6841 - RNA, 708 nt, synthetic construct
  misc_feature 1..708: note = derived and/or modified CDS sequence (opt1) from JCV(W13135)__KM215552.1__N
  source 1..708: mol_type = other RNA
atgggcgacctggtgttctacgacgtcgccagcaccggggccaacggcttcgaccccgacgcggggttcgtggccttcatggccgaccacggcgagtccgtgaacctcagcgccgtccgcatcttcttcctgaacgccgcgaaggccaaggccgccctggcgcggaagccggagcgcaaggccacccccaagttcggggagtggcaggtcgagatcgtgaacaaccacttccccggcaaccggaacaaccccatcggcaacaacgacctcacgatccaccgcctgtccgggtacctggcccggtgggtgctcgagcacttcaccaccgacgacgacgagagccagcgcgagctgatccggtccaccatcatcaacccgatcgccgagagcaacggcatccactggaacaacgggcccgagatctacctgtccttcttccccggcacggagatgttcctcgagatcttcaagttctaccccctgaccatcgggatctaccgcgtgaagcacggcatgatggacccgcagtacctgaagaaggccctccggcagcgctacggcaccctgaccgcggagaagtggatggcccagaagacggtgctgatcgccaagagcctcaaggacgtcgagcagctgaagtgggggcggggcgggctgtccgacgccgcccgcaccttcctcatcaagttcggcgtgaagctgccctga

SEQ ID NO: 6842 - RNA, 708 nt, synthetic construct
  misc_feature 1..708: note = derived and/or modified CDS sequence (opt1) from JCV(W18393)__KM215559.1__N
  source 1..708: mol_type = other RNA
atgggcgacctggtgttctacgacgtcgccagcaccggggccaacggcttcgaccccgacgcggggttcgtggccttcatggccgaccacggcgagtccatcaacctcagcgccgtgcgcatcttcttcctgaacgccgcgaaggccaaggccgccctggcgcggaagccggagcgcaaggccacccccaagttcggggagtggcaggtcgagatcatcaacaaccacttccccggcaaccggaacaaccccatcggcaacaacgacctcacgatccaccgcctgtccgggtacctggcccggtgggtgctcgagcacttcaccgccgacgacgacgagagccagcgcgagctgatccggtccaccatcatcaacccgatcgccgagagcaacggcatccactggaacaacgggcccgagatctacctgtccttcttccccggcaccgagatgttcctcgagatcttcaagttctaccccctgacgatcgggatctaccgcgtgaagcacggcatgatggacccgcagtacctgaagaaggcgctccggcagcgctacggcaccctgaccgccgagaagtggatggcccagaagaccgtcctgatcgccaagagcctcaaggacgtggagcagctgaagtgggggcggggcgggctgtccgacgccgcgcgcacgttcctcatcaagttcggcgtgaagctgccctga

SEQ ID NO: 6843 - RNA, 708 nt, synthetic construct
  misc_feature 1..708: note = derived and/or modified CDS sequence (opt1) from KEYV(KEYV/Ochlerotatus atlanticus/USA/KEYVLK01/2005)__KT630290.1__N
  source 1..708: mol_type = other RNA
atgggcgacctggtgttctacgacgtcgccagcaccggggccaacggcttcgaccccgacgcggggtacgtggccttcatggccaaccacggcgagtccatcagcctctccaccgtgcgcatcttcttcctgaacgccgccaaggcgaaggccgccctgacgcggaagccggagcgcaaggccacccccaagttcggggagtggcaggtcgagatcgtgaacaaccacttccccggcaaccggaacaaccccatcggcaacaacgacctcaccctgcaccgcatcagcgggtacctggcgcggtgggtgctcgagcacttcggcgagggggaggacgagtcccagaaggagctgatcaagagcaccgtcatcaacccgatcgccgagtccaacggcatccgctgggggaacggcgtggagatctacctgagcttcttccccggcacggagatgttcctcgagctgttcaagttctaccccctgaccatcgggatctaccgggtgaagcacggcatgatggacgcccagtacctcaagaaggccctgcgccagcggtacgggaccctgaccgccgacaagtggatggcgcagaagacgtccatgatcaccaagagcctcaaggacgtcgagcagctgaagtggggcaagggcgggctgtccgacaccgcccgcgccttcctcgccaagttcggcgtgcggctgccctga

SEQ ID NO: 6844 - RNA, 708 nt, synthetic construct
  misc_feature 1..708: note = derived and/or modified CDS sequence (opt1) from KEYV(KEYV/Ochlerotatus atlanticus/USA/KEYVLK02/2005)__KT630293.1__N
  source 1..708: mol_type = other RNA
atgggcgacctggtgttctacgacgtcgccagcaccggggccaacggcttcgaccccgacgcggggtacgtggccttcatggccaaccacggcgagtccatcagcctctccaccgtgcgcatcttcttcctgaacgccgccaaggcgaaggccgccctgacgcgcaagagcgagcggaaggccaccccgaagttcggggagtggcaggtcgagatcgtgaacaaccacttccccggcaaccggaacaaccccatcggcaacaacgacctcaccctgcaccgcatctccgggtacctggcgcggtgggtgctcgagcacttcggcgagggggaggacgagagccagaaggagctgatcaagtccaccgtcatcaaccccatcgccgagagcaacggcatccgctgggggaacggcgtggagatctacctgtccttcttcccgggcacggagatgttcctcgagctgttcaagttctaccccctgaccatcgggatctaccgggtgaagcacggcatgatggacgcccagtacctcaagaaggccctgcgccagcggtacgggaccctgaccgccgacaagtggatggcgcagaagacgagcatgatcaccaagtccctcaaggacgtcgagcagctgaagtggggcaagggcgggctgagcgacaccgcccgcgccttcctcgccaagttcggcgtgcggctgccctga

SEQ ID NO: 6845 - RNA, 708 nt, synthetic construct; identical to SEQ ID NO: 6843
  misc_feature 1..708: note = derived and/or modified CDS sequence (opt1) from KEYV(C14031-33)__U12801.1__N
  source 1..708: mol_type = other RNA

SEQ ID NO: 6846 - RNA, 708 nt, synthetic construct
  misc_feature 1..708: note = derived and/or modified CDS sequence (opt1) from LACV(Human/78)__NC_004110.1__N
  source 1..708: mol_type = other RNA
atgagcgacctggtgttctacgacgtcgcctccaccggcgccaacgggttcgaccccgacgcgggctacatggacttctgcgtgaagaacgccgagctcctgaacctggccgccgtgcgcatcttcttcctcaacgccgcgaaggccaaggccgccctgagccggaagccggagcgcaaggcgaaccccaagttcggggagtggcaggtcgaggtgatcaacaaccacttccccggcaaccggaacaaccccatcgggaacaacgacctgaccatccaccgcctctccggctacctggcccggtgggtgctggaccagtacaacgagaacgacgacgagagccagcacgagctcatccgcacgaccatcatcaacccgatcgccgagtccaacggcgtcgggtgggacagcggccccgagatctacctgtccttcttccccgggaccgagatgttcctggagaccttcaagttctaccccctcacgatcggcatccaccgggtgaagcaggggatgatggacccgcagtacctgaagaaggccctgcgccagcggtacggcaccctcaccgccgacaagtggatgagccagaaggtggcggccatcgccaagtccctgaaggacgtcgagcagctgaagtggggcaagggcgggctcagcgacaccgccaagacgttcctgcagaagttcgggatccgcctgccctga

SEQ ID NO: 6847 - RNA, 708 nt, synthetic construct
  misc_feature 1..708: note = derived and/or modified CDS sequence (opt1) from LACV__KP271107.1__N
  source 1..708: mol_type = other RNA
atgagcgacctggtgttctacgacgtcgcctccaccggcgccaacgggttcgaccccgacaccggctacatggacttctgcgtgaagaacgcggagagcctcaacctggccgccgtgcgcatcttcttcctgaacgccgccaaggcgaaggccgccctctcccggaagccggagcgcaaggccaaccccaagttcggggagtggcaggtcgaggtgatcaacaaccacttccccggcaaccggaacaaccccatcgggaacaacgacctgacgatccaccgcctgagcggctacctcgcgcggtgggtgctggaccagtacaacgagaacgacgacgagtcccagcacgagctgatccgcaccaccatcatcaacccgatcgccgagagcaacggcgtcgggtgggactccggccccgagatctacctcagcttcttccccgggaccgagatgttcctggagacgttcaagttctaccccctgaccatcggcatccaccgggtgaagcaggggatgatggacccgcagtacctcaagaaggccctgcgccagcggtacggcaccctgaccgccgacaagtggatgtcccagaaggtggccgcgatcgccaagagcctcaaggacgtcgagcagctgaagtggggcaagggcgggctgtccgacacggccaagaccttcctccagaagttcgggatccgcctgccctga

SEQ ID NO: 6848 - RNA, 708 nt, synthetic construct
  misc_feature 1..708: note = derived and/or modified CDS sequence (opt1) from LACV(BEN2_Lafayette_WI_2007)__GU596386.1__N
  source 1..708: mol_type = other RNA
atgagcgacctggtgttctacgacgtcgcctccaccggcgccaacgggttcgaccccgacgcgggctacatggacttctgcgtgaagaacgccgagagcctcaacctggccgccgtgcgcatcttcttcctgaacgccgcgaaggccaaggccgccctctcccggaagccggagcgcaaggcgaaccccaagttcggggagtggcaggtcgaggtgatcaacaaccacttccccggcaaccggaacaaccccatcgggaacaacgacctgaccatccaccgcctgagcggctacctcgcccggtgggtgctggaccagtacaacgagaacgacgacgagtcccagcacgagctgatccgcacgaccatcatcaacccgatcgccgagagcaacggcgtcgggtgggactccggccccgagatctacctcagcttcttccccgggaccgagatgttcctggagaccttcaagttctaccccctgacgatcggcatccaccgggtgaagcaggggatgatggacccgcagtacctcaagaaggccctgcgccagcggtacggcaccctgaccgccgacaagtggatgtcccagaaggtggcggccatcgccaagagcctcaaggacgtcgagcagctgaagtggggcaagggcgggctgtccgacaccgccaagacgttcctccagaagttcgggatccgcctgccctga

SEQ ID NO: 6849 - RNA, 708 nt, synthetic construct
  misc_feature 1..708: note = derived and/or modified CDS sequence (opt1) from LACV(Dallas/TX/2009)__GU591164.1__N
  source 1..708: mol_type = other RNA
atgagcgacctggtgttctacgacgtcgcctccaccggcgccaacgggttcgaccccgacgcgggctacatggacttctgcgtgaagaacgccgagagcctcaacctggccgccgtgcgcatcttcttcctgaacgccgcgaaggccaaggccgccctctcccggaagccggagcgcaaggcgaaccccaagttcggggagtggcaggtcgaggtggtgaacaaccacttccccggcaaccggaacaaccccatcgggaacaacgacctgaccatccaccgcctgagcggctacctcgcccggtgggtcctggaccagtacaacgagaacgacgacgagtcccagcgcgagctgatccggacgaccatcatcaacccgatcgccgagagcaacggcgtgcgctgggactccgggcccgagatctacctcagcttcttccccggcaccgagatgttcctggagaccttcaagttctaccccctgacgatcgggatccaccgggtgaagcagggcatgatggacccgcagtacctcaagaaggccctgcgccagcggtacgggaccctgaccgccgacaagtggatgtcccagaaggtcgcggccatcgccaagagcctcaaggacgtggagcagctgaagtggggcaagggcgggctgtccgacaccgccaagacgttcctccagaagttcggcatccgcctgccctga

SEQ ID NO: 6850 - RNA, 708 nt, synthetic construct
  misc_feature 1..708: note = derived and/or modified CDS sequence (opt1) from LACV(Fort Bend County/TX/2009)__GU591167.1__N
  source 1..708: mol_type = other RNA
atgagcgacctggtgttctacgacgtcgcctccaccggcgccaacgggttcgaccccgacgcgggctacatggacttctgcgtgaagaacgccgagagcctcaacctggccgccgtgcgcatcttcttcctgaacgccgcgaaggccaaggccgccctctcccggaagccggagcgcaaggcgaaccccaagttcggggagtggcaggtcgaggtgatcaacaaccacttccccggcaaccggaacaaccccatcgggaacaacgacctgaccatccaccgcctgagcggctacctcgcccggtgggtgctggaccagtacaacgagaacgacgacgagtcccagcgcgagctgatccggacgaccatcatcaacccgatcgccgagagcaacggcgtccgctgggactccgggcccgagatctacctcagcttcttccccggcaccgagatgttcctggagaccttcaagttctaccccctgacgatcgggatccaccgggtgaagcagggcatgatggacccgcagtacctcaagaaggccctgcgccagcggtacgggaccctgaccgccgacaagtggatgtcccagaaggtggcggccatcgccaagagcctcaaggacgtcgagcagctgaagtggggcaagggcgggctgtccgacaccgccaagacgttcctccagaagttcggcatccgcctgccctga

SEQ ID NO: 6851 - RNA, 708 nt, synthetic construct
  misc_feature 1..708: note = derived and/or modified CDS sequence (opt1) from LACV(LACV/95/OH-H (CCH-MB96))__GU206135.1__N
  source 1..708: mol_type = other RNA
atgagcgacctggtgttctacgacgtcgcctccaccggcgccaacgggttcgaccccgacgcgggctacatggacttctgcgtgaagaacgccgagagcctcaacctggccgccgtgcgcatcttcttcctgaacgccgcgaaggccaaggccgccctctcccggaagccggagcgcaaggcgaaccccaagttcggggagtggcaggtcgaggtggtgaacaaccacttccccggcaaccggaacaaccccatcgggaacaacgacctgaccatccaccgcctgagcggctacctcgcccggtgggtcctggaccagtacaacgagaacgacgacgagtcccagcacgagctgatcaagacgaccatcatcaacccgatcgccgagagcaacggcgtggggtgggactccggccccgagatctacctcagcttcttccccgggaccgagatgttcctggagaccttcaagttctaccccctgacgatcggcatccaccgcgtgaagcaggggatgatggacccgcagtacctcaagaaggccctgcggcagcgctacggcaccctgaccgccgacaagtggatgtcccagaaggtcgcggccatcgccaagagcctcaaggacgtggagcagctgaagtggggcaagggcgggctgtccgacaccgccaagacgttcctccagaagttcgggatccggctgccctga

SEQ ID NO: 6852 - RNA, 696 nt, synthetic construct
  misc_feature 1..696: note = derived and/or modified CDS sequence (opt1) from OROV(BeAn19991)__NC_005777.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaaggtgctccgccagcggtacggccagaagaccgcggagcagtggatgcgcgaggagatcgtcgccgtgcgggccgccttcgaggccgtggggaccctggcgtgggcccgcaccggcttcagcccggccgcccgggacttcctgcgccagttcggcatcgacatctga

SEQ ID NO: 6853 - RNA, 696 nt, synthetic construct
  misc_feature 1..696: note = derived and/or modified CDS sequence (opt1) from OROV(AR136921)__HQ830443.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaaggtgctccgccagcggtacggccagaagaccgcggagcagtggatgcgcgaggagatcgtcgccgtgcgggccgccttcgaggccgtggggaccctggcgtgggcccgcaccggcttcagcccggccgcccgggacttcctgcgccagttcggcatcgggatctga

SEQ ID NO: 6854 - RNA, 696 nt, synthetic construct
  misc_feature 1..696: note = derived and/or modified CDS sequence (opt1) from OROV(AR366927)__HQ830448.1__N
  source 1..696: mol_type = other RNA
atgagcgagttcttcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaaggtgctccgccagaagtacggccagaagaccgcggagcagtggatgcgggaggagatcgtcgccgtgcgcgccgccttcgaggccgtggggaccctggcgtgggcccggaccggcttcagcccggccgcccgcgacttcctgcggcagttcggcatcgggatctga

SEQ ID NO: 6855 - RNA, 696 nt, synthetic construct
  misc_feature 1..696: note = derived and/or modified CDS sequence (opt1) from OROV(BeAn 206119)__AY993909.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccgcggtggtggtccccctggtggaggtgaagggctgcacctggaacgacggcgacgccatgtacctggggttcgccgccggcgccgagatgttcctccagaccttcaccttcttccccctggtcatcgagatgcaccgggtgctgaaggacgggatggacgtgaacttcatgaagaaggtcctccgccagcggtacggccagaagacggcggagcagtggatgcgcgaggagatcgtggccgtgcgggccgccttcgagaccgtcgggaccttcgcctgggcgcgcaccggcttcagcccggccgcccgggacttcctgcgccagttcggcatcgggatctga

SEQ ID NO: 6856 - RNA, 696 nt, synthetic construct
  misc_feature 1..696: note = derived and/or modified CDS sequence (opt1) from OROV(BeAn 208819)__AY993911.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggtggaggtgaagggctgcacctggaacgacggcgacgcgatgtacctggggttcgccgccggcgccgagatgttcctccagaccttcacgttcttccccctggtcatcgagatgcaccgggtgctgaaggacgggatggacgtgaacttcatgaagaaggtcctccgccagcggtacggccagaagaccgccgagcagtggatgcgcgaggagatcgtggcggtgcgggccgccttcgaggccgtcgggaccctggcctgggcgcgcaccggcttcagcccggccgcccgggacttcctgcgccagttcggcatcgggatctga

SEQ ID NO: 6857 - RNA, 696 nt, synthetic construct
  misc_feature 1..696: note = derived and/or modified CDS sequence (opt1) from OROV(BeAn 208823)__AY993912.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggtggaggtgaagggctgcacctggaacgacggcgacgcgatgtacctggggttcgccgccggcgccgagatgttcctccagaccttcacgttcttccccctggtcatcgagatgcaccgggtgctgaaggacgggatggacgtgaacttcatgaagaaggtcctccgccagcggtacggccagaagaccgccgagcgctggatgcgggaggagatcgtggcggtgcgcgccgccttcgaggccgtcgggaccctggcctgggcgcggaccggcttcagcccggccgcccgcgacttcctgcggcagttcggcatcgggatctga

SEQ ID NO: 6858 - RNA, 696 nt, synthetic construct
  misc_feature 1..696: note = derived and/or modified CDS sequence (opt1) from OROV(H244576)__HQ830444.1__N
  source 1..696: mol_type = other RNA
atgagcgagttcttcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccttccaccggctgagcgggtacctggcgcgctgggccttcacgcagatgcggtcccccatcaagcaggccgagttccgcgccaccgtggtggtccccctcgcggaggtgaagggctgcacctggaacgacggcgacgccatgtacctggggttcgccgccggcgccgagatgttcctgcagaccttcacgttcttccccctcgtgatcgagatgcaccgggtcctgaaggacgggatggacgtgaacttcatgaagaaggtgctgcgccagaagtacggccagaagaccgcggagcagtggatgcgggaggagatcgtcgccgtgcgcgccgccttcgaggccgtggggaccctcgcgtgggcccggaccggcttcagcccggccgcccgcgacttcctgcggcagttcggcatcgggatctga

SEQ ID NO: 6859 - RNA, 696 nt, synthetic construct
  misc_feature 1..696: note = derived and/or modified CDS sequence (opt1) from OROV(H355186)__HQ830446.1__N
  source 1..696: mol_type = other RNA
atgagcgagttcatcttctccgacgtgccccagcgcaccaccagcacgttcgacccggaggccgcctacgtcgcgttcgaggcccggtacggccaggtgctgaacgccggggtggtccgcgtgttcttcctcaaccagaagaaggccaaggacgtgctgcggaagacctcccgccccatggtcgacctgaccttcggcggggtgcagttcgccatggtgaacaaccacttcccccagttccagagcaaccccgtcccggacaacggcctcaccctgcaccggctgtccgggtacctcgcgcgctgggccttcacgcagatgcggagccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaaggtgctccgccagcggtacggccagaagaccgcggagcagtggatgcgcgaggagatcgtcgccgtgcgggccgccttcgaggccgtggggaccctggcgtgggcccgcaccggcttctccccggccgcccgggacttcctgcgccagttcggcatcgggatctga

SEQ ID NO: 6860 - RNA, 696 nt, synthetic construct
  misc_feature 1..696: note = derived and/or modified CDS sequence (opt1) from OROV(H356898)__HQ830447.1__N
  source 1..696: mol_type = other RNA
atgagcgagttcatcttcaacgacgtgccccagcgcaccacctccacgttcgacccggaggccgcctacgtcagcttcgaggcgcggtacggccaggtgctgaacgccggggtggtccgcgtgttcttcctcaaccagaagaaggccaaggacgtgctgcggaagacctcccgccccatggtcgacctgaccttcggcggggtgcagttcgccatggtgaacaaccacttcccccagttccagagcaaccccgtcccggacaacggcctcaccctgcaccggctgtccgggtacctcgcccgctgggcgttcacgcagatgcggagccccatcaagcaggccgagttccgcgccaccgtggtggtccccctggccgaggtgaagggctgcacctggaacgacggcgacgcgatgtacctggggttcgccgccggcgccgagatgttcctccagaccttcacgttcttccccctggtgatcgagatgcaccgggtcctgaaggacgggatggacgtgaacttcatgaagaaggtgctccgccagcggtacggccagaagaccgccgagcagtggatgcgcgaggagatcgtcgcggtgcgggccgccttcgaggccgtggggaccctggcctgggcgcgcaccggcttctccccggccgcccgggacttcctgcgccagttcggcatcgggatctga

SEQ ID NO: 6861 - RNA, 696 nt, synthetic construct
  misc_feature 1..696: note = derived and/or modified CDS sequence (opt1) from OROV(H389865)__HQ830453.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcacatgcggtcccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaagttcctccgccagcggtacggccagaagaccgcggagcagtggatgcgcgaggagatcctggccgtgaaggccgccttcgagagcgtcgggaccctggcctgggcgcggaccggcttctccccggccgcccgcgacttcctccggcagttcgccatcggcatctga

SEQ ID NO: 6862 - RNA, 696 nt, synthetic construct
  misc_feature 1..696: note = derived and/or modified CDS sequence (opt1) from OROV(H472433)__HQ830455.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttctccggcgtgcagttcgccatggtgaacaaccacttcccccagttccagagcaaccccgtcccggacaacgggctcaccctgcaccggctgtccggctacctcgcgcgctgggccttcacgcagatgcggagccccatcaagcaggccgagttccgcgccaccgtggtggtccccctggcggaggtgaaggggtgcacctggaacgacggcgacgccatgtacctgggcttcgccgccggggccgagatgttcctccagaccttcacgttcttccccctggtgatcgagatgcaccgggtcctgaaggacggcatggacgtgaacttcatgaagaaggtgctccgccagcggtacgggcagaagaccgcggagcagtggatgcgcgaggagatcgtcgccgtgcgggccgccttcgaggccgtgggcaccctggcgtgggcccgcaccgggttctccccggccgcccgggacttcctgcgccagttcggcatcggcatctga

SEQ ID NO: 6863 - RNA, 696 nt, synthetic construct
  misc_feature 1..696: note = derived and/or modified CDS sequence (opt1) from OROV(H532490)__HQ830463.1__N
  source 1..696: mol_type = other RNA
atgagcgagttcatcttcaacgacgtgccccagcgcaccacctccacgttcgacccggaggccgcctacgtcagcttcgaggcgcggtacggccaggtgctgaacgccggggtggtccgcgtgttcttcctcaaccagaagaaggccaaggacgtgctgcggaagacctccagccccatggtcgacctgaccttcggcggggtgcagttcgccatggtgaacaaccacttcccccagttccagtccaaccccgtcccggacaacggcctcaccctgcaccgcctgagcgggtacctcgcccggtgggcgttcacgcagatgcgctcccccatcaagcaggccgagttccgggccaccgtggtggtccccctggccgaggtgaagggctgcacctggaacgacggcgacgcgatgtacctggggttcgccgccggcgccgagatgttcctccagaccttcacgttcttccccctggtgatcgagatgcaccgcgtcctgaaggacgggatggacgtgaacttcatgaagaaggtgctccggcagcgctacggccagaagaccgccgagcagtggatgcgggaggagatcgtcgcggtgcgcgccgccttcgaggccgtggggaccctggcctgggcgcggaccggcttcagcccggccgcccgcgacttcctgcggcagttcggcatcgggatctga

SEQ ID NO: 6864 - RNA, 696 nt, synthetic construct
  misc_feature 1..696: note = derived and/or modified CDS sequence (opt1) from OROV(H543629)__HQ830467.1__N
  source 1..696: mol_type = other RNA
atgagcgagttcctgttcaacgacgtgccccagcgcaccacctccacgttcgacccggaggccgcctacgtcgcgttcgaggcccggtacggccaggtgctcaacgccggggtggtccgcgtgttcttcctgaaccagaagaaggccaaggacgtgctgcggaagaccagccgccccatggtcgacctcaccttcggcggggtgcagttcgccatggtgaacaaccacttcccccagttccagtccaaccccgtcccggacaacggcctgaccctgcaccggctcagcgggtacctggcgcgctgggccttcacgcagatgcggtcccccatcaagcaggccgagttccgcgccaccgtggtggtccccctggcggaggtgaagggctgcacctggaacgacggcgacgccatgtacctcgggttcgccgccggcgccgagatgttcctgcagaccttcacgttcttccccctggtgatcgagatgcaccgggtcctcaaggacgggatggacgtgaacttcatgaagaaggtgctgcgccagcggtacggccagaagaccgcggagcagtggatgcgcgaggagatcgtcgccgtgcgggccgccttcgaggccgtggggaccctggcgtgggcccgcaccggcttcagcccggccggccgggacttcctccgccagttcgggatcggcatctga

SEQ ID NO: 6865 - RNA, 696 nt, synthetic construct
  misc_feature 1..696: note = derived and/or modified CDS sequence (opt1) from OROV(H543638)__HQ830468.1__N
  source 1..696: mol_type = other RNA
atgagcgagttcctgttcaacgacgtgccccagcgcaccacctccacgttcgacccggaggccgcctacgtcgcgttcgaggcccggtacggccaggtgctcaacgccggggtggtccgcgtgttcttcctgaaccagaagaaggccaagaacgtgctgcggaagaccagccgccccatggtcgacctcaccttcggcggggtgcagttcgccatggtgaacaaccacttcccccagttccagtccaaccccgtcccggacaacggcctgaccctgcaccggctcagcgggtacctggcgcgctgggccttcacgcagatgcggtcccccatcaagcaggccgagttccgcgccaccgtggtggtccccctggcggaggtgaagggctgcacctggaacgacggcgacgccatgtacctcgggttcgccgccggcgccgagatgttcctgcagaccttcacgttcttccccctggtgatcgagatgcaccgggtcctcaaggacgggatggacgtgaacttcatgaagaaggtgctgcgccagcggtacggccagaagaccgcggagcagtggatgcgcgaggagatcgtcgccgtgcgggccgccttcgaggccgtggggaccctggcgtgggcccgcaccggcttcagcccggccggccgggacttcctccgccagttcgggatcggcatctga

SEQ ID NO: 6866 - RNA, 696 nt, synthetic construct
  misc_feature 1..696: note = derived and/or modified CDS sequence (opt1) from OROV(H706890)__HQ830473.1__N
  source 1..696: mol_type = other RNA
atggccgagttcatcttcaacgacgtgccccagcgcaccaccagcacgttcgacccggaggccgcgtacgtcgccttcgaggcccggtacggccaggtgctgaacgccggggtggtccgcgtgttcttcctcaaccagaagaaggccaaggacgtgctgcggaagacctcccgccccatggtcgacctgaccttcggcggggtgcagttcgcgatggtgaacaaccacttcccccagttccagagcaaccccgtcccggacaacggcctcaccctgcaccggctgtccgggtacctcgcccgctgggccttcacgcagatgcggagccccatcaagcaggccgagttccgcgcgaccgtggtggtccccctggccgaggtgaagggctgcacctggaacgacggcgacgccatgtacctggggttcgccgccggcgcggagatgttcctccagaccttcacgttcttccccctggtgatcgagatgcaccgggtcctgaaggacgggatggacgtgaacttcatgaagaaggtgctccgccagcggtacggccagaagaccgccgagcagtggatgcgcgaggagatcgtcgccgtgcgggccgccttcgaggcggtggggaccctggcctgggcccgcaccggcttctccccggccgcccgggacttcctgcgccagttcggcatcgggatctga

SEQ ID NO: 6867 - RNA, 696 nt, synthetic construct
  misc_feature 1..696: note = derived and/or modified CDS sequence (opt1) from OROV(H758669)__HQ830479.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatcctcaacaaccacttcccccagttccagtccaaccccgtgccggacaacggcctgaccctgcaccggctcagcgggtacctggcgcgctgggccttcacgcagatgcggtcccccatcaagcaggccgagttccgcgccaccgtcgtggtgcccctggcggaggtcaagggctgcacctggaacgacggcgacgccatgtacctcgggttcgccgccggcgccgagatgttcctgcagaccttcacgttcttccccctggtgatcgagatgcaccgggtgctcaaggacgggatggacgtcaacttcatgaagaaggtgctgcgccagcggtacggccagaagaccgcggagcagtggatgcgcgaggagatcgtggccgtccgggccgccttcgaggccgtggggaccctggcgtgggcccgcaccggcttcagcccggccgcccgggacttcctccgccagttcggcatcgggatctga

SEQ ID NO: 6868 - RNA, 696 nt, synthetic construct
  misc_feature 1..696: note = derived and/or modified CDS sequence (opt1) from OROV(H758687)__HQ830478.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccttcgtgatcgagatgcaccgggtcctgaaggacgggatggacgtgaacttcatgaagaaggtgctgcgccagcggtacggccagaagaccgcggagcagtggatgcgcgaggagatcgtcgccgtgcgggccgccttcgaggccgtggggaccctcgcgtgggcccgcaccggcttcagcccggccgcccgggacttcctgcgccagttcggcatcgggatctga

SEQ ID NO: 6869 - RNA, 696 nt, synthetic construct
  misc_feature 1..696: note = derived and/or modified CDS sequence (opt1) from OROV(H759041)__HQ830488.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaacgacgggatggacgtgaacttcatgaagaaggtgctccgccagcggtacggccagaagaccgcggagcagtggatgcgcgaggagatcgtcgccgtgcgggccgccttcgaggccgtggggaccctggcgtgggcccgcaccggcttcagcccggccgcccgggacttcctgcgccagttcggcatcgggatctga

SEQ ID NO: 6870 - RNA, 696 nt, synthetic construct
  misc_feature 1..696: note = derived and/or modified CDS sequence (opt1) from OROV(BeAr473358)__AF164539.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcacatgcggtcccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaagatcctccgccagcggtacggccagaagaccgcggagcagtggatgcgcgaggagatcatcgccgtgaagaccgccttcgagaccgtcgggacgctggcctgggccatcaccggcttcagcccggcggcccggaacttcctgcgccagttcgagatcgacatctga

SEQ ID NO: 6871 - RNA, 696 nt, synthetic construct
  misc_feature 1..696: note = derived and/or modified CDS sequence (opt1) from OROV(BeH 521086)__AY704559.1__N
  source 1..696: mol_type = other RNA
atgagcgagttcctgttcaacgacgtgccccagcgcaccacctccacgttcgacccggaggccgcctacgtcgcgttcgagagccggtacggccaggtgctcaacgccggggtggtccgcgtgttcttcctgaaccagaagaaggccaaggacgtgctgcggaagacctcccgccccatggtcgacctcaccttcggcggggtgcagttcaccatggtgaacaaccacttcccccagttccagagcaaccccgtcccggacaacggcctgacgctgcaccggctctccgggtacctggcccgctgggccttcacccagatgcggagccccatcaagcaggcggagttccgcgccaccgtggtggtccccctggccgaggtgaagggctgcacctggaacgacggcgacgccatgtacctcgggttcgcggccggcgccgagatgttcctgcagacgttcaccttcttccccctggtgatcgagatgcaccgggtcctcaaggacgggatggacgtgaacttcatgaagaaggtgctgcgccagcggtacggccagaagaccgccgagcagtggatgcgcgaggagatcgtcgccgtgcgggcggccttcgaggccgtggggaccctggcctgggcccgcacgggcttctccccggcggcccgggacttcctccgccagagcggcatcgggatctga

SEQ ID NO: 6872 - RNA, 696 nt, synthetic construct
  misc_feature 1..696: note = derived and/or modified CDS sequence (opt1) from OROV(BeH121923)__HM470110.1__N
  source 1..696: mol_type = other RNA
atgagcgagttcatcttcaacgacgtgccccagcgcaccacctccagcttcgacccggaggccgcctacgtcgcgttcgaggcccggtacggccaggtgctgaacgcctgcgtggtccgcgtgttcttcctcaaccagaagaaggccaaggacgtgctgcggaagacgtcctggcccatggtcgacctgaccttcgggcgcgtgcagttcgccatggtgaacaaccacttcccccagttccagagcaaccccgtcccggacaacggcctcgcgctgcaccggctgtccgggtacctcgcccgctgggccttcacccagatgcggagccccatcaagcaggccgagttccgcgcgaccgtggtggtccccctggccgaggtgaagggctgcacgtggaacgacggggacgccatgtacctgggcttcgccgccggcgcggagatgttcctccagaccttcaccttcttccccctggtgatcgagatgcaccgggtcctgaaggacgggatggacgtgaacttcatgaagaaggtgctccgccagcggtacggccagaagaccgccgagcagtggatgcgcgaggagatcgtcgccgtgcgggccgccttcgaggcggtggggacgctggcctgggcccgcaccggcttctccccggccgcccgggacttcctgcgccagttcgggatcgacatctga

SEQ ID NO: 6873 - RNA, 696 nt, synthetic construct
  misc_feature 1..696: note = derived and/or modified CDS sequence (opt1) from OROV(BeH379693)__AF164534.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggcgcaccagccggcccatggtcgacctgaccttcggcggggtgcagttcgccatggtgaacaaccacttcccccagttccagtccaaccccgtcccggacaacggcctcaccctgcaccgcctgagcgggtacctcgcgcggtgggccttcacgcagatgcgctcccccatcaagcaggccgagttccgggccaccgtggtggtccccctggcggaggtgaagggctgcacctggaacgacggcgacgccatgtacctggggttcgccgccggcgccgagatgttcctccagaccttcacgttcttccccctggtgatcgagatgcaccgcgtcctgaaggacgggatggacgtgaacttcatgaagaaggtgctccggcagcgctacggccagaagaccgcggagcagtggatgcgggaggagatcgtcgccgtgcgcgccgccttcgaggccgtggggaccctggcgtgggcccggaccggcttcagcccggccgcccgcgacttcctgcggcagttcggcatcgggatctga

SEQ ID NO: 6874 - RNA, 696 nt, synthetic construct
  misc_feature 1..696: note = derived and/or modified CDS sequence (opt1) from OROV(BeH381114)__AF164535.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaaggtgctccgccagcggtacggccagaagaccgcggagcagtggatgcgcgaggagatcgtcgccgtgcgggccgccttcgaggccgtggggaccctggcgtgggcccgcaccggcttcagcccggccgcccgggacttcctgcgccagttcggcatctgcatctga

SEQ ID NO: 6875 - RNA, 696 nt, synthetic construct
  misc_feature 1..696: note = derived and/or modified CDS sequence (opt1) from OROV(BeH390233)__AF164536.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaaggtgctccgccagcggtacggccagaagaccgcggagcagtggatgcgcgaggagatcgtcgccgtgcgggccgccttcgaggccgtggggaccctggcgtgggcccgcaccggcttcagcccggccgcccgggacttcctgggccagttcgggatcggcatctga

SEQ ID NO: 6876 - RNA, 696 nt, synthetic construct
  misc_feature 1..696: note = derived and/or modified CDS sequence (opt1) from OROV(BeH472204)__AF164538.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaaggtgctccgccagcggtacgtccagaagaccgcggagcagtggatgcgcgaggagatcgtggccgtgcgggccgccttcgaggccgtcggcaccctggcgtgggcccgcaccgggttcagcccggccgcccgggacttcctgcgccagttcggcatcggcatctga

SEQ ID NO: 6877 - RNA, 696 nt, synthetic construct
  misc_feature 1..696: note = derived and/or modified CDS sequence (opt1) from OROV(BeH505442)__AF164542.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggcggaggtgaagggctgcacctggaacgacggcgacgccatgtacctggggttcgccgccggcgccgagatgttcctccaggcgttcaccttcttccccctggtgatcgagatgcaccgggtcctgaaggacgggatggacgtgaacttcatgaagaaggtgctccgccagcggtacggccagaagacggccgagcagtggatgcgcgaggagatcgtcgccgtgcgggccgccttcgaggcggtggggaccctggcctgggcccgcaccggcttcagcccggccgcccgggacttcctgcgccagttcggcatcgacatctga

SEQ ID NO: 6878 - RNA, 696 nt, synthetic construct
  misc_feature 1..696: note = derived and/or modified CDS sequence (opt1) from OROV(BeH541863)__AF164544.1__N
  source 1..696: mol_type = other RNA
atgagcgagttcatcttctccgacgtgccccagcgcaccaccagcacgttcgacccggaggccgcctacgtcgcgttcgaggcccggtacggccaggtgctgaacgccggggtggtccgcgtgttcttcctcaaccagaagaaggccaaggacgtgctgcggaagacctcccgccccatggtcgacctgaccttcggcggggtgcagttcgccatggtgaacaaccacttcccccagttccagagcaaccccgtcccggacaacggcctcaccctgcaccggctgtccgggtacctcgcgcgctgggccttcacgcagatgcggagccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaaggtgctccgccagcggtacggccagaagaccgcggagcagtggatgcgcgaggagatcgtcgccgtgcgggccgccttcgaggccgtggggaccctggcgtgggcccgcaccggcttctccccggccgcccggaacttcctgcgccagttcggcatcgggatctga

SEQ ID NO: 6879 - RNA, 696 nt, synthetic construct
  misc_feature 1..696: note = derived and/or modified CDS sequence (opt1) from OROV(BeH543033)__AF164545.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaaggtgctccgccagcggtacggccagaagaccgcggagcagtggatgcgcgaggagatcgtcgccgtgcgggccgccttcgaggccgtggggaccctggcgtgggcccgcaccggcttcagcccggccgcccgggagttcctgcgccagttcggcatcgggatctga

SEQ ID NO: 6880 - RNA, 696 nt, synthetic construct
  misc_feature 1..696: note = derived and/or modified CDS sequence (opt1) from OROV(BeH543618)__AF164548.1__N
  source 1..696: mol_type = other RNA
atgcaggagttcatcttcaacgacgtgccccagcgcaccaccagcacgttcgacccggaggccgcctacgtcgcgttcgaggcccggtacggccaggtgctgaacgccggggtggtccgcgtgttcttcctcaaccagaagaaggccaaggacgtgctgcggaagacctcccgccccatggtcgacctgaccttcggcggggtgcagttcgccatggtgaacaaccacttcccccagttccagagcaaccccgtcccggacaacggcctcaccctgcaccggctgtccgggtacctcgcgcgctgggccttcacgcagatgcggagccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaaggtgctccgccagcggtacggccagaagaccgcggagcagtggatgcgcgaggagatcgtcgccgtgcgggccgccttcgaggccgtggggaccctggcgtgggcccgcaccggcttctccccggccgcccgggacttcctgcgccagttcggcatcgggatctga

SEQ ID NO: 6881 - RNA, 696 nt, synthetic construct
  misc_feature 1..696: note = derived and/or modified CDS sequence (opt1) from OROV(BeH544552)__AF164546.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaaggtgctccgccagcggtacggccagaagaccgcggagcagtggatgcgcgaggagatcgtcgccgtgcgggccgccttcgaggccgtggggaccctggcgtgggcccgcaccggcttcagcccggccgcccgggacttcctgcgccagatcggcatcgggatctga

SEQ ID NO: 6882 - RNA, 696 nt, synthetic construct
  misc_feature 1..696: note = derived and/or modified CDS sequence (opt1) from OROV(GML444911)__AF164556.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaaggtgctccgccagcggtacggccagaagaccgcggagcagtggatgcgcgaggagatcgtcgccgtgcgggccgccttcgaggccgtggggaccctggcgtgggcccgcaccggcttcagcccggccgcccgggacttcctgcgccagttcggcatctacatctga

SEQ ID NO: 6883 - RNA, 696 nt, synthetic construct
  misc_feature 1..696: note = derived and/or modified CDS sequence (opt1) from OROV(IQT4083)__AF164552.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaaggtgctccgccagcggtacggcaagaagaccgcggagcagtggatgcgcgaggagatcgtcgccgtgcgggccgccttcgaggccgtggggaccctggcgtgggcccgcaccggcttcagcccggccgcccgggacttcctgcgccagttcggcatcgacatctga

SEQ ID NO: 6884 - RNA, 696 nt, synthetic construct
  misc_feature 1..696: note = derived and/or modified CDS sequence (opt1) from OROV(PPS 522 H 669314)__EF467370.1__N
  source 1..696: mol_type = other RNA
atgagcgagttcatctccaacgacgtgccccaccgcaccaccagcacgttcgacccggaggccgcctacgtcgcgttcgaggcccggtacggccaggtgctgaacgccggggtggtccgcgtgttcttcctcaaccagaagaaggccaaggacgtgctgcggaagacctcccgccccatggtcgacctgaccttcggcggggtgcagttcgccatggtgaacaaccacttcccccagttccagagcaaccccgtcccggacaacggcctcaccctgcaccggctgtccgggtacctcgcgcgctgggccttcacgcagatgcggagccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaaggtgctccgccagcggtacggccagaagaccgcggagcagtggatgcgcgaggagatcgtcgccgtgcgggccgccttcgaggccgtggggaccctggcgtgggcccgcaccggcttctccccggccgcccgggacttcctgcgccagttcggcatctgcatctga

SEQ ID NO: 6885 - RNA, 696 nt, synthetic construct
  misc_feature 1..696: note = derived and/or modified CDS sequence (opt1) from OROV(TVP-19254/GML-480914)__KP795083.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgagcgccggggtggtccgcgtgttcttcctcaaccagaagaaggccaaggacgtgctgcggaagacctcccgccccatggtcgacctgaccttcggcggggtgcagttcgccatggtgaacaaccacttcccccagttccagagcaaccccgtcccggacaacggcctcaccctgcaccggctgtccgggtacctcgcgcgctgggccttcacgcagatgcggagccccatcaagcaggccgagttccgcgccaccgtggtggtccccctggcggaggtgaagggctgcacctggaacgacggcgacgccatgtacctggggttcgccgccggcgccgagatgttcctccagaccttcacgttcttccccctggtgatcgagatgcaccgggtcctgaaggacgggatggacgtgaacttcatgaagaaggtgctccgccagcggtacggccagaagaccgcggagcagtggatgcgcgaggagatcgtcgccgtgcgggccgccttcgaggccgtggggaccctggcgtgggcccgcaccggcttctccccggccgcccgggacttcctgcgccagttcggcatcgacatctga

SEQ ID NO: 6886 - RNA, 696 nt, synthetic construct
  misc_feature 1..696: note = derived and/or modified CDS sequence (opt1) from OROV(TVP-19256/IQE-7894)__KP795086.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcaccatggtgaacaaccacttcccccagttccagtccaaccccgtcccggacaacggcctcacgctgcaccggctgagcgggtacctcgcccgctgggcgttcacccagatgcggtcccccatcaagcaggccgagttccgcgccaccgtggtggtccccctggccgaggtgaagggctgcacctggaacgacggcgacgcgatgtacctggggttcgccgccggcgccgagatgttcctccagacgttcaccttcttccccctggtgatcgagatgcaccgggtcctgaaggacgggatggacgtgaacttcatgaagaaggtgctccgccagcggtacggccagaagaccgccgagcagtggatgcgcgaggagatcgtcgcggtgcgggccgccttcgaggccgtggggaccctggcctgggcgcgcacgggcttcagcccggccgcccgggacttcctgcgccagttcggcatcgacatctga

SEQ ID NO: 6887 - RNA, 696 nt, synthetic construct
  misc_feature 1..696: note = derived and/or modified CDS sequence (opt1) from OROV(TVP-19258/IQT-4083)__KP795092.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcggcaccgtggtggtccccctggccgaggtgaagggctgcacctggaacgacggggacgcgatgtacctgggcttcgccgccggggccgagatgttcctccagaccttcacgttcttccccctggtgatcgagatgcaccgggtcctgaaggacggcatggacgtgaacttcatgaagaaggtgctccgccagcggtacgggcagaagaccgccgagcagtggatgcgcgaggagatcgtcgcggtgcgggccgccttcgaggccgtgggcaccctggcctgggcgcgcaccggcttcagcccggccgcccgggacttcctgcgccagttcgggatcgacatctga

SEQ ID NO: 6888 - RNA, 699 nt, synthetic construct
  misc_feature 1..699: note = derived and/or modified CDS sequence (opt1) from OROV/FPV(Aus Ch 16129)__AF362400.1__N
  source 1..699: mol_type = other RNA
atgaccgacttcgtgttcaacgacgtcccccagcgcgccaccagcacgttcgacccggaggccgcgtacgtggccttcgagaaccggttccgcgccaacctgaccgtggacgtcgcccggatcttcttcctcaaccagaagaaggccaaggaccgcctggcgaagaccgcccgggccaccgtggacatcacgttcggcggggtggtcttccccgtggtgaacaaccactaccccgagtaccagcgcaaccccgtcccggacgacggcctgaccctccaccggctgtccgggtacctggcccgctggctcatcgaccagtgcaacgcgagccccgtgcggatgaccgagatccgcaccaaggtgatcatccccctggccgaggtcaagggctgcacgtggaacgacggggcctccatgtacctgggcttcgccgccggcgcggagatgttcctccagagcttcaccttctaccccctggtgatcgagatgcagcgggtgctgaaggacgggatggacgtcaacttcatgcgcaaggtgctccggcagcgctacggcaccaagaccgccgagcagtggatgcgggacgacatcgtggccgtcaagacggccttcgaggccatcaacaccatctcctgggcgcgcagcgggttctccccggccgcccgggagttcctgcgccagttcggcatcaacatctga

SEQ ID NO: 6889 - RNA, 696 nt, synthetic construct
  misc_feature 1..696: note = derived and/or modified CDS sequence (opt1) from OROV/IQTV(IQE3728/PER/06)__KF150535.1__N
  source 1..696: mol_type = other RNA
atgagcgagttcatcttcaacgacgtgccccagcgcaccacctccacgttcgacccggaggccgcctacgtcgcgttcgaggcccggtacggccaggtgctgaacgccggggtggtccgcgtgttcttcctcaaccagaagaaggccaaggacgtgctgcggaagaccagccgccccatggtcgacctgaccttcggcggggtgcagttcgccatggtgaacaaccacttcccccagttccagtccaaccccgtcccggacaacggcctcaccctgcaccggctgagcgggtacctcgcgcgctgggccttcacgcagatgcggtcccccatcaagcaggccgagttccgcgccaccgtggtggtccccctggcggaggtgaagggctgcacctggaacgacggcgacgccatgtacctggggttcgccgccggcaccgagatgttcctccagacgttcaccttcttccccctggtgatcgagatgcaccgggtcctgaaggacgggatggacgtgaacttcatgaagaaggtgctccgccagcggtacggccagaagaccgccgagcagtggatgcgcgaggagatcgtcgcggtgcgggccgccttcgaggccgtggggaccctggcctgggcgcgcacgggcttcagcccggccgcccgggacttcctgcgccagttcggcatcgggatctga

SEQ ID NO: 6890 - RNA, 699 nt, synthetic construct
  misc_feature 1..699: note = derived and/or modified CDS sequence (opt1) from OROV/UTIV(Be An 84785)__KF697156.1__N
  source 1..699: mol_type = other RNA
atggccgagttcgtgttcaacgacgtcccccagcgcagcacctccaccttcgacccggaggtggcctacgcgacgttcgaggccgccttccggcagaccctgaacgtgaacgtcgtgcgcgtgttcttcctcaaccagaagaacgccaagaacgtcctgcggaagaccagccgccccaacgtggacctgaccttcggcggggccacgttccccatcgtgaacaaccacttcccccagttccagtccaacccggtccccgacaacggcctcaccctgcaccggctgagcgggtacctcgcgcgctggtccatggaccagatgcggaccaaccccatccgccaggccgagttccgggccgccgtggtggtccccctggcggagatcaagggctgcacctggaacgacggggacgccatgtacctggccttcgccgccggcgcggagatgttcctcaacacgttcaccttcttcccgctggtgatcgagatgcaccgcgtgctgaaggacggcatggacgtcaacttcatgcggaaggtgctccgccagcggtacgggaccaagaccgccgagcagtggatgaaggacgagatcatccccatcaaggccgccttcgaggccgtgggcatgctgagctgggcgcgcacggggttctcccccgccgcccgggacttcctgcgccagttcggcatcaacgtctga

SEQ ID NO: 6891 - RNA, 738 nt, synthetic construct
  misc_feature 1..738: note = derived and/or modified CDS sequence (opt1) from HRTV(TN)__KJ740146.1__N
  source 1..738: mol_type = other RNA
atgaccgactggagcgccatcgccgtggagatcggcaacgagcccctggacgtcccggcgctcgtggagttcgccaaggagatcgcctacgaggggctggaccccgccgtgatcctgggcctcctgcgcgagcgcgggggcgagaactggcggaacgacgtcaagtacatcatcgtgttcgccctgacccgggggaacaagatcgtgaaggcgtgcggcaagatgtccaagaagggcgccgagcgcatgacgaacctcgcccgggtctacgagctgaaggagaacgccgtggaccgcatggcggtgacccccgtccgggtggcccagtgcctgcccacctggacctgcgccgccgccgcggccatcaaggagtacctcccggtggggcccgccatcatgcacaacaagatccagggctaccccctggagatgatgtgcatggccttcgggagcctgatcccccaggccgacgtctccatcgaggtgatcaaggacttcatggacgcgtacagcctctggcaggacacgttcgcccgcaccatcaacgtggaccagcggaagatgaccaaggccgaggtctacgccaagttccgcgacccgctgcacgccgcggtgaactccctgttcttccccaacgccacccggatcagctggctccaggccaagggcctgctgacggccaccaaggaggcctccgggagcgtgaaggcggccgccgccgcgtaccgcaacatgtga

SEQ ID NO: 6892 - RNA, 738 nt, synthetic construct
  misc_feature 1..738: note = derived and/or modified CDS sequence (opt1) from HRTV(Patient1)__JX005842.1__N
  source 1..738: mol_type = other RNA
atgaccgactggagcgccatcgccgtggagatcggcaacgagcccctggacgtcccggcgctcgtggagttcgccaaggagatcgcctacgaggggctggaccccgccgtgatcttcggcctgctccgcgagcgcgggggcgagaactggcggaacgacgtcaagtacatcatcgtgttcgccctgacccgggggaacaagatcgtgaaggcgtgcggcaagatgtccaagaagggcgccgagcgcatgacgaacctggcccgggtctacgagctcaaggagaacgccgtggaccgcatggcggtgacccccgtccgggtggcccagtgcctgcccacctggacctgcgccgccgccgcggccatcaaggagtacctgccggtggggcccgccatcatgcacaacaagatccagggctaccccctcgagatgatgtgcatggccttcgggagcctgatcccccaggccgacgtctccatcgaggtgatcaaggacttcatggacgcgtacagcctgtggcaggacacgttcgcccgcaccatcaacgtggaccagcggaagatgaccaaggccgaggtctacgccaagttccgcgacccgctccacgccgcggtgaactccctgttcttccccaacgccacccggatcagctggctgcaggccaagggcctcctgacggccaccaaggaggcctccgggagcgtgaaggcggccgccgccgcgtaccgcaacatgtga

SEQ ID NO: 6893 - RNA, 738 nt, synthetic construct; identical to SEQ ID NO: 6891
  misc_feature 1..738: note = derived and/or modified CDS sequence (opt1) from HRTV(Patient2)__JX005843.1__N
  source 1..738: mol_type = other RNA

SEQ ID NO: 6894 - RNA, 732 nt, synthetic construct
  misc_feature 1..732: note = derived and/or modified CDS sequence (opt1) from PTV(PAN472868)__NC_027202.1__N
  source 1..732: mol_type = other RNA
atgagctacgaggagatcgccgtgcagttcgcctccgagagcatcgacgagcaggcggtcgccggctgggtgaccgacttcgcctaccaggggttcgacgccaagcgcgtgatcgccctggtcaaggaccggggcggggaggactggaagcaggacgtgaagaagatgatcgtgctctccctgacccgcggcaacaagcccaacaagatggtcctgaagatgagcgacaaggggaaggcgatggtgaacgagctcgtgctgaagtacaagctgaagtccggcaacccgagccgggacgacctcacgctgtcccgcatcaccgccgccttcgccggctggacctgccaggcggccgactacgtccaggagtacctgcccgtgaccgggcgggccatggacgccatcagctccagctacccccgcgccatgatgcacccctccttcgcgggcctcatcgaccaggagctgccggccgacgtgctgagcgagatcacgcaggcccactgcctcttcatgatccagttctccaagaccatcaaccccagcctgcgggggctgtccaaggacgagatcgtcagctccttcgagcgccccatgcaggccgccatcagctccaccttcctcaccagcgcgaaccggcgcgccatgctgaagacgctgggcatcatcaacgacaacctcaagcccagctccagcaccgtgtccgccgccaaggtgttccggagcctgtga

SEQ ID NO: 6895 - RNA, 732 nt, synthetic construct
  misc_feature 1..732: note = derived and/or modified CDS sequence (opt1) from PTV(Adames)__KR912210.1__N
  source 1..732: mol_type = other RNA
atgagctacgaggagatcgccgtgcagttcgcctccgagagcatcgacgagcaggcggtcgccggctgggtgaccgacttcgcctaccaggggttcgacgccaagcgcgtgatcgccctggtcaaggagcggggcggggaggactggaagcaggacgtgaagaagatgatcgtgctctccctgacccgcggcaacaagcccaacaagatggtcctgaagatgagcgacaaggggaaggcgatggtgaacgagctcgtgctgaagtacaagctgaagtccggcaacccgagccgggacgacctcacgctgtcccgcatcaccgccgccttcgccggctggacctgccaggcggccgactacgtccaggagtacctgcccgtgaccgggcgggccatggacacgatcagctccggctacccccgcgccatgatgcaccccagcttcgccgggctcatcgaccaggagctgccggcggacgtgctgtccgagatcacccaggcccactgcctcttcatgatccagttcagcaagaccatcaacccctccctgcggggcctgagcaaggacgagatcgtctccagcttcgagcgccccatgcaggccgccatctccagcaccttcctcacgtccgccaaccggcgcgcgatgctgaagaccctggggatcatcaacgacaacctcaagcccagcagctccaccgtgagcgccgccaaggtgttccggtccctgtga

SEQ ID NO: 6896 - RNA, 732 nt, synthetic construct
  misc_feature 1..732: note = derived and/or modified CDS sequence (opt1) from PTV(Balliet)__KR912211.1__N
  source 1..732: mol_type = other RNA
atgagctacgaggagatcgccgtgcagttcgcctccgagagcatcgacgagcagaccgtcgcgggctgggtgaccgacttcgcctaccaggggttcgacgccaagcgcgtgatcgccctggtcaaggaccggggcggggaggactggaagcaggacgtgaagaagatgatcgtgctctccctgacgcgcggcaacaagcccaacaagatgatcctgaagatgagcgacaaggggaaggccatggtcaacgagctcgtgctgaagtacaagctgaagtccggcaacccgagccgggacgacctcaccctgtcccgcatcaccgcggccttcgccggctggacctgccaggccgcggactacgtgcaggagtacctgcccgtcacggggcgggccatggacgccatcagctccagctacccccgcgccatgatgcacccctccttcgccggcctcatcgaccaggagctgccggcggacgtgttcagcgagatcacccaggcccactgcctgttcatgatccagttctccaagaccatcaaccccagcctccgggggctgtccaaggacgagatcgtgagctccttcgagcgccccatgcaggccgccatcagctccaccttcctgacgagcgccaaccggcgcgcgatgctcaagaccctgggcatcatcaacgacaacctgaagcccagctccagcaccgtctccgccgccaaggtgttccggagcctctga

SEQ ID NO: 6897 - RNA, 732 nt, synthetic construct
  misc_feature 1..732: note = derived and/or modified CDS sequence (opt1) from PTV(PaAR2381)__KP272006.1__N
  source 1..732: mol_type = other RNA
atgagctacgaggagatcgccgtgcagttcgcctccgagagcatcgacgagcaggcggtcgccggctgggtgaccgacttcgcctaccaggggttcgacgccaagcgcgtgatcgccctggtcaaggaccggggcggggacgactggaagcaggacgtgaagaagatgatcgtgctctccctgacccgcggcaacaagcccaacaagatggtcctgaagatgagcgacaaggggaaggcgatggtgaacgagctcgtgctgaagtacaagctgaagtccggcaacccgagccgggacgacctcacgctgtcccgcatcaccgccgccttcgccggctggacctgccaggcggccgactacgtccaggagtacctgcccgtgaccgggcgggccatggacgccatcagctccagctacccccgcgccatgatgcacccctccttcgcgggcctcatcgaccaggagctgccggccgacgtgctgagcgagatcacgcaggcccactgcctcttcatgatccagttctccaagaccatcaaccccagcctgcgggggctgtccaaggacgagatcgtcagctccttcgagcgccccatgcaggccgccatcagctccaccttcctcaccagcgcgaaccggcgcgccatgctgaagacgctgggcatcatcaacgacaacctcaagcccagctccagcaccgtgtccgccgccaaggtgttccggagcctgtga

SEQ ID NO: 6898 - RNA, 732 nt, synthetic construct
  misc_feature 1..732: note = derived and/or modified CDS sequence (opt1) from PTV(GML902876)__KP272012.1__N
  source 1..732: mol_type = other RNA
atgagctacgaggagatcgccgtgcagttcgcctccgagagcatcgacgagcaggcggtcgccggctgggtgaccgacttcgcctaccaggggttcgacgccaagcgcgtgatcgccctggtcaaggaccggggcggggacgactggaagcaggacgtgaagaagatgatcgtgctctccctgacccgcggcaacaagcccaacaagatggtcctgaagatgagcgacaaggggaaggcgatggtgaacgagctcgtgctgaagtacaagctgaagtccggcaacccgagccgggacgacctcacgctgtcccgcatcaccgccgccttcgccggctggacctgccaggcggccgactacgtccaggagtacctgcccgtgaccgggcgggccatggacgccatcagctccagctacccccgcgccatgatgcacccctccttcgcgggcctcatcgaccaggagctgccggccgacgtgctgagcgagatcacgcaggcccactgcctcttcatgatccagttctccaagaccatcaaccccagcctgcgggggctgtccaaggacgagatcgtcagctccttcgagcgccccatgcaggccgccatcagctccaccttcctcaccagcgcgaaccggcgcgccatgctgaagacgctgggcatcatcaacgacaacctcaagcccagctccagcaccgcctccgccgccaaggtgttccggagcctgtga

SEQ ID NO: 6899 - RNA, 732 nt, synthetic construct
  misc_feature 1..732: note = derived and/or modified CDS sequence (opt1) from PTV(Adames)__KP272030.1__N
  source 1..732: mol_type = other RNA
atgagctacgaggagatcgccgtgcagttcgcctccgagagcatcgacgagcaggcggtcgccggctgggtgacccacttcgcctaccaggggttcgacgccaagcgcgtgatcgccctggtcaaggagcggggcggggaggactggaagcaggacgtgaagaagatgatcgtgctctccctgacccgcggcaacaagcccaacaagatggtcctgaagatgagcgacaaggggaaggcgatggtgaacgagctcgtgctgaagtacaagctgaagtccggcaacccgagccgggacgacctcacgctgtcccgcatcaccgccgccttcgccggctggacctgccaggcggccgactacgtccaggagtacctgcccgtgaccgggcgggccatggacacgatcagctccggctacccccgcgccatgatgcaccccagcttcgccgggctcatcgaccaggagctgccggcggacgtgctgtccgagatcacccaggcccactgcctcttcatgatccagttcagcaagaccatcaacccctccctgcggggcctgagcaaggacgagatcgtctccagcttcgagcgccccatgcaggccgccatctccagcaccttcctcacgtccgccaaccggcgcgcgatgctgaagaccctggggatcatcaacgacaacctcaagcccagcagctccaccgtgagcgccgccaaggtgttccggtccctgtga

SEQ ID NO: 6900 - RNA, 735 nt, synthetic construct
  misc_feature 1..735: note = derived and/or modified CDS sequence (opt1) from Phlebovirus(CoAr171616)__HM566153.1__N
  source 1..735: mol_type = other RNA
atgagctacgaggagatcgccgtgaacttcgcctccgagagcatcgacgagtccaccatcagcgcgtgggtctccgacttcgcctaccagggcttcgacgccaagcgcgtgatcgccctgatcaaggagcgcgggggcgagaactggaaggaggacgtgaagaagatgatcgtcctcagcctgacccgggggaacaagcccgccaagatgatcctgaagatgtccgacaagggcaagaaggaggtgaacgacctcatcacgcggtacaagctcaagagcgggaacccgtcccgcgacgacctgaccctgagccgggtggcggccgccttcgccggctggacctgccaggcggccgagtacgtccaggagtacctgcccgtgaccggccgcgccatggacgccttctccgccgacttcccccgggcgctgatgcaccccagcttcgccgggctcatcgaccaggagctgccgtccagcgccatgacggacatcgtgcacgcccactgcctgttcatgatccagttctccaagaccatcaaccccaccatccgcagcgcctccaaggacgagatcgtcgcgagcttcgaccggcccatgcaggccgccatcaactccaccttcctcacgagcgcccagcgccgggccatgctgaagaccctgggcgtgatcaacgacaacctcaaggtgagcaccgcggtctccagcgccgccaaggccttcaagaagctgcagtga

SEQ ID NO: 6901 - RNA, 735 nt, synthetic construct
  misc_feature 1..735: note = derived and/or modified CDS sequence (opt1) from Phlebovirus(CoAr171616)__EF201836.1__N
  source 1..735: mol_type = other RNA
atgagctacgaggagatcgccatccacttcgcctccgagagcatcgacgagtccaccatcagcgcgtgggtgtccgacttcgcctaccagggcttcgacgccaagcgcgtcatcgccctgatcaaggagcgcgggggcgagaactggaaggaggacgtgaagaagatgatcgtgctcagcctgacccgggggaacaagcccgccaagatgatcctgaagatgtccgacaagggcaagaaggaggtcaacgacctcatcacgcggtacaagctcaagagcgggaacccgtcccgcgacgacctgaccctgagccgggtggcggccgccttcgccggctggacctgccaggcggccgagtacgtgcaggagtacctgcccgtcaccggccgcgccatggacgccttctccgccgacttcccccgggcgctgatgcaccccagcttcgccgggctcatcgaccaggagctgccgtccagcgccatgacggacatcgtgcacgcccactgcctgttcatgatccagttctccaagaccatcaaccccaccatccgcagcgcctccaaggacgagatcgtggcgagcttcgaccggcccatgcaggccgccatcaactccaccttcctcacgagcgcccagcgccgggccatgctgaagaccctgggcgtcatcaacgacaacctcaaggtgagcaccgcggtgtccagcgccgccaaggccttcaagaagctgcagtga

SEQ ID NO: 6902 - RNA, 732 nt, synthetic construct
  misc_feature 1..732: note = derived and/or modified CDS sequence (opt1) from Phlebovirus(CoAr170255)__EF201840.1__N
  source 1..732: mol_type = other RNA
atgagctacgaggagatcgccatccagttcgcctccgagagcgtggacgcgaccaccatcgccgcctgggtctccgagttcgcctaccagggcttcgacgcccgccaggtgatcaacctggtgaagcagcgcgggggcgacgactggaaggaggacgtcaagaagatgatcgtgctcagcctgacgcgggggaacaagccctccaagatgctgaacaagatgagcgagtccggccagaagatcgtgaacgacctcatcagcaagtacaagctgaagtccgggaacccgggccggaacgacctgaccctcagccgcatcgcggccgccttcgccggctggacctgccaggcggccgaggtcgtgcaggactacctgcccgtgaccgggcgggccatggacgccatctccgacaagttcccccgcgccctgatgcaccccagcttcgcgggcctcgtcgacccgacgctgcccgagggggtggtggaggacatcgtccacgcccactgcctgttcatgatccagttctccaagaccatcaaccccagcctccggtccagctccaagagcgaggtggtgtccagcttcgaccgccccatgcaggccgccatcaacagcccgttcctgaccgccggcaaccggcgcgacatcctgatgtccctcgggctgatcaacagcaacctgaagccctcccccgcggtcatcgccgccgccaaggtgtaccggaagctctga

SEQ ID NO: 6903 - RNA, 732 nt, synthetic construct
  misc_feature 1..732: note = derived and/or modified CDS sequence (opt1) from Buenaventura virus(CoAr3319)__KP272003.1__N
  source 1..732: mol_type = other RNA
atgagctacgaggagatcgccatccagttcgcctccgagagcgtggacgcgaccaccatcgccgcctgggtctccgagttcgcctaccagggcttcgacgcccgccaggtgatcaacctggtgaagcagcgcgggggcgacgactggaaggaggacgtcaagaagatgatcgtgctcagcctgacgcgggggaacaagccctccaagatgctgaacaagatgagcgagtccggccagaagatcgtgaacgacctcatcagcaagtacaagctgaagtccgggaacccgggccggaacgacctgaccctcagccgcatcgcggccgccttcgccggctggacctgccaggcggccgaggtcgtgcaggactacctgcccgtgaccgggcgggccatggacgccatctccgacaagttcccccgcgccctgatgcaccccagcttcgcgggcctcgtcgacccgacgctgcccgagggggtggtggaggacatcgtccacgcccactgcctgttcatgatccagttctccaagaccatcaaccccagcctccggtccagctccaagagcgaggtggtgtccagcttcgaccgccccatgcaggccgccatcaacagcccgttcctgaccgccggcaaccggcgcgacatcctgatgtccctcgggctgatcaacagcaacctgaagccctcccccaccgtcgtggcggccgccaaggtgtaccggaagctctga

SEQ ID NO: 6904 - RNA, 732 nt, synthetic construct
  misc_feature 1..732: note = derived and/or modified CDS sequence (opt1) from Cocle virus(GML244915)__KP272035.1__N
  source 1..732: mol_type = other RNA
atgagctacgaggagatcgccgtgcagttcgcctccgagagcatcgacgagcaggcggtcgccggctgggtgaccgacttcgcctaccaggggttcgacgcccgccgggtgatcgccctggtcaaggaccgcggcggggaggactggaagcaggacgtgaagaagatgatcgtgctctccctgacccggggcaacaagcccaacaagatggtcctgaagatgagcgacaaggggaaggcgatggtgaacgagctcgtgctgaagtacaagctgaagtccggcaacccgagccgcgacgacctcacgctgtcccggatcaccgccgccttcgccggctggacctgccaggcggccgactacgtccaggagtacctgcccgtgaccgggcgcgccatggacgccatcagctccggctacccccgggccatgatgcaccccagcttcgcggggctcatcgaccaggagctgccggccgacgtgctgtccgagatcacgcaggcccactgcctcttcatgatccagttcagcaagaccatcaacccctccctgcgcggcctggggaaggacgagatcgtcagctccttcgagcggcccatgcaggccgccatcagctccaccttcctcaccagcgcgaaccgccgggccatgctgaagacgctgggcatcatcaacgacaacctcaagccctccagcagcaccgtgtccgccgccaaggtgttccgcagcctgtga

SEQ ID NO: 6905 - RNA, 732 nt, synthetic construct
  misc_feature 1..732: note = derived and/or modified CDS sequence (opt1) from Capira virus(VP-366G)__KP272044.1__N
  source 1..732: mol_type = other RNA
atgagctacgaggagatcgccatccagttcgcctccgagagcatcgacgagtccaccatcgcggcctgggtgagcgacttcgcctaccagggcttcgacgccaagcaggtcatcatcctgatcaagaagcgcgggggcgagaactggaaggaggacgtgaagaagatgatcgtgctctccctgacccgggggaacaagcccagcaagatggtcaacaagatgtccgacgagggcaagaaggtggtgaacgagctgatcagcaagtacaagctcaagacggggaacccggcccgcgacgacctgaccctgtcccggatcgcggccgccttcgccggctggacctgccaggcggccgagtacgtccaggactacctccccgtgaccggccgcgccatggacgccctgagcgacaagtacccccgggccctgatgcacccctccttcgcggggctcatcgacccgacgctgcccgacgacgccgtgaaggacatcgtccacgcccactgcctgttcatgatccagttcagcaagaccatcaacccctccctccgcagctccaccaagaccgagatcgtgaacagcttcgaccggcccatgcaggccgccatcaactccccgttcctgacggcggagaaccgccgggccatgctgaccaccctcggcgtgatcaacagcaacctgaagccctccgccgccgtcgtggccgcggccaaggcctaccgcaagctgtga

SEQ ID NO: 6906 - RNA, 732 nt, synthetic construct
  misc_feature 1..732: note = derived and/or modified CDS sequence (opt1) from Campana virus(VP-334K)__KP272042.1__N
  source 1..732: mol_type = other RNA
atgagctacgaggagatcgccatccagttcgcctccgagagcgtggacgcgaccaccatcgccgcctgggtctccgagttcgcctaccagggcttcgacgcccgccaggtgatcaacctggtgaagcagcgcgggggcgacgactggaaggaggacgtcaagaagatgatcgtgctcagcctgacgcgggggaacaagccctcccggatggtgaccaagatgagcgagtccggccagaagatcgtcaacgacctgatcagcaagtacaagctcaagtccgggaacccgggccgcaacgacctgaccctgagccgggtggcggccgccttcgccggctggacctgccaggcggccgaggtggtccaggactacctccccgtgacggggcgcgccatggacgccctgtccgacaagttcccccgggccatcatgcaccccagcttcgcgggcctgatcgacccgaccctccccgagaacgtggtcgaggacatcgtgcacgcccactgcctgttcatgatccagttctccaagaccatcaaccccagcctgcgctccagctccaagagcgaggtggtctccagcttcgaccggcccatgcaggccgccatcaacagcccgttcctcaccgccgcgaaccgccgggacatgctgatgtccctggggctcatcagctccaacctgaagcccagcgccgccgtgacggccgccgcgaaggcctaccgcaagctgtga

SEQ ID NO: 6907 - RNA, 738 nt, synthetic construct
  misc_feature 1..738: note = derived and/or modified CDS sequence (opt1) from RVFV(ZH-548)__DQ380151.1__N
  source 1..738: mol_type = other RNA
atggacaactaccaggagctggccatccagttcgccgcgcaggccgtggaccgcaacgagatcgagcagtgggtccgggagttcgcctaccagggcttcgacgcccgccgggtgatcgagctcctgaagcagtacgggggcgccgactgggagaaggacgcgaagaagatgatcgtgctggccctcacccgcgggaacaagccccggcgcatgatgatgaagatgagcaaggagggcaaggccaccgtcgaggccctgatcaacaagtacaagctgaaggaggggaacccgtcccgggacgagctcacgctgagccgcgtggcggccgccctggccggctggacctgccaggccctcgtggtcctgtccgagtggctgcccgtgaccggcaccacgatggacgggctcagccccgcgtacccccggcacatgatgcacccgtccttcgccggcatggtggaccccagcctgcccggggactacctgcgcgccatcctcgacgcccactccctgtacctgctccagttcagccgggtcatcaaccccaacctgcgcggccggaccaaggaggaggtggccgcgaccttcacccagccgatgaacgccgccgtgaactccaacttcatcagccacgagaagcgccgggagttcctgaaggccttcgggctcgtcgactccaacggcaagcccagcgccgcggtgatggccgccgcccaggcctacaagacggcggcctga

SEQ ID NO: 6908 - RNA, 738 nt, synthetic construct
  misc_feature 1..738: note = derived and/or modified CDS sequence (opt1) from RVFV(OV 35/74)__EF530207.1__N
  source 1..738: mol_type = other RNA
atggacaactaccaggagctggccatccagttcgccgcgcaggccgtggaccgcaacgagatcgagcagtgggtccgggagttcgcctaccagggcttcgacgcccgccgggtgatcgagctcctgaagcagtacgggggcgccgactgggagaaggacgcgaagaagatgatcgtgctggccctcacccgcgggaacaagccccggcgcatgatgatgaagatgagcaaggagggcaaggccaccgtcgaggccctgatcaacaagtacaagctgaaggaggggaacccgtcccgggacgagctcacgctgagccgcgtggcggccgccctggccggctggacctgccaggccctcgtggtcctgtccgagtggctgcccgtgaccggcaccacgatggacgggctcagccccgcgtacccccggcacatgatgcacccgtccttcgccggcatggtggaccccagcctgcccgaggactacctgcgcgccatcctcgacgcccactccctgtacctgctccagttcagccgggtcatcaaccccaacctgcgcgggcggaccaaggaggaggtggccgcgaccttcacccagccgatgaacgccgccgtgaactccaacttcatcagccacgagaagcgccgggagttcctgaaggccttcggcctcgtcgactccaacgggaagcccagcgccgcggtgatggccgccgcccaggcctacaagacggcggcctga

SEQ ID NO: 6909 - RNA, 762 nt, synthetic construct
  misc_feature 1..762: note = derived and/or modified CDS sequence (opt1) from SFNV(Toscana)__NC_006318.1__N
  source 1..762: mol_type = other RNA
atgagcgacgagaactaccgcgacatcgccctggccttcctcgacgagtccgcggacagcggcaccatcaacgcctgggtgaacgagttcgcctaccaggggttcgaccccaagcggatcgtccagctggtgaaggagcgcggcaccgccaaggggcgggactggaagaaggacgtgaagatgatgatcgtcctgaacctcgtgcgcggcaacaagccggaggccatgatgaagaagatgtccgagaagggggcgagcatcgtggccaacctgatctccgtctaccagctgaaggagggcaaccccggccgggacacgatcaccctcagccgcgtgtccgccgccttcgtgccctggaccgtccaggcgctgcgggtgctgagcgagtccctccccgtgagcgggaccacgatggacgccatcgccggcgtcacctacccgcgcgccatgatgcacccctccttcgccgggatcatcgacctggacctgcccaacggcgcgggggccaccatcgccgacgcccacggcctcttcatgatcgagttcagcaagaccatcaacccctccctgcggacgaagcaggccaacgaggtggcggccaccttcgagaagccgaacatggccgccatgagcggccgcttcttcacccgggaggacaagaagaagctgctcatcgccgtggggatcatcgacgaggacctggtcctggcgtccgccgtggtgcgcagcgccgagaagtaccgggccaaggtcggcaagtga

SEQ ID NO: 6910 - RNA, 762 nt, synthetic construct
  misc_feature 1..762: note = derived and/or modified CDS sequence (opt1) from SFNV__HM566170.1__N
  source 1..762: mol_type = other RNA
atgagcgaggagaactaccgcgagatcgccctggccttcctcgacgaggcggccgactccggcaccatcaccgcctgggtgaacgagttcgcctaccaggggttcgaccccaagcggatcgtccagctggtgaaggagcgcggcacggccaaggggcgggactggaagaaggacgtgaagatgatgatcgtcctgaacctcgtgcgcggcaacaagccggaggcgatgatgaagaagatgagcgagaagggggccggcatcgtggcccagctgatctccgtctaccagctgaaggagggcaaccccgggcgggacaccatcaccctcagccgcgtgtccgccgcgttcgtgccctggaccatccaggccctgcgggtcctgagcgactccctccccgtgacgggcaccaccatggacgccatcgccggggtgacctacccgcgcgccatgatgcaccccagcttcgcgggcatcatcgacctggacctgcccaaccgggccggggaggtcatcgccgacgcccacggcctcttcatgctggagttctccaagacgatcaaccccagcctgcgcaccaagcagccgaacgagatcgccgcgaccttcgagaagcccaacatggccgccatgtccggccggttcttcacccgcgaggacaagaagaagctcctgatggccgtggggatcctgaacgaggacctcgtgctgacgcccgccatcgtcaagtgcgcggagaagtactgcagcaaggtgggcaagtga

SEQ ID NO: 6911 - RNA, 735 nt, synthetic construct; identical to SEQ ID NO: 6900
  misc_feature 1..735: note = derived and/or modified CDS sequence (opt1) from SFNV(Namru)__HM566168.1__N
  source 1..735: mol_type = other RNA

SEQ ID NO: 6912 - RNA, 762 nt, synthetic construct
  misc_feature 1..762: note = derived and/or modified CDS sequence (opt1) from SFNV(NAMRU 840055)__EF201828.1__N
  source 1..762: mol_type = other RNA
atgagcgaggagaactaccgcgagatcgccctggccttcctcgacgaggcggccgactccggcaccatcaccgcctgggtgaacgagttcgcctaccaggggttcgaccccaagcggatcgtccagctggtgaaggagcgcggcacggccaaggggcgggactggaagaaggacgtgaagatgatgatcgtcctgaacctcgtgcgcggcaacaagccggaggcgatgatgaagaagatgagcgagaagggggccggcatcgtggcccagctgatctccgtctaccagctgcgggagggcaaccccgggcgcgacaccatcaccctcagccgggtgtccgccgcgttcgtgccctggaccatccaggccctgaaggtcctgagcgactccctccccgtgacgggcaccaccatggacgccatcgccggggtggtctacccgcgcgccatgatgcaccccagcttcgcgggcatcatcgacctggacctgcccaaccgggccggggaggccatcgccgacgcccacggcctcttcatgctggagttctccaagaccatcaaccccagcctgcgcacgaagcagccgaacgagatcgcggccaccttcgagaagcccaacatggccgccatgtccggccggttcttcacccgcgaggacaagaagaagctcctgatggccgtggggatcctgaacgaggacctcgtgctgacccccgcgatcgtcaagtgcgccgagaagtaccggagcaaggtgggcaagtga

SEQ ID NO: 6913 - RNA, 762 nt, synthetic construct
  misc_feature 1..762: note = derived and/or modified CDS sequence (opt1) from SFNV(NAMRU 840055)__EF201829.1__N
  source 1..762: mol_type = other RNA
atgagcgaggagaactaccgcgagatcgccctggccttcctcgacgaggcggccgactccggcaccatcaccgcctgggtgaacgagttcgcctaccaggggttcgaccccaagcggatcgtccagctggtgaaggagcgcggcacggccaaggggcgggactggaagaaggacgtgaagatgatgatcgtcctgaacctcgtgcgcggcaacaagccggaggcgatgatgaagaagatgagcgagaagggggccggcatcgtggcccagctgatctccgtctaccagctgaaggagggcaaccccgggcgggacaccatcaccctcagccgcgtgtccgccgcgttcgtgccctggaccatccaggccctgcgggtcctgagcgactccctccccgtgacgggcaccaccatggacgccatcgccggggtgacctacccgcgcgccatgatgcaccccagcttcgcgggcatcatcgacctggacctgcccaaccgggccggggaggccatcgccgacgcccacggcctcttcatgctggagttctccaagacgatcaaccccagcctgcgcaccaagcagccgaacgagatcgcggccaccttcgagaagcccaacatggccgccatgtccggccggttcttcacccgcgaggacaagaagaagctcctgatggccgtcgggatcctgaacgaggacctcgtgctgacgcccgcgatcgtgaagtgcgccgagaagtactgcagcaaggtcggcaagtga

SEQ ID NO: 6914 - RNA, 762 nt, synthetic construct
  misc_feature 1..762: note = derived and/or modified CDS sequence (opt1) from SFNV(P-7101795)__EF201830.1__N
  source 1..762: mol_type = other RNA
atgagcgaggagaactaccgcgagatcgccctggccttcctcaacgaggcggccgactccggcaccatcaccgcctgggtgaacgagttcgcctaccaggggttcgaccccaagcggatcgtccagctggtgaaggagcgcggcacggccaaggggcgggactggaagaaggacgtgaagatgatgatcgtcctgaacctcgtgcgcggcaacaagccggagaccatgatgaagaagatgagcgagaagggggcgggcatcgtggcccagctgatctccgtctaccagctgaaggagggcaaccccgggcgggacaccatcaccctcagccgcgtgtccgccgccttcgtgccctggacggtccaggcgctgcgggtgctgagcgactccctccccgtgaccggcaccaccatggacgccatcgccggggtcacgtacccgcgcgccatgatgcaccccagcttcgccggcatcatcgacctggacctgcccaaccgggcgggggagaccatcgccgacgcccacggcctcttcatgctggagttctccaagaccatcaaccccagcctgcgcaccaagcagccgaacgagatcgccgccacgttcgagaagcccaacatggcggccatgtccggccggttcttcacccgcgaggacaagaagaagctcctgatggccgtgggggtgctgaacgaggacctcgtcctgacccccgccatcgtgaagtgcgccgagaagtaccggagcaaggtgggcaagtga

SEQ ID NO: 6915 - RNA, 762 nt, synthetic construct
  misc_feature 1..762: note = derived and/or modified CDS sequence (opt1) from SFNV(P-7101795)__EF201832.1__N
  source 1..762: mol_type = other RNA
atgagcgaggagaactaccgcgagatcgccctggccttcctcgacgaggcggccgactccggcaccatcaccgcctgggtgaacgagttcgcctaccaggggttcgaccccaagcggatcgtccagctggtgaaggagcgcggcacggccaaggggcgggactggaagaaggacgtgaagatgatgatcgtcctgaacctcgtgcgcggcaacaagccggaggcgatgatgaagaagatgagcgagaagggggccggcatcgtggcccagctgatctccgtctaccagctgcgggagggcaaccccgggcgcgacaccatcaccctcagccgggtgtccgccgcgttcgtgccctggaccatccaggccctgaaggtcctgagcgactccctccccgtgacgggcaccaccatggacgccatcgccggggtgatgtacccgcgcgccatgatgcaccccagcttcgcgggcatcatcgacctggacctgcccaaccgggccggggaggccatcgccgacgcccacggcctcttcatgctggagttctccaagaccatcaaccccagcctgcgcacgaagcagccgaacgagatcgcggccaccttcgagaagcccaacatggccgccatgtccggccggttcttcacccgcgaggacaagaagaagctcctgatggccgtcgggatcctgaacgaggacctcgtgctgacccccgcgatcatcaagtgcgccgagaagtaccggagcaaggtgggcaagtga

SEQ ID NO: 6916 - RNA, 762 nt, synthetic construct
  misc_feature 1..762: note = derived and/or modified CDS sequence (opt1) from Arrabida virus(PoSFPhlebV/126/2008)__KP863801.1__N
  source 1..762: mol_type = other RNA
atgagcgaggacaactaccgcaccatcgccctggccttcctcgacgagtccgcggacagcaccacgatcaacgcctgggtgaacgagttcgcctaccagggcttcgaccccaagcggatcgtccagctggtgaaggagcgcgggaccgccaagggccgggactggaagaaggacgtgaagatgatgatcgtcctgaacctcgtgcgcgggaacaagccggagtccatgatgaagaagatgagcgagaagggcgccgcgatcgtgacccagctgatctccacctaccagctgaaggaggggaaccccggccgggacacgatcaccctcagccgcgtctccgccgccttcgtgccctggaccgtgcaggccctgaagaccctgagcgagtccctccccgtcacgggcaccaccatggacagcatcgcggggaccacgtacccgcggtgcatgatgcacccctccttcgccggcatcatcgacctggagctgcccaacaacaccggggccatgctcgccgacgcccacggcctgttcatgctggagttcagcaagaccatcaacccctccctccgcaccaagcagccgaacgagatcgcggccacgttcgagaagcccaacatggccgccatgaccgggcggttcttcacccgcgacgacaagaagaagctgctgatcgccatcggcgtgctcgacgaggacctggtgcccaaccccgcgatcgagaagtgcgccgagaagtacaaggccaaggtcggcaagtga

SEQ ID NO: 6917 - RNA, 765 nt, synthetic construct
  misc_feature 1..765: note = derived and/or modified CDS sequence (opt1) from Gordil virus(Dak ANBr 496d)__KF297902.1__N
  source 1..765: mol_type = other RNA
atgagcgaggagaactaccgcgagatcgccatggccttcgcgaacgactccgccgacttcaacatgatcagcgtgtgggccaacgacttcgcctaccagggcttcgaccccaagcggatcgtcgagctggtgcgccagcgggggctcgccaaggcgcgcaactggaagcaggacgtgaagatgatgatcgtcctgaacctgatgcggggcaacaagccggaggccatggtgcgcaagatgcaggagaaggggcagcggatcgtgctcgagctgatctccgtctacgagctgaaggagggcaaccccgggcgcgacaccatcaccctcagccgggtgtccgccgccttcgtgccctggacgatcatggcgctgcgccagctggccgagaacatccccgtcaccggcagcatcatggactccatcctcgacggcgccgtgtacccgcgggccatgatgcaccccagcttcgccgggatcatcgacctggagctgcccgagggccgcggggcggagctcgccgacgcccacggcctgttcatgatcgagttctccaagaccatcaaccccagcctgcggaccaagtccgccatcgagatcgccgcgagcttcgagaagccgaacatggccgccatgacggggaacttcttcaccaaggacgacaagcgcaagctcctgaagcagatcggcatcctggactccgacctcaagctgacccccgtgatcgagaaggccgccgcgctgtaccggagcaagaccaacaagtga

SEQ ID NO: 6918 - RNA, 762 nt, synthetic construct
  misc_feature 1..762: note = derived and/or modified CDS sequence (opt1) from Granada virus(GR25)__GU135608.1__N
  source 1..762: mol_type = other RNA
atgagcgaggacaactaccgcaccatcgccctggccttcctcgacgagtccgcggacagcaccacgatcaacgcctgggtgaacgagttcgcctaccagggcttcgaccccaagcggatcgtccagctggtgaaggagcgcgggaccgccaagggccgggactggaagaaggacgtgaagatgatgatcgtcctgaacctcgtgcgcgggaacaagccggagtccatgatgaagaagatgagcgagaagggcgccgcgatcgtgacccagctgatctccacctaccagctgaaggaggggaaccccggccgggacacgatcaccctcagccgcgtctccgccgccttcgtgccctggaccgtgcaggccctgaagaccctgagcgagtccctccccgtcacgggcaccaccatggacagcatcgcggggaccacgtacccgcggtgcatgatgcacccctccttcgccggcatcatcgacctggagctgcccaacaacaccggggccatgctcgccgacgcccacggcctgttcatgctggagttcagcaagaccatcaacccctccctccgcaccaagcagccgaacgagatcgcggccacgttcgagaagcccaacatggccgccatgaccgggcggttcttcacccgcgacgacaagaagaagctgctgatcgccatcggcgtgctcaacgaggacctggtgcccaaccccgcgatcgagaagtgcgccgagaagtacaaggccaaggtcggcaagtga

SEQ ID NO: 6919 - RNA, 762 nt, synthetic construct
  misc_feature 1..762: note = derived and/or modified CDS sequence (opt1) from Massilia virus(127)__KT906102.1__N
  source 1..762: mol_type = other RNA
atgagcgaggacaactaccgcaccatcgccctgtccttcctcgacgagaccgccgtgagcacgtccatcaacgcgtgcgtcaacgagttcgcctaccagggcttcgaccccaagcggatcgtgcagctggtgaaggagcgcgggaccgccaagggccgggactggaagaaggacgtcaagatgatgatcgtgctgaacctcgtgcgcgggaacaagccggagagcatgatgaagaagatgtccgagaagggcgccgccatcgtcacccagctgatcagcacctaccagctgaaggaggggaaccccggccgggacacgatcaccctctcccgcgtgagcgcggccttcgtgccctggaccgtccaggccctgaagaccctgtccgagagcctccccgtgacgggcaccaccatggactccatcgccgggaccacgtacccgcggtgcatgatgcaccccagcttcgcgggcatcatcgacctggagctgcccaacaacaccggggccatgctcgccgacgcccacggcctgttcatgctggagttctccaagaccatcaaccccagcctccgcaccaagcagccgaacgagatcgccgcgacgttcgagaagcccaacatggccgccatgaccgggcggttcttcacccgcgacgacaagaagaagctgctgatcgccatcggcgtgctcgacgaggacctggtccccaaccccgccatcgagaagtgcgcggagaagtacaaggccaaggtgggcaagtga

SEQ ID NO: 6920 - RNA, 762 nt, synthetic construct
  misc_feature 1..762: note = derived and/or modified CDS sequence (opt1) from Massilia virus(130)__KT906103.1__N
  source 1..762: mol_type = other RNA
atgagcgaggacaactaccgcaccatcgccctgtccttcctcgacgagaccgccgacagcacgtccatcaacgcgtgcgtgaacgagttcgcctaccagggcttcgaccccaagcggatcgtccagctggtgaaggagcgcgggaccgccaagggccgggactggaagaaggacgtgaagatgatgatcgtcctgaacctcgtgcgcgggaacaagccggagagcatgatgaagaagatgtccgagaagggcgccgccatcgtgacccagctgatcagcacctaccagctgaaggaggggaaccccggccgggacacgatcaccctctcccgcgtcagcgcggccttcgtgccctggaccgtgcaggccctgaagaccctgtccgagagcctccccgtcacgggcaccaccatggactccatcgccgggaccacgtacccgcggtgcatgatgcaccccagcttcgcgggcatcatcgacctggagctgcccaacaacaccggggccatgctcgccgacgcccacggcctgttcatgctggagttctccaagaccatcaaccccagcctccgcaccaagcagccgaacgagatcgccgcgacgttcgagaagcccaacatggccgccatgaccgggcggttcttcacccgcgacgacaagaagaagctgctgatcgccatcggcgtgctcgacgaggacctggtgcccaaccccgccatcgagaagtgcgcggagaagtacaaggccaaggtcggcaagtga

SEQ ID NO: 6921 - RNA, 762 nt, synthetic construct
  misc_feature 1..762: note = derived and/or modified CDS sequence (opt1) from Naples virus(Yu 8/76)__JF920141.1__N
  source 1..762: mol_type = other RNA
atgagcgaggacgactaccacaagatcgccctggccttcgcggaggagtccgccgacgtgagcaccatcgagtcctgggtcaacgacttcgcctaccagggcttcgacccccgccggatcgtgcagctcgtgaaggagcgcgggaccgccaagggccgggactggaagaaggacgtcaagatgatgatcgtgctgaacctggtgcgcgggaacaagccggaggccatgatgaagaagatgagcgagaagggcgcggccatcgtcgcccagctcatctccgtgtaccagctgaaggaggggaaccccggccgggacacgatcaccctgagccgcgtgtccgccgcgttcgtcccctggaccgtgcaggccctccgggtgctgagcgaccacctccccgtcaccggcacgaccatggacgccatcgccggggtgacctacccgcgcgccatgatgcacccctccttcgcgggcatcgtggacctggagctgccccggaagaccggggagatgatcgccgacgcccacggcctgttcatgctcgagttcagcaagacgatcaacccctccctgcgcaccaagcagccgaacgagatcgccaccaccttcgagaagcccaacatggccgcgatgagcgggaagttcttctcccgggaggacaagaagaagctgctcatgagcgtcggcatcatcaacgacgacctgctgctcacggcctccgtggtgaagtgcgccgagaagtaccgcgccaagaccggcaagtga

SEQ ID NO: 6922 - RNA, 762 nt, synthetic construct
  misc_feature 1..762: note = derived and/or modified CDS sequence (opt1) from Punique virus(P1_B4_2008)__FJ848987.1__N
  source 1..762: mol_type = other RNA
atgagcgaggagaactaccgcgagatcgccctggccttcctcgacgagtccgcggacagcggcaccatctccacctgggtgaacgacttcgcctaccaggggttcgaccccaagcggatcgtccagctggtgaaggagcgcggcacggccaaggggcgggactggaagaaggacgtgaagatgatgatcgtcctgaacctcgtgcgcggcaacaagccggagagcatgatgaagaagatgtccgagaagggggccgccatcgtggcgcagctgatcgccgcctaccagctgaaggagggcaaccccggccgggacaccatcaccctcagccgcgtctccgccgcgttcgtgccctggaccgtgcaggccctgcggagcctgtccgacagcctccccgtcacggggaccaccatggactccatcgccggcgtgacctacccgcgctgcatgatgcaccccagcttcgccgggatcatcgacctggacctgcccaacgacacgggcgccatgctcgcggacgcccacgggctgttcatgctggagttctccaagaccatcaaccccagcctccggaccaagcaggccaacgagatcgccgccaccttcgagaagccgaacatggcggccatgaacggccgcttcttcacgcgggaggacaagaagaagctgctgatcgccatcggcgtgctcaacgaggacctgatccccgtctccgccatcgccaagtgcgcggagaagtaccgcgccaaggtggggaagtga

SEQ ID NO: 6923 - RNA, 762 nt, synthetic construct
  misc_feature 1..762: note = derived and/or modified CDS sequence (opt1) from Saint Floris virus(Dak ANB512)__JF920138.1__N
  source 1..762: mol_type = other RNA
atgagcgaggagacctacgcccagctggccatggcgttcctcgccgagcccgccgactggtccaccctgagcgtgtgggtcaacgagttcgcctaccagggcttcgacccgaagcgcatcgtggagctgatcatggagcgggggaagaagttcaaccgcgagtggaagaaggacgtgaagatgatgatcacgctcaacctgatccggggcaacaagcccgaggccatgatgcgcaagatgtccgacaaggggcggagcatcgtctccgagctgatcagcgtgtacgagctcaaggagggcaaccccgggcgcgacaccatcaccctgtcccgggtgagcgcggccttcgtcccctggaccgtgcgcgccctggtggccctccagaacgacctgccggtcacgggcgcggccatggactccatctgcggcgtgacctacccccgggccatgatgcaccccagcttcgccggggtgatcgacctggagctccccaacggcgtcggggcccagctggcggacgcccacggcctgttcatgctcgagttctccaagaccatcaacccggggctgcgcaccaagcagcccaacgagatcgccgccacgttcgagaagcccaacctggccgcgatgaccggcaagttcttcaccaaggaggacaagcggaaggtgctcatcagcgtgggcgtcatcaactccgacctgcagcccaacagcgtggtgaagacctgcgccgagctgtaccgcgcccgggtcatgaagtga

SEQ ID NO: 6924 - RNA, 762 nt, synthetic construct
  misc_feature 1..762: note = derived and/or modified CDS sequence (opt1) from Tehran virus(I-47)__JF939848.1__N
  source 1..762: mol_type = other RNA
atgagcgaggaggactaccgcgccatcgccctgtccttcagcgacgagtccgcggacgtgggcatcatcaccacctgggtcaacgagttcgcctaccaggggttcgaccccaagcggatcgtgcagctcgtgaaggagcgcggccaggccaaggggcgggactggaagaaggacgtcaagatgatgatcgtgctgaacctgatccgcggcaacaagccggacgccatgatgaagaagatgagcgagaagggggccgcgacggtggcccagctcgtctccgtgtaccagctgaaggagggcaaccccggccgggacaccatcaccctgagccgcgtgtccgccgccttcgtcccctggaccgtgcaggcgctcaaggtgctgagcgagtccctgcccgtcacggggaccaccatggacaccgtggccggcgtgacgtacccgcgggccatgatgcaccccagcttcgccgggatcatcgacctcgagctgcccggccgcgccggggaggcgatcgccgacgcccacggcctgttcatgctcgagttctccaagaccatcaaccccagcctgcggaccaagcagccgaacgagatcgccgccaccttcgagaagcccaacatggcggccatgacgggccgcttcttcacccgggaggacaagaagaagctgctcatcgccgtcgggatcatcaacgacgacctgctgctcaccccctccatcgccaagtgcgccgagaagtaccgcgcgaaggtgggcaagtga

SEQ ID NO: 6925 - RNA, 762 nt, synthetic construct
  misc_feature 1..762: note = derived and/or modified CDS sequence (opt1) from Zerdali virus(37)__KP966618.1__N
  source 1..762: mol_type = other RNA
atgagcgaggaggactaccgcgccatcgccctgtccttcagcgacgaggcggccgacgtgggcaccatcaccgcctgggtcaacgagttcgcctaccaggggttcgaccccaagcggatcgtgcagctcgtgcgcgagcggggcatcgccaaggggcgcgactggaagaaggacgtcaagatgatgatcgtgctgaacctgatccggggcaacaagccggacgcgatgatgaagaagatgtccgagaagggggccgccacggtggcccagctcgtcagcgtgtaccagctgaaggagggcaaccccggccgcgacaccatcaccccctcccgggtgagcgcggccttcgtcccctggaccgtgcaggccctgaaggtgctctccgagagcctgccggtcacggggaccaccatggacaccatcgccggcgtgtcctacccccgcgccatgatgcaccccagcttcgcggggatcatcgacctggagctcccccggcgcgccggcgaggtgatcgccgacgcccacgggctgttcatgctggagttctccaagacgatcaacccgagcctccggaccaagcagcccaacgagatcgccgcgaccttcgagaagcccaacatggccgccatgaccggccgcttcttcacgcgggaggacaagaagaagctgctgatcgccgtcggcatcatcaacgacgacctcctgctggccccctccgtggcgaagtgcgccgagaagtaccgcgccaaggtggggaagtga

SEQ ID NO: 6926 - RNA, 762 nt, synthetic construct; identical to SEQ ID NO: 6909
  misc_feature 1..762: note = derived and/or modified CDS sequence (opt1) from TOSV(9028)__KU904263.1__N
  source 1..762: mol_type = other RNA

SEQ ID NO: 6927 - RNA, 762 nt, synthetic construct
  misc_feature 1..762: note = derived and/or modified CDS sequence (opt1) from TOSV(SI-121283)__JF330274.1__N
  source 1..762: mol_type = other RNA
atgagcgacgagaactaccgcgacatcgccctggccttcctcgacgagtccgcggacagcggcaccatcaacgcctgggtgaacgagttcgcctaccaggggttcgaccccaagcggatcgtccagctggtgaaggagcgcggcaccgccaaggggcgggactggaagaaggacgtgaagatgatgatcgtcctgaacctcgtgcgcggcaacaagccggaggccatgatgaagaagatgtccgagaagggggcgagcatcgtggccaacctgatctccgtctaccagctgaaggagggcaaccccggccgggacacgatcaccctcagccgcgtgtccgccgccttcgtgccctggaccgtccaggcgctgcgggtgctgagcgagtccctccccgtgagcgggaccacgatggacgccatcgccggcgtcacctacccgcgcgccatgatgcacccctccttcgccgggatcatcgacctggacctgcccaacggcgcgggggccaccatcgccgacgcccacggcctcttcatgatcgagttcagcaagaccatcaacccctccctgcggacgaagcaggccaacgaggtggcggccaccttcgagaacccgaacatggccgccatgagcggccgcttcttcacccgggaggacaagaagaagctgctcatcgccgtggggatcatcgacgaggacctggtcctggcgtccgccgtggtgcgcagcgccgagaagtaccgggccaaggtcggcaagtga

SEQ ID NO: 6928 - RNA, 762 nt, synthetic construct
  misc_feature 1..762: note = derived and/or modified CDS sequence (opt1) from TOSV(5963930705)__KU935733.1__N
  source 1..762: mol_type = other RNA
atgagcgacgagaactaccgcgacatcgccctggccttcctcgacgagtccgcggacagcggcaccatcaacgcctgggtgaacgagttcgcctaccaggggttcgaccccaagcggatcgtccagctggtgaaggagcgcggcaccgccaaggggcgggactggaagaaggacgtgaagatgatgatcgtcctgaacctcgtgcgcggcaacaagccggaggccatgatgaagaagatgtccgagaagggggcgagcatcgtggccaacctgatctccgtctaccagctgaaggagggcaaccccggccgggacacgatcaccctcagccgcgtgtccgccgccttcgtgccctggaccgtccaggcgctgcgggtgctgagcgagtccctccccgtgagcgggaccacgatggacgccatcgccggcgtcacctacccgcgcgccatgatgcacccctccttcgccgggatcatcgacctggacctgcccaacggcgcgggggccaccatcgccgacgcccacggcctcttcatggtggagttcagcaagaccatcaacccctccctgcggacgaagcaggccaacgaggtggcggccaccttcgagaagccgaacatggccgccatgagcggccgcttcttcacccgggaggacaagaagaagctgctcatcgccgtcgggatcatcgacgaggacctggtgctggcgtccgccgtggtccgcagcgccgagaagtaccgggccaaggtgggcaagtga

SEQ ID NO: 6929 - RNA, 762 nt, synthetic construct
  misc_feature 1..762: note = derived and/or modified CDS sequence (opt1) from TOSV(MRS2010-4319501)__KC776214.1__N
  source 1..762: mol_type = other RNA
atgagcgacgagaactaccgcgacatcgccctggccttcctcgacgagtccgcggacagcggcaccatcaacgcctgggtgaacgagttcgcctaccaggggttcgaccccaagcggatcgtccagctggtgaaggagcgcggcaccgccaaggggcgggactggaagaaggacgtgaagatgatgatcgtcctgaacctcgtgcgcggcaacaagccggaggccatgatgaagaagatgtccgagaagggggcgagcatcgtggccaacctgatctccgtctaccagctgaaggagggcaaccccggccgggacacgatcaccctcagccgcgtgtccgccgccttcgtgccctggaccgtccaggcgctgcgggtgctgagcgagtccctccccgtgagcgggaccacgatggacgccatcgccggcgtcacctacccgcgcgccatgatgcacccctccttcgccgggatcatcgacctgcacctccccaacggcgcgggggccaccatcgccgacgcccacggcctgttcatgatcgagttcagcaagaccatcaacccctccctgcggacgaagcaggccaacgaggtggcggccaccttcgagaagccgaacatggccgccatgagcggccgcttcttcacccgggaggacaagaagaagctgctcatcgccgtggggatcatcgacgaggacctggtcctggcgtccgccgtggtgcgcagcgccgagaagtaccgggccaaggtcggcaagtga

SEQ ID NO: 6930 - RNA, 762 nt, synthetic construct
  misc_feature 1..762: note = derived and/or modified CDS sequence (opt1) from TOSV(TOSV/Firenze.ITA/1983/2)__KM275765.1__N
  source 1..762: mol_type = other RNA
atgagcgacgagaactaccgcgacatcgccctggccttcctcgacgagtgcgcggactccggcaccatcaacgcctgggtgaacgagttcgcctaccaggggttcgaccccaagcggatcgtccagctggtgaaggagcgcggcaccgccaaggggcgggactggaagaaggacgtgaagatgatgatcgtcctgaacctcgtgcgcggcaacaagccggaggccatgatgaagaagatgagcgagaagggggcgtccatcgtggccaacctgatcagcgtctaccagctgaaggagggcaaccccggccgggacacgatcaccctctcccgcgtgagcgccgccttcgtgccctggaccgtccaggcgctgcgggtgctgtccgagagcctccccgtgtccgggaccacgatggacgccatcgccggcgtcacctacccgcgcgccatgatgcaccccagcttcgccgggatcatcgacctggacctgcccaacggcgcgggggccaccatcgccgacgcccacggcctcttcatgatcgagttctccaagaccatcaaccccagcctgcggacgaagcaggccaacgaggtggcggccaccttcgagaagccgaacatggccgccatgtccggccgcttcttcacccgggaggacaagaagaagctgctcatcgccgtggggatcatcgacgaggacctggtcctggcgagcgccgtggtgcgctccgccgagaagtaccgggccaaggtcggcaagtga

SEQ ID NO: 6931 - RNA, 738 nt, synthetic construct
  misc_feature 1..738: note = derived and/or modified CDS sequence (opt1) from SFTSV(HB29)__NC_018137.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcggggcgcctccaagacggaggtgtacaacagcttccgcgaccccctccacgcggccgtcaactccgtgttcttcccgaacgacgtgcgggtcaagtggctgaaggccaaggggatcctgggccccgacggcgtgcccagccgcgccgccgaggtggcggccgccgcctaccggaacctctga

SEQ ID NO: 6932 - RNA, 738 nt, synthetic construct
  misc_feature 1..738: note = derived and/or modified CDS sequence (opt1) from SFTSV(111S)__KP339904.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccgcgccctgatcatcaagaagctgaaggagaccggcggggacgactgggtcaaggacacgaagttcatcatcgtgttcgccctcacccggggcaacaagatcgtgaaggccagcgggaagatgtccaacagcggctccaagcgcctgatggccctgcaggagaagtacggcctcgtcgagcgggcggagacccgcctgagcatcacccccgtgcgggtggcccagtccctgccgacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcgcggcgcctccaagacggaggtgtacaacagcttccgggaccccctccacgcggccgtcaactccgtgttcttccccaacgacgtgcgcgtcaagtggctgaaggccaaggggatcctgggcccggacggcgtgcccagccgggccgccgaggtggcggccgccgcctaccgcaacctctga

SEQ ID NO: 6933 - RNA, 738 nt, synthetic construct
  misc_feature 1..738: note = derived and/or modified CDS sequence (opt1) from SFTSV(116S)__KP339905.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcggggcgcctccaagacggagatctacaacagcttccgcgaccccctccacgcggccgtgaactccgtcttcttcccgaacgacgtgcgggtgaagtggctgaaggccaaggggatcctgggccccgacggcgtccccagccgcgccgccgaggtggcggccgccgcctaccggaacctctga

SEQ ID NO: 6934 - RNA, 738 nt, synthetic construct
  misc_feature 1..738: note = derived and/or modified CDS sequence (opt1) from SFTSV(132S)__KP339912.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcagcgtgttcgccctcacccgcggcaacaagatcgtgaaggcctccgggaagatgagcaactccggcagcaagcggctgatggccctgcaggagaagtacggcctcgtcgagcgcgcggagacccggctgtccatcaccccggtgcgcgtggcccagagcctgcccacgtggacctgcgccgccgcggccgccctcaaggagtacctgcccgtcgggcccgccgtgatgaacctgaaggtggagaactacccgcccgagatgatgtgcatggccttcggctccctcatccccaccgcgggggtcagcgaggccaccacgaagaccctgatggaggcctactccctgtggcaggacgccttcaccaagaccatcaacgtgaagatgcggggcgccagcaagacggaggtgtacaactccttccgcgaccccctccacgcggccgtcaacagcgtgttcttcccgaacgacgtgcgggtcaagtggctgaaggccaaggggatcctgggccccgacggcgtgccctcccgcgccgccgaggtggcggccgccgcctaccggaacctctga

SEQ ID NO: 6935 - RNA, 738 nt, synthetic construct
  misc_feature 1..738: note = derived and/or modified CDS sequence (opt1) from SFTSV(2014045S)__KR075923.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcggggcgcctccaagacggaggtgtacaacagcttccgcgaccccctccacgcggccgtcaactccgtgttcttcccgaacgacgtgcgggtcaagtggctgaaggccaaggggatcctgggccccgacggcgcccccagccgcgccgcggaggtggccgccgccgcctaccggaacctctga

SEQ ID NO: 6936 - RNA, 738 nt, synthetic construct
  misc_feature 1..738: note = derived and/or modified CDS sequence (opt1) from SFTSV(2014193S)__KR075916.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcgtgaccccggtgcgcgtcgcccagtccctgcccacgtggacctgcgccgccgcggccgccctcaaggagtacctgcccgtggggcccgccgtgatgaacctgaaggtcgagaactacccgcccgagatgatgtgcatggccttcggcagcctcatccccaccgcgggggtgtccgaggccaccacgaagaccctgatggaggcctacagcctgtggcaggacgccttcaccaagaccatcaacgtgaagatgcggggcgcctccaagacggaggtctacaacagcttccgcgaccccctccacgcggccgtgaactccgtgttcttcccgaacgacgtccgggtgaagtggctgaaggccaaggggatcctgggccccgacggcgtgcccagccgcgccgccgaggtcgcggccgccgcctaccggaacctctga

SEQ ID NO: 6937 - RNA, 738 nt, synthetic construct
  misc_feature 1..738: note = derived and/or modified CDS sequence (opt1) from SFTSV(2015SH232S)__KT736097.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcggggcgcctccaagacggaggtgtacaacagcttccgcgaccccctccacgcggccgtcaactccgtgttcttcccgaacgacgtgcgggtccgctggctgaaggccaaggggatcctgggccccgacggcgtgcccagccgggccgccgaggtggcggccgccgcctaccgcaacctctga

SEQ ID NO: 6938 - RNA, 738 nt, synthetic construct
  misc_feature 1..738: note = derived and/or modified CDS sequence (opt1) from SFTSV(2015SYSH33)__KT380653.1__N
  source 1..738: mol_type = other RNA
atgagcgagtggtcccgcatcgccgtggagttcggcgagcagcagctcaacctgaccgagctggaggacttcgcccgggagctcgcgtacgaggggctggaccccgccctgatcatcaagaagctcaaggagaccggcggggacgactgggtcaaggacacgaagttcatcatcgtgttcgccctgacccgcggcaacaagatcgtgaaggccagcgggaagatgtccaacagcggctccaagcggctgatggccctccaggagaagtacggcctggtcgagcgcgcggagacccggctgagcatcaccccggtgcgcgtggcccagtccctccccacgtggacctgcgccgccgcggccgccctgaaggagtacctgcccgtcgggcccgccgtgatgaacctcaaggtggagaactacccgcccgagatgatgtgcatggccttcggcagcctgatccccaccgcgggggtctccgaggccaccacgaagaccctgatggaggcctacagcctctggcaggacgccttcaccaagaccatcaacgtgaagatgcggggcgcctccaagacggaggtgtacaacagcttccgcgaccccctgcacgcggccgtcaactccgtgttcttcccgaacgacgtgcgggtcaagtggctgaaggccaaggggatcctcggccccgacggcgtgcccagccgcgccgccgaggtggcggccgccgcctaccggaacctgtga

SEQ ID NO: 6939 - RNA, 738 nt, synthetic construct
  misc_feature 1..738: note = derived and/or modified CDS sequence (opt1) from SFTSV(2015SYSH86)__KT380657.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcatcaaggccagcgggaagatgtccaacagcggctccaagcggctgatggccctgcaggagaagtacggcctcgtggagcgcgcggagacccggctgagcatcaccccggtccgcgtggcccagtccctgcccacgtggacctgcgccgccgcggccgccctcaaggagtacctgcccgtggggcccgccgtcatgaacctgaaggtggagaactacccgcccgagatgatgtgcatggccttcggcagcctcatccccaccgcgggggtgtccgaggccaccacgaagaccctgatggaggcctacagcctgtggcaggacgccttcaccaagaccatcaacgtcaagatgcggggcgcctccaagacggaggtgtacaacagcttccgcgaccccctccacgcggccgtgaactccgtcttcttcccgaacgacgtgcgggtgaagtggctgaaggccaaggggatcctgggccccgacggcgtccccagccgcgccgccgaggtggcggccgccgcctaccggaacctctga

SEQ ID NO: 6940 - RNA, 738 nt, synthetic construct
  misc_feature 1..738: note = derived and/or modified CDS sequence (opt1) from SFTSV(67S)__KP339890.1__N
  source 1..738: mol_type = other RNA
atgagcgagtggtcccgcatcgccgtggagttcgccgagcagcagctgaacctcaccgagctggaggacttcgcgcgggagctggcctacgagggcctcgaccccgccctgatcatcaagaagctgaaggagaccgggggcgacgactgggtcaaggacacgaagttcatcatcgtgttcgccctcacccgcgggaacaagatcgtgaaggccagcggcaagatgtccaacagcgggtccaagcggctgatggcgctgcaggagaagtacggcctcgtcgagcgcgccgagacccggctgagcatcaccccggtgcgcgtggcccagtccctgcccacgtggacctgcgccgcggccgccgccctcaaggagtacctgcccgtcggccccgccgtgatgaacctgaaggtggagaactacccgcccgagatgatgtgcatggcgttcgggagcctcatccccaccgccggcgtctccgaggccaccacgaagaccctgatggaggcctacagcctgtggcaggacgccttcaccaagaccatcaacgtgaagatgcgcggggcgtccaagacggaggtgtacaacagcttccgggaccccctccacgccgccgtcaactccgtgttcttcccgaacgacgtgcgggtcaagtggctgaaggccaagggcatcctggggcccgacggcgtgcccagccgcgccgcggaggtggccgccgccgcctaccggaacctctga

SEQ ID NO: 6941 - RNA, 738 nt, synthetic construct
  misc_feature 1..738: note = derived and/or modified CDS sequence (opt1) from SFTSV(6S)__KP339927.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggttcagcatcaccccggtgcgcgtggcccagtccctgcccacgtggacctgcgccgccgcggccgccctgaaggagtacctccccgtcgggcccgccgtgatgaacctgaaggtggagaactacccgcccgagatgatgtgcatggccttcggcagcctgatccccaccgcgggggtctccgaggccaccacgaagaccctcatggaggcctacagcctgtggcaggacgccttcaccaagaccatcaacgtgaagatgcggggcgcctccaagacggaggtgtacaacagcttccgcgaccccctgcacgcggccgtcaactccgtgttcttcccgaacgacgtgcgggtcaagtggctcaaggccaaggggatcctgggccccgacggcgtgcccagccgcgccgccgaggtggcggccgccgcctaccggaacctgtga

SEQ ID NO: 6942 - RNA, 738 nt, synthetic construct
  misc_feature 1..738: note = derived and/or modified CDS sequence (opt1) from SFTSV(72S)__KP339891.1__N
  source 1..738: mol_type = other RNA
atgagcgagtggtcccgcatcgccgtggagttcggcgagcagcagctgaccctcaccgagctggaggacttcgcccgggagctggcgtacgaggggctcgaccccgccctgatcatcaagaagctgaaggagacgggcggggacgactgggtcaaggacaccaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcacgccggtgcgcgtggcccagtccctgcccacctggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccacgaccaagaccctgatggaggcctacagcctgtggcaggacgccttcaccaagacgatcaacgtgaagatgcggggcgcctccaagaccgaggtgtacaacagcttccgcgaccccctccacgcggccgtcaactccgtgttcttcccgaacgacgtgcgggtccgctggctgaaggccaaggggatcctgggccccgacggcgtgcccagccgggccgccgaggtggcggccgccgcctaccgcaacctctga

SEQ ID NO: 6943 - RNA, 738 nt, synthetic construct
  misc_feature 1..738: note = derived and/or modified CDS sequence (opt1) from SFTSV(AP01-Korea-13)__KR612072.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtccgcgacacgaagttcatcatcgtgttcgccctcacccggggcaacaagatcgtgaaggccagcgggaagatgtccaacagcggctccaagcgcctgatggccctgcaggagaagtacggcctcgtcgagcgggcggagacccgcctgagcatcaccccggtgcgggtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcgcggcgcctccaagacggaggtgtacaacagcttccgggaccccctccacgcggccgtcaactccgtgttcttcccgaacgacgtgcgcgtcaagtggctgaaggccaaggggatcctgggccccgacggcgtgcccagccgggccgccgaggtggcggccgccgcctaccgcaacctctga

SEQ ID NO: 6944 - RNA, 738 nt, synthetic construct
  misc_feature 1..738: note = derived and/or modified CDS sequence (opt1) from SFTSV(JP03-Korea-13)__KR612079.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtccgcgacacgaagttcatcatcgtgttcgccctcacccggggcaacaagatcgtgaaggccagcgggaagatgtccaacagcggctccaagcgcctgatggccctgcaggagaagtacggcctcgtcgagcgggcggagacccgcctgagcatcaccccggtgcgggtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcgcggcgcctccaagacggaggtgtacaacagcttccgggaccccctccacgcggccgtcaactccgtgttcttcccgaacgacgtgcgcgtcaagtggctgaaggccaaggggatcctgggccccgacggcatccccagccgggccgccgaggtggcggccgccgcctaccgcaacctctga

SEQ ID NO: 6945 - RNA, 738 nt, synthetic construct
  misc_feature 1..738: note = derived and/or modified CDS sequence (opt1) from SFTSV(JP07-Korea-13)__KR612088.1__N
  source 1..738: mol_type = other RNA
atgagcgagtggtcccgcatcgccgtggagttcggcgagcaccagctgaacctcaccgagctggaggacttcgcccgggagctggcgtacgaggggctcgaccccgccctgatcatcaagaagctgaaggagaccggcggggacgactgggtccgcgacacgaagttcatcatcgtgttcgccctcacccggggcaacaagatcgtgaaggccagcgggaagatgtccaacagcggctccaagcgcctgatggccctgcaggagaagtacggcctcgtcgagcgggcggagacccgcctgagcatcaccccggtgcgggtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcgcggcgcctccaagacggaggtgtacaacagcttccgggaccccctccacgcggccgtcaactccgtgttcttcccgaacgacgtgcgcgtcaagtggctgaaggccaaggggatcctgggccccgacggcgtgcccagccgggccgccgaggtggcggccgccgcctaccgcaacctctga

SEQ ID NO: 6946 - RNA, 738 nt, synthetic construct
  misc_feature 1..738: note = derived and/or modified CDS sequence (opt1) from SFTSV(JS2011-13-2)__KR230790.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccagctccggcagcaagcggctgatggccctgcaggagaagtacggcctcgtcgagcgcgcggagacccggctgtccatcaccccggtgcgcgtggcccagagcctgcccacgtggacctgcgccgccgcggccgccctcaaggagtacctgcccgtcgggcccgccgtgatgaacctgaaggtggagaactacccgcccgagatgatgtgcatggccttcggctccctcatccccaccgcgggggtcagcgaggccaccacgaagaccctgatggaggcctactccctgtggcaggacgccttcaccaagaccatcaacgtgaagatgcggggcgccagcaagacggaggtgtacaactccttccgcgaccccctccacgcggccgtcaacagcgtgttcttcccgaacgacgtgcgggtcaagtggctgaaggccaaggggatcctgggccccgacggcgtgccctcccgcgccgccgaggtggcggccgccgcctaccggaacctctga

SEQ ID NO: 6947 - RNA, 738 nt, synthetic construct
  misc_feature 1..738: note = derived and/or modified CDS sequence (opt1) from SFTSV(JS2014-15)__KR230799.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgctggtcgggcccgccgtgatgaacctcaaggtggagaactacccgcccgagatgatgtgcatggccttcggcagcctgatccccaccgcgggggtctccgaggccaccacgaagaccctgatggaggcctacagcctctggcaggacgccttcaccaagaccatcaacgtgaagatgcggggcgcctccaagacggaggtgtacaacagcttccgcgaccccctgcacgcggccgtcaactccgtgttcttccccaacgacgtgcgggtcaagtggctgaaggccaaggggatcctcggcccggacggcgtgcccagccgcgccgccgaggtggcggccgccgcctaccggaacctgtga

SEQ ID NO: 6948 - RNA, 738 nt, synthetic construct
  misc_feature 1..738: note = derived and/or modified CDS sequence (opt1) from SFTSV(KASJH)__KP663733.1__N
  source 1..738: mol_type = other RNA
atgagcgagtggtcccgcatcgccgtggagttcggcgagcagcagctgaacctcagcgagctggaggacttcgcccgggagctggcgtacgaggggctcgaccccgccctgatcatcaagaagctgaaggagaccggcggggacgactgggtcaaggacaccaagttcatcatcgtgttcgccctcacgcgcggcaacaagatcgtgaaggcctccgggaagatgagcaactccggcagcaagcggctgatggccctgcaggagaagtacggcctcgtcgagcgcgcggagacccggctgtccatcaccccggtgcgcgtggcccagagcctgcccacctggacgtgcgccgccgcggccgccctcaaggagtacctgcccgtcgggcccgccgtgatgaacctgaaggtggagaactacccgcccgagatgatgtgcatggccttcggctccctcatccccaccgcgggggtcagcgaggccaccaccaagacgctgatggaggcctactccctgtggcaggacgccttcaccaagaccatcaacgtgaagatgcggggcgccagcaagaccgaggtgtacaactccttccgcgaccccctccacgcggccgtcaacagcgtgttcttcccgaacgacgtgcgggtcaagtggctgaaggccaaggggatcctgggccccgacggcgtgccctcccgcgccgccgaggtggcggccgccgcctaccggaacctctga

SEQ ID NO: 6949 - RNA, 738 nt, synthetic construct
  misc_feature 1..738: note = derived and/or modified CDS sequence (opt1) from SFTSV(YSH116)__KT721303.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgtgttcaccaagaccatcaacgtgaagatgcggggcgcctccaagacggaggtctacaacagcttccgcgaccccctccacgccgcggtgaactccgtgttcttcccgaacgacgtccgggtgaagtggctgaaggccaaggggatcctgggccccgacggcgtgcccagccgcgccgccgaggtcgccgcggccgcctaccggaacctctga

SEQ ID NO: 6950 - RNA, 738 nt, synthetic construct
  misc_feature 1..738: note = derived and/or modified CDS sequence (opt1) from SFTSV(AH-YTY/China/05/2012)__KR017811.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccaccggggtctccgaggcgacgaccaagaccctgatggaggcctacagcctgtggcaggacgccttcaccaagacgatcaacgtgaagatgcggggcgcctccaagaccgaggtgtacaacagcttccgcgaccccctccacgccgcggtcaactccgtgttcttcccgaacgacgtgcgggtcaagtggctgaaggccaaggggatcctgggccccgacggcgtgcccagccgcgccgccgaggtggccgcggccgcctaccggaacctctga

SEQ ID NO: 6951 - RNA, 738 nt, synthetic construct
  misc_feature 1..738: note = derived and/or modified CDS sequence (opt1) from SFTSV(DS02/CHN/2013)__KR698319.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtccgcgacacgaagttcatcatcgtgttcgccctcacccggggcaacaagatcgtgaaggccagcgggaagatgtccaacagcggctccaagcgcctgatggccctgcaggagaagtacggcctcgtcgagaaggcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcggggcgcctccaagacggaggtgtacaacagcttccgcgaccccctccacgcggccgtcaactccgtgttcttcccgaacgacgtgcgggtcaagtggctgaaggccaaggggatcctgggccccgacggcgtgcccagccgcgccgccgaggtggcggccgccgcctaccggaacctctga

SEQ ID NO: 6952 - RNA, 738 nt, synthetic construct
  misc_feature 1..738: note = derived and/or modified CDS sequence (opt1) from SFTSV(HB2014-13)__KU738908.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccaccggggtctccgaggcgacgaccaagaccctgatggaggcctacagcctgtggcaggacgccttcaccaagacgatcaacgtgaagatgcggggcgcctccaagaccgaggtgtacaacagcttccgcgaccccctccacgccgcggtcaactccgtgttcttcccgaacgacgtgcgggtccgctggctgaaggccaaggggatcctgggccccgacggcgtgcccagccgggccgccgaggtggccgcggccgcctaccgcaacctctga

SEQ ID NO: 6953 - RNA, 738 nt, synthetic construct
  misc_feature 1..738: note = derived and/or modified CDS sequence (opt1) from SFTSV(HB2014-20)__KU738910.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatgaccctgcaggagaagtacggcctcgtcgagcgcgccgagacccggctgagcatcacgccggtgcgcgtggcgcagtccctgcccacctggacctgcgccgccgccgcggccctcaaggagtacctgcccgtcgggcccgccgtgatgaacctgaaggtggagaactacccgcccgagatgatgtgcatggccttcggcagcctcatccccaccgccggggtctccgaggcgacgaccaagaccctgatggaggcctacagcctgtggcaggacgccttcaccaagacgatcaacgtgaagatgcggggcgcctccaagaccgaggtgtacaacagcttccgcgaccccctccacgccgcggtcaactccgtgttcttcccgaacgacgtgcgggtcaagtggctgaaggccaaggggatcctgggccccgacggcgtgcccagccgcgccgccgaggtggccgcggccgcctaccggaacctctga

SEQ ID NO: 6954 - RNA, 738 nt, synthetic construct
  misc_feature 1..738: note = derived and/or modified CDS sequence (opt1) from SFTSV(LN2012-14)__KF887431.1__N
  source 1..738: mol_type = other RNA
atgagcgagcgctcccggatcgccgtggagttcggcgagcagcagctgaacctcaccgggctggaggacttcgcccgcgagctggcgtacgagggcctcgaccccgccctgatcatcaagaagctgaaggagaccgggggcgacgactgggtcaaggacacgaagttcatcatcgtgttcgccctcacccgggggaacaagatcgtgaaggccagcggcaagatgtccaacagcggctccaagcgcctgatggccctgcaggagaagtacgggctcgtcgagcgggcggagacccgcctgagcatcaccccggtgcgggtggcccagtccctgcccacgtggacctgcgccgccgcggccgccctcaaggagtacctgcccgtcggccccgccgtgatgaacctgaaggtggagaactacccgcccgagatgatgtgcatggccttcgggagcctcatccccaccgcgggcgtctccgaggccaccacgcgcaccctgatggaggcctacagcctgtggcaggacgccttcaccaagaccatcaacgtgaagatgcgcggggcctccaagacggaggtgtacaacagcttccgggaccccctccacgcggccgtcaactccgtgttcttcccgaacgacgtgcgggtcaagtggctgaaggccaagggcatcctgggccccgacggggtgcccagccgcgccgccgaggtggcggccgccgcctaccggaacctctga

SEQ ID NO: 6955 - RNA, 738 nt, synthetic construct
  misc_feature 1..738: note = derived and/or modified CDS sequence (opt1) from SFTSV(NB31/CHN/2013)__KR698325.1__N
  source 1..738: mol_type = other RNA
atgagcgagtggtcccgcatcgccgtggagttcggcgagcagcagctgaacctcatcgagctggaggacttcgcccgggagctggcgtacgaggggctcgaccccgccctgatcatcaagaagctgaaggagaccggcggggacgactgggtccgcgacaccaagttcatcatcgtgttcgccctcacgcggggcaacaagatcgtgaaggccagcgggaagatgtccaacagcggctccaagcgcctgatggccctgcaggagaagtacggcctcgtcgagaaggcggagacccggctgagcatcaccccggtgcgcgtggcccagtccctgcccacctggacgtgcgccgccgcggccgccctcaaggagtacctgcccgtcgggcccgccgtgatgaacctgaaggtggagaactacccgcccgagatgatgtgcatggccttcggcagcctcatccccaccgcgggggtctccaagcccaccaccaagacgctgatggaggcctacagcctgtggcaggacgccttcaccaagaccatcaacgtgaagatgcggggcgcctccaagaccgaggtgtacaacagcttccgcgacccgctccacgccgcggtcaactccgtgttcttccccaacgacgtgcgggtcaagtggctgaaggccaaggggatcctgggccccgacggcgtgcccagccgcgccgccgaggtggccgcggccgcctaccggaacctctga

SEQ ID NO: 6956 - RNA, 738 nt, synthetic construct
  misc_feature 1..738: note = derived and/or modified CDS sequence (opt1) from SFTSV(QD7)__KR706565.1__N
  source 1..738: mol_type = other RNA
atgagcgagtggtcccgcatcgccgtggagttcggcgtccagcagctgaacctcaccgagctggaggacttcgcccgggagctggcgtacgaggggctcgaccccgccctgatcatcaagaagctgaaggagaccggcggggacgactgggtgaaggacacgaagttcatcatcgtgttcgccctcacccgcggcaacaagatcgtcaaggccagcgggaagatgtccaacagcggctccaagcggctgatggccctgcaggagaagtacggcctcgtggagcgcgcggagacccggctgagcatcaccccggtgcgcgtcgcccagtccctgcccacgtggacctgcgccgccgcggccgccctcaaggagtacctgcccgtggggcccgccgtgatgaacctgaaggtcgagaactacccgcccgagatgatgtgcatggccttcggcagcctcatccccaccgcgggggtgtccgaggccaccacgaagaccctgatggaggcctacagcctgtggcaggacgccttcaccaagaccatcaacgtgaagatgcggggcgcctccaagacggaggtctacaacagcttccgcgaccccctccacgcggccgtgaactccgtgttcttcccgaacgacgtccgggtgaagtggctgaaggccaaggggatcctgggccccgacggcgtgcccagccgcgccgccgaggtcgcggccgccgcctaccggaacctctga

SEQ ID NO: 6957 - RNA, 738 nt, synthetic construct
  misc_feature 1..738: note = derived and/or modified CDS sequence (opt1) from SFTSV(SDLZP06/2011)__JQ693009.1__N
  source 1..738: mol_type = other RNA
atgagcgagtggtcccgcaccgccgtggagttcggcgagcagcagctgaacctcaccgagctggaggacttcgcccgggagctggcgtacgaggggctcgaccccgccctgatcatcaagaagctgaaggagacgggcggggacgactgggtcaaggacaccaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcacgccggtgcgcgtggcccagtccctgcccacctggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccacgaccaagaccctgatggaggcctacagcctgtggcaggacgccttcaccaagacgatcaacgtgaagatgcggggcgcctccaagaccgaggtgtacaacagcttccgcgaccccctccacgcggccgtcaactccgtgttcttcccgaacgacgtgcgggtcaagtggctgaaggccaaggggatcctgggccccgacggcgtgcccagccgcgccgccgaggtggcggccgccgcctaccggaacctctga

SEQ ID NO: 6958 - RNA, 738 nt, synthetic construct
  misc_feature 1..738: note = derived and/or modified CDS sequence (opt1) from SFTSV(ZJZHSH-FDE/China/06/2012)__KR017821.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtccgcgacacgaagttcatcatcgtgttcgccctcacccggggcaacaagatcgtgaaggccagcgggaagatgtccaacagcggctccaagcgcctgatggccctgcaggagaagtacggcctcgtcgagaaggcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcggggcgcctccaagacggaggtgtacaacagcttccgcgaccccctccacgcggccgtcaactccgtgctgttcccgaacgacgtgcgggtcaagtggctgaaggccaaggggatcctcggccccgacggcgtgcccagccgcgccgccgaggtggcggccgccgcctaccggaacctgtga

SEQ ID NO: 6959 - RNA, 738 nt, synthetic construct
  misc_feature 1..738: note = derived and/or modified CDS sequence (opt1) from SFTSV(ZJZHSH-FZHR/China/07/2013)__KR017824.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactggatgaaggacacgaagttcatcatcgtcttcgccctcacccgcggcaacaagatcgtgaaggccagcgggaagatgtccaacagcggctccaagcggctgatggccctgcaggagaagtacggcctcgtggagcgcgcggagacccggctgagcatcaccccggtccgcgtggcccagtccctgcccacgtggacctgcgccgccgcggccgccctcaaggagtacctgcccgtggggcccgccgtcatgaacctgaaggtggagaactacccgcccgagatgatgtgcatggccttcggcagcctcatccccaccgcgggggtgtccgaggccaccacgaagaccctgatggaggcctacagcctgtggcaggacgccttcaccaagaccatcaacgtcaagatgcggggcgcctccaagacggaggtgtacaacagcttccgcgaccccctccacgcggccgtgaactccgtcttcttcccgaacgacgtgcgggtgaagtggctgaaggccaaggggatcctgggccccgacggcgtccccagccgcgccgccgaggtggcggccgccgcctaccggaacctctga

SEQ ID NO: 6960 - RNA, 738 nt, synthetic construct
  misc_feature 1..738: note = derived and/or modified CDS sequence (opt1) from SFTSV(ZJZHSH-HYC/China/05/2012)__KR017809.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtccgcgacacgaagttcatcatcgtgttcgccctcacccggggcaacaagatcgtgaaggccagcgggaagatgtccaacagcggctccaagcgcctgatggccctgcaggagaagtacggcctcgtcgagaaggcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgtcggggtgtccgaggcgaccacgaagaccctgatggaggcctacagcctgtggcaggacgccttcaccaagaccatcaacgtgaagatgcggggcgcctccaagacggaggtctacaacagcttccgcgaccccctccacgccgcggtgaactccgtgttcttcccgaacgacgtccgggtgaagtggctgaaggccaaggggatcctgggccccgacggcgtgcccagccgcgccgccgaggtcgccgcggccgcctaccggaacctctga

SEQ ID NO: 6961 - RNA, 738 nt, synthetic construct
  misc_feature 1..738: note = derived and/or modified CDS sequence (opt1) from SFTSV(SPL003A)__AB817996.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtccgcgacacgaagttcatcatcgtgttcgccctcacccggggcaacaagatcgtgaaggccagcgggaagatgtccaacagcggctccaagcgcctgatggccctgcaggagaagtacggcctcgtcgagcgggcggagacccgcctgagcatcaccccggtgcgggtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcgcggcgcctccaagacggaggtgtacaacagcttccgggaccccctccacgcggccgtcaactccgtgttcttcccgaacgacgtgcgcgtcaagtggctgaaggccaaggggatcctgggccccgacggcgcccccagccgggccgcggaggtggccgccgccgcctaccgcaacctctga

SEQ ID NO: 6962 - RNA, 738 nt, synthetic construct
  misc_feature 1..738: note = derived and/or modified CDS sequence (opt1) from SFTSV(SPL077A)__AB985536.1__N
  source 1..738: mol_type = other RNA
atgagcgagtggccccgcatcgccgtggagttcggcgagcagcagctgaacctcaccgagctggaggacttcgcccgggagctggcgtacgaggggctcgacccggccctgatcatcaagaagctgaaggagaccggcggggacgactgggtccgcgacacgaagttcatcatcgtgttcgccctcacccggggcaacaagatcgtgaaggcctccgggaagatgagcaactccggcagcaagcgcctgatggccctgcaggagaagtacggcctcgtcgagcgggcggagacccgcctgtccatcacccccgtgcgggtggcccagagcctgcccacgtggacctgcgccgccgcggccgccctcaaggagtacctgcccgtcgggccggccgtgatgaacctgaaggtggagaactacccgcccgagatgatgtgcatggccttcggctccctcatccccaccgcgggggtcagcgaggccaccacgaagaccctgatggaggcctactccctgtggcaggacgccttcaccaagaccatcaacgtgaagatgcgcggcgccagcaagacggaggtgtacaactccttccgggaccccctccacgcggccgtcaacagcgtgttcttccccaacgacgtgcgcgtcaagtggctgaaggccaaggggatcctgggccccgacggcgtgccctcccgggccgccgaggtggcggccgccgcctaccgcaacctctga

SEQ ID NO: 6963 - RNA, 738 nt, synthetic construct
  misc_feature 1..738: note = derived and/or modified CDS sequence (opt1) from SFTSV(SPL106A)__AB985548.1__N
  source 1..738: mol_type = other RNA
atgagcgactggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtccgcgacacgaagttcatcatcgtgttcgccctcacccggggcaacaagatcgtgaaggccagcgggaagatgtccaacagcggctccaagcgcctgatggccctgcaggagaagtacggcctcgtcgagcgggcggagacccgcctgagcatcaccccggtgcgggtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcgcggcgcctccaagacggaggtgtacaacagcttccgggaccccctccacgcggccgtcaactccgtgttcttcccgaacgacgtgcgcgtcaagtggctgaaggccaaggggatcctgggccccgacggcgtgcccagccgggccgccgaggtggcggccgccgcctaccgcaacctctga

SEQ ID NO: 6964 - RNA, 738 nt, synthetic construct
  misc_feature 1..738: note = derived and/or modified CDS sequence (opt1) from SFTSV(SPL114A)__AB985552.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtccgcgacacgaagttcatcatcgtgttcgccctcacccggggcaacaagatcgtgaaggccccggggaagatgagcaactccggcagcaagcgcctgatggccctgcaggagaagtacggcctcgtcgagcgggcggagacccgcctgtccatcacccccgtgcgggtggcccagagcctgcccacgtggacctgcgccgccgcggccgccctcaaggagtacctgcccgtcgggccggccgtgatgaacctgaaggtggagaactacccgcccgagatgatgtgcatggccttcggctccctcatccccaccgcgggggtcagcgaggccaccacgaagaccctgatggaggcctactccctgtggcaggacgccttcaccaagaccatcaacgtgaagatgcgcggcgccagcaagacggaggtgtacaactccttccgggaccccctccacgcggccgtcaacagcgtgttcttccccaacgacgtgcgcgtcaagtggctgaaggccaaggggatcctgggccccgacggcgtgccctcccgggccgccgaggtggcggccgccgcctaccgcaacctctga

SEQ ID NO: 6965 - RNA, 738 nt, synthetic construct
  misc_feature 1..738: note = derived and/or modified CDS sequence (opt1) from SFTSV(SPL125A)__AB985557.1__N
  source 1..738: mol_type = other RNA
atgagcgagtggtccggcgtggccgtcgagttcggggagcagcagctgaacctcaccgagctggaggacttcgcccgcgagctggcgtacgagggcctcgaccccgccctgatcatcaagaagctgaaggagaccgggggcgacgactgggtgcgggacacgaagttcatcatcgtgttcgccctcacccgcgggaacaagatcgtcaaggccagcggcaagatgtccaacagcggctccaagcggctgatggccctgcaggagaagtacgggctcgtggagcgcgcggagacccggctgagcatcaccccggtgcgcgtcgcccagtccctgcccacgtggacctgcgccgccgcggccgccctcaaggagtacctgcccgtgggccccgccgtgatgaacctgaaggtcgagaactacccgcccgagatgatgtgcatggccttcgggagcctcatccccaccgcgggcgtgtccgaggccaccacgaagaccctgatggaggcctacagcctgtggcaggacgccttcaccaagaccatcaacgtgaagatgcgcggggcctccaagacggaggtctacaacagcttccgggaccccctccacgcggccgtgaactccgtgttcttcccgaacgacgtccgggtgaagtggctgaaggccaagggcatcctgggccccgacggggtgcccagccgcgccgccgaggtcgcggccgccgcctaccggaacctctga

SEQ ID NO: 6966 - RNA, 738 nt, synthetic construct
  misc_feature 1..738: note = derived and/or modified CDS sequence (opt1) from SFTSV(SPL160A)__AB985571.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaccaagctgaaggagacgggcggggacgactgggtccgcgacaccaagttcatcatcgtgttcgccctcacccggggcaacaagatcgtgaaggccagcgggaagatgtccaacagcggctccaagcgcctgatggccctgcaggagaagtacggcctcgtcgagcgggcggagacccgcctgagcatcacgccggtgcgggtggcccagtccctgcccacctggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccacgaccaagaccctgatggaggcctacagcctgtggcaggacgccttcaccaagacgatcaacgtgaagatgcgcggcgcctccaagaccgaggtgtacaacagcttccgggaccccctccacgcggccgtcaactccgtgttcttcccgaacgacgtgcgcgtcaagtggctgaaggccaaggggatcctgggccccgacggcgtgcccagccgggccgccgaggtggcggccgccgcctaccgcaacctctga

SEQ ID NO: 6967 - RNA, 738 nt, synthetic construct
  misc_feature 1..738: note = derived and/or modified CDS sequence (opt1) from SFTSV(SPL163A)__AB985573.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtccgcgacacgaagttcatcatcgtgttcccgctcacccggggcaacaagatcgtgaaggccagcgggaagatgtccaacagcggctccaagcgcctgatggccctgcaggagaagtacggcctcgtcgagcgggccgagacccgcctgagcatcacccccgtgcgggtggcgcagtccctgcccacgtggacctgcgccgccgccgcggccctcaaggagtacctgcccgtcgggccggccgtgatgaacctgaaggtggagaactacccgcccgagatgatgtgcatggccttcggcagcctcatccccaccgccggggtctccgaggcgaccacgaagaccctgatggaggcctacagcctgtggcaggacgccttcaccaagaccatcaacgtgaagatgcgcggcgcctccaagacggaggtgtacaacagcttccgggaccccctccacgccgcggtcaactccgtgttcttccccaacgacgtgcgcgtcaagtggctgaaggccaaggggatcctgggccccgacggcgtgcccagccgggccgccgaggtggccgcggccgcctaccgcaacctctga

SEQ ID NO: 6968 - RNA, 738 nt, synthetic construct
  misc_feature 1..738: note = derived and/or modified CDS sequence (opt1) from SFTSV/FTLSV(2011YPQ12)__KF711915.1__N
  source 1..738: mol_type = other RNA
atgagcaagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcgaagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcggggcgcctccaagacggaggtgtacaacagcttccgcgaccccctccacgcggccgtcaactccgtgttcttcccgaacgacgtgcgggtcaagtggctgaaggccaaggggatcctgggccccgacggcgtgcccagcaaggccgccgaggtggcggccgccgcctaccgcaacctctga

SEQ ID NO: 6969 - RNA, 738 nt, synthetic construct
  misc_feature 1..738: note = derived and/or modified CDS sequence (opt1) from SFTSV/FTLSV(2011YXX9)__KF711898.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctggtggaggcctacagcctgtggcaggacgccttcaccaagaccatcaacgtgaagatgcggggcgcctccaagacggaggtctacaacagcttccgcgaccccctccacgcggccgtgaactccgtgttcttcccgaacgacgtccgggtgaagtggctgaaggccaaggggatcctgggccccgacggcgtgcccagccgcgccgccgaggtcgcggccgccgcctaccggaacctctga

SEQ ID NO: 6970 - RNA, 738 nt, synthetic construct
  misc_feature 1..738: note = derived and/or modified CDS sequence (opt1) from SFTSV/FTLSV(YPQ2)__KF356519.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcggggcgcctccaagacggaggtgtacaacagcttccgcgaccccctccacgcggccgtcaactccgtgttcttcccgaacgacgtgcgggtcaagtggctgaaggccaaggggatcctgggccccaacggcgtgcccagccgcgccgccgaggtggcggccgccgcctaccggaacctctga

SEQ ID NO: 6971 - RNA, 738 nt, synthetic construct
  misc_feature 1..738: note = derived and/or modified CDS sequence (opt1) from SFTSV/Guertu virus(DXM)__KT328591.1__N
  source 1..738: mol_type = other RNA
atgagcgagtggtccaagatcgccgtggagttcggcgagcagcagctgaacgtcatcgagctcgaggagttcgcccgcgagctggcgtacgaggggctggaccccgccctcatcatcaagaagctgaaggaggtgggcggggacgactggatgcgggacaccaagttcatcatcgtgttcgccctgacccgcggcaacaagatcctcaaggccgccgggaagatgagcaactccggcagcaagcggatcatggcgctgcaggagaagtacggcctggtcgagcgcgccgagacgcggctctccatcaccccggtgcgcgtggcccagagcctgcccacctggacctgctccgccgcggccgccctgcaggagtacctccccgtcgggcccgccgtgatgagcctgaaggtgtccaacttcccgcccgagatgatgtgcatggccttcggcagcctgatccccgcgacgggggtccccgagtccaccaccaagatcctcatggaggcctacagcctgtggcaggacgccttcaccaagacgatcaacgtgaagatgcggggcgcctccaaggccgaggtgtacaacagcttccgcgacccgctgcacgcggccgtcaactccgtgttcttccccaacgacgtgcggctccgctggctcaagagcaaggggatcctgggccccgacggcctgccctccaaggccgtcgagaccgccgccgcggcctaccggaacctgtga

SEQ ID NO: 6972 - RNA, 738 nt, synthetic construct
  misc_feature 1..738: note = derived and/or modified CDS sequence (opt1) from SFTSV/Huaiyangshan virus(2010-FQM)__HQ419240.1__N
  source 1..738: mol_type = other RNA
atgagcgagtggtcccgcatcgccgtgaagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcggggcgcctccaagacggaggtgtacaacagcttccgcgaccccctccacgcggccgtcaactccgtgttcctgccgaacgacgtgcgggtcaagtggctgaaggccaaggggatcctcggccccgacggcgtgcccagccgcgccgccgaggtggcggccgccgcctaccggaacctgtga

SEQ ID NO: 6973 - RNA, 738 nt, synthetic construct
  misc_feature 1..738: note = derived and/or modified CDS sequence (opt1) from SFTSV/Huaiyangshan virus(2010-ZGQ)__HQ419241.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatgagcctgcaggagaagtacggcctcgtcgagcgcgccgagacccggctgtccatcaccccggtgcgcgtggcgcagagcctgcccacgtggacctgcgccgccgccgcggccctcaaggagtacctgcccgtcgggcccgccgtgatgaacctgaaggtggagaactacccgcccgagatgatgtgcatggccttcggctccctcatccccaccgccggggtcagcgaggcgaccacgcggaccctgatggaggcctactccctgtggcaggacgccttcaccaagaccatcaacgtgaagatgcgcggcgccagcaagacggaggtgtacaactccttccgggaccccctccacgccgcggtcaacagcgtgttcttcccgaacgacgtgcgcgtcaagtggctgaaggccaaggggatcctgggccccgacggcgtgccctcccgggccgccgaggtggccgcggccgcctaccgcaacctctga

SEQ ID NO: 6974 - RNA, 738 nt, synthetic construct
  misc_feature 1..738: note = derived and/or modified CDS sequence (opt1) from SFTSV/Huaiyangshan virus(S-HGX)__HQ171192.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcaccgccgccgcggccctcaaggagtacctgcccgtcgggcccgccgtgatgaacctgaaggtggagaactacccgcccgagatgatgtgcatggccttcgagagcctcatccccaccgccggcgtctccgaggcgacgaccaagaccctgatggaggcctacagcctgtggcaggacgccttcaccaagacgatcaacgtggagatgcgcggggcctccaagaccgaggtgtacaacagcttccgggaccccctccacgccgcggtcaactccgtgttcttcccgaacgacgtgcgggtcaagtggctgaaggccaagggcatcctggggcccgacggcgtgcccagccgcgccgccgaggtggccgcggccgcctaccggaacctctga

SEQ ID NO: 6975 - RNA, 738 nt, synthetic construct
  misc_feature 1..738: note = derived and/or modified CDS sequence (opt1) from SFTSV/Huaiyangshan virus(S-HZM)__HQ171193.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacggagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccaccggggtctccgaggcgacgaccaagaccctgatggaggcctacagcctgtggcaggacgccttcaccaagacgatcaacgtgaagatgcggggcgcctccaagaccgaggtgtacaacagcttccgcgaccccctccacgccgcggtcaactccgtgttcttcccgaacgacctgcgggtgaagtggctgaaggccaaggggatcctcggccccgacggcgtccccagccgcgccgccgaggtggccgcggccgcctaccggaacctgtga

SEQ ID NO: 6976 - RNA, 738 nt, synthetic construct
  misc_feature 1..738: note = derived and/or modified CDS sequence (opt1) from SFTSV/Huaiyangshan virus(S-WJ)__HQ171191.1__N
  source 1..738: mol_type = other RNA
atgagcgagtggtcccgcatcgccgtggagttcggcgagcagcagctgaacctcaccgagctggaggacttcgcccgggagctggcgtacgaggggctcggccccgccctgatcatcaagaagctgaaggagaccgggggcgacgactgggtcaaggacacgaagttcatcatcgtgttcgccctcacccgcgggaacaagatcgtgaaggccagcggcaagatgtccaacagcggctccaagcggctgatggccctgcaggagaagtacgggctcgtcgagcgcgcggagacccggctgagcatcaccccggtgcgcgtggcccagtccctgcccacgtggacctgcgccgccgcggccgccctcaaggagtacctgcccgtcggccccgccgtgatgaacctgaaggtggagaactacccgcccgagatgatgtgcatggccttcgggagcctcatccccaccgcgggcgtctccgaggccaccacgaagaccctgatggaggcctacagcctgtggcaggacgccttcaccaagaccatcaacgtgaagatgcgcggggcctccaagacggaggtgtacaacagcttccgggaccccctccacgcggccgtcaactccgtgttcttcccgaacgacgtgcgggtcaagtggctgaaggccaagggcatcctgggccccgacggggtgcccagccgcgccgccgaggtggcggccgccgcctaccggaacctctga

SEQ ID NO: 6977 - RNA, 738 nt, synthetic construct
  misc_feature 1..738: note = derived and/or modified CDS sequence (opt1) from SFTSV/Phlebovirus(JS2010-019)__JQ317180.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcggggcgcctccaagacggaggtgtacaacagcttccgcgaccccctccacgcggccgtcaactccgtgttcttcccgaacgacgtgcgggtcaagtggctgaaggccaaggggatcctgggccccgacggcgtgcccagccgcgccgccgaggcggccgccgccgcctaccggaacctctga

SEQ ID NO: 6978 - RNA, 738 nt, synthetic construct
  misc_feature 1..738: note = derived and/or modified CDS sequence (opt1) from SFTSV/Phlebovirus(SD24/China/2010 strain SD24)__HM802205.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtcaccgaggccacgaccaagaccctgatggaggcctactccctgtggcaggacgccttcaccaagacgatcaacgtgaagatgcggggcgccagcaagaccgaggtgtacaactccttccgcgaccccctccacgcggccgtcaacagcgtgttcttcccgaacgacgtgcgggtcaagtggctgaaggccaaggggatcctgggccccgacggcgtgccctcccgcgccgccgaggtggcggccgccgcctaccggaacctctga

SEQ ID NO: 6979 - RNA, 738 nt, synthetic construct
  misc_feature 1..738: note = derived and/or modified CDS sequence (opt1) from SFTSV/Phlebovirus(ZJ1/China/2011)__HE663216.1__N
  source 1..738: mol_type = other RNA
atgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtccgcgacacgaagttcatcatcgtgttcgccctcacccggggcaacaagatcgtgaaggccagcgggaagatgtccaacagcggctccaagcgcctgatggccctgcaggagaagtacggcctcgtcgagaaggcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaaggccctgatggaggcctacagcctgtggcaggacgccttcaccaagaccatcaacgtgaagatgcggggcgcgtccaagaccgaggtgtacagctccttccgcgaccccctccacgccgccgtcaacagcgtgttcttcccgaacgacgtgcgggtcaagtggctgaaggccaaggggatcctgggccccgacggcgtgccctcccgcgccgcggaggtggccgccgccgcctaccggaacctctga

SEQ ID NO: 6980 - RNA, 1287 nt, synthetic construct
  misc_feature 1..1287: note = derived and/or modified CDS sequence (opt5) from ANDV(Chile-9717869)__AF291702.1__N
  source 1..1287: mol_type = other RNA
atgagcaccctgcaggagctccaagaaaacatcacagcccacgagcagcagctggtgacggctagacagaaacttaaggacgccgaaaaggcggtcgaggttgatcccgacgatgtgaataaatccaccctgcaatctcggcgcgctgccgtgagcacactcgaaaccaagctgggcgagcttaaaagacagctggccgacctcgtcgctgcccagaagctggctacaaagcctgtggatccgaccgggctggagcccgacgatcatctcaaagaaaagtcctctctgcggtacggaaacgttcttgacgtgaatagcattgatctggaggaaccttccggccagacagccgactggaaagcgatcggggcctatattctcggattcgctatccccattatcctgaaggccctttacatgctgtctacccgcggcagacaaacggtcaaagataacaaggggacccggatccgctttaaggacgatagctccttcgaggaggtgaatggaattagaaaacctaagcacctctatgttagcatgcccacagctcagtctaccatgaaagccgaagagatcacacctggccggtttcgcaccattgcgtgcggcctgttcccggcccaggtgaaggctagaaacatcatttcccccgtcatgggggtgatcggatttggcttctttgtgaaagactggatggaccggattgaagagttcctggccgctgaatgtccttttctccccaagcctaaagtcgccagcgaggccttcatgtctacgaataagatgtactttctgaaccgccagagacaagttaatgagtccaaggtgcaggatatcatcgaccttattgatcatgctgaaacagagagcgcgaccctgttcacagaaatcgccacaccccactctgtgtgggtctttgcttgcgccccggaccggtgtcctcccaccgccctctatgtggctggggttcctgagctgggagccttcttctccattcttcaggatatgcgcaacaccatcatggcgagcaaatccgtgggcacggctgaagagaagctgaaaaagaaatctgccttttaccaaagctatctcagacggacccagtccatggggattcagctggaccagaagatcatcattctgtacatgctcagctggggaaaggaggccgtcaatcatttccacctgggcgatgacatggatcccgaacttagacaactggctcagtctctcatcgacacaaaagtgaaggagatttccaaccaggaacccctgaaactttga

SEQ ID NO: 6981 - RNA, 1287 nt, synthetic construct
  misc_feature 1..1287: note = derived and/or modified CDS sequence (opt5) from ANDV(Nort)__AF325966.1__N
  source 1..1287: mol_type = other RNA
atgagcaccctgcaggagctccaagaaaacatcacagcccacgagcagcagctggtgacggctagacagaaacttaaggacgccgaaaagaccgtcgaggttgatcccgacgaagtgaataaatccacactgcaatctcggcgcgcggctgtgagcaccctcgagacaaagctgggcgagcttaaaagacagctggccgatctcgtcgccgctcagaagctggccaccaagcctgtggacccgacagggctggaacccgatgaccatctcaaagagaagtcctctctgcggtacggaaacgttcttgatgtgaatagcattgacctggaggaaccttccggccagaccgctgattggaaagccatcggggcgtatattctcggattcgccatccccattatcctgaaggctctttacatgctgtctacgcgcggcagacaaaccgtcaaagacaacaaggggacacggatccgctttaaggatgacagctccttcgaggaagtgaatggaattagaaaacctaagcacctctatgttagcatgcccaccgcccagtctacaatgaaagctgaggaaatcacccctggccggtttcgcacgattgcctgcggcctgttcccggcccaggtgaaggcgagaaacatcatttcccccgtcatgggggtgatcggatttagcttctttgtgaaagattggatggagcggattgaagacttcctggctgccgagtgtccttttctccccaagcctaaagctctgtctgaggccttcatggccacaaataaggcttactttcttaaccgccagagacaagtcaatgactccaaggttcaggatatcgtggacctgatcgatcatgcggaaattgagagcgccaccctcttcacagacatcgctacaccccactctgtgtgggtctttgcctgcgccccggatcggtgtcctcccaccgctctgtatgtggccggcgttcctgaacttggggcgttcttcgctattctgcaggacatgcgcaacaccatcatggcctccaaaagcgtgggaacggccgaggaaaagctcaaaaagaaatccgctttttaccaatcttatctgagacggacccagtacatgggcattcagctggatcagaagatcatcattctctacatgctgagctgggggaaggaggccgtcaatcatttccaccttggagacgatatggaccccgagctgagacaactcgctcagtccctgatcgatacaaaagtgaaggaaattagcaaccaggagccccttaaactgtga

SEQ ID NO: 6982 - RNA, 1287 nt, synthetic construct
  misc_feature 1..1287: note = derived and/or modified CDS sequence (opt5) from ANDV(CHI-7913)__AY228237.1__N
  source 1..1287: mol_type = other RNA
atgagcaccctgcaggagctccaagaaaacatcacagcccacgagcagcagctggtgacggctagacagaaacttaaggacgccgaaaaggcggtcgaggttgatcccgacgatgtgaataaatccaccctgcaaaaccggcgcgctgccgtgtctacactcgaaaccaagctgggcgagcttaaaagacagctggccgacctcgtcgctgcccagaagctggctacaaagcctgtggatccgaccgggctggagcccgacgatcatctcaaagaaaagagctccctgcggtacggaaatgttcttgacgtgaactctattgatctggaggaacctagcggccagacagccgactggaaagcgatcggggcctatattctcggattcgctatccccattatcctgaaggccctttacatgctgtccacccgcggcagacaagctgtcaaagataataaggggacgcggatccgctttaaggacgattctagcttcgaggaggtgaacggaattagaaaacctaagcacctctatgtttccatgcccaccgcccagagcacaatgaaagcggaagagatcacccctggccggtttcgcacaattgcctgcggcctgttcccggctcaggtgaaggccagaaatatcatttctcccgtcatgggggtgatcggatttggcttctttgtgaaagactggatggaccggattgaagagttcctggctgccgaatgtccttttctccccaagcctaaagtcgcctccgaggctttcatgagcaccaacaagatgtactttctgaatcgccagagacaagttaacgagtctaaggtgcaggatatcatcgaccttattgatcatgcggaaacggagtccgccacactgttcaccgaaatcgctacaccccacagcgtgtgggtctttgcctgcgccccggaccggtgtcctcccaccgctctctatgtggccggggttcctgagctgggagcgttcttctctattcttcaggatatgcgcaataccatcatggcttccaaaagcgtgggcacagccgaagagaagctgaaaaagaaatccgccttttaccaatcttatctcagacggacgcagagcatggggattcagctggaccagaagatcatcattctgtacatgctctcctggggaaaggaggctgtcaaccatttccacctgggcgatgacatggatcccgaacttagacaactggcccagagcctcatcgacaccaaagtgaaggagatttctaatcaggaacccctgaaactttga

SEQ ID NO: 6983 - RNA, 1287 nt, synthetic construct
  misc_feature 1..1287: note = derived and/or modified CDS sequence (opt5) from ANDV(9718133)__AF482712.1__N
  source 1..1287: mol_type = other RNA
atgagcaccctgcaggagctccaagaaaacatcacagcccacgagcagcagctggtgacggctagacagaaacttaaggacgccgaaaaggcggtcgaggttgatcccgacgatgtgaataaatccaccctgcaaaaccggcgcgctgccgtgtctacactcgaaaccaagctgggcgagcttaaaagacagctggccgacctcgtcgctgcccagaagctggctacaaagcctgtggatccgaccgggctggagcccgacgatcatctcaaagaaaagagctccctgcggtacggaaatgttcttgacgtgaactctattgatctggaggaacctagcggccagacagccgactggaaagcgatcggggcctatattctcggattcgctatccccattatcctgaaggccctttacatgctgtccacccgcggcagacaaacggtcaaagataataaggggacccggatccgctttaaggacgattctagcttcgaggaggtgaacggaattagaaaacctaagcacctctatgtttccatgcccacagctcagagcaccatgaaagccgaagagatcacacctggccggtttcgcaccattgcgtgcggcctgttcccggcccaggtgaaggctagaaatatcatttctcccgtcatgggggtgatcggatttggcttctttgtgaaagactggatggaccggattgaagagttcctggccgctgaatgtccttttctccccaagcctaaagtcgcctccgaggccttcatgagcacgaacaagatgtactttctgaatcgccagagacaagttaacgagtctaaggtgcaggatatcatcgaccttattgatcatgctgaaacagagtccgcgaccctgttcacagaaatcgccacaccccacagcgtgtgggtctttgcttgcgccccggaccggtgtcctcccaccgccctctatgtggctggggttcctgagctgggagccttcttctctattcttcaggatatgcgcaataccatcatggcgtccaaaagcgtgggcacggctgaagagaagctgaaaaagaaatccgccttttaccaatcttatctcagacggacccagagcatggggattcagctggaccagaagatcatcattctgtacatgctctcctggggaaaggaggccgtcaaccatttccacctgggcgatgacatggatcccgaacttagacaactggctcagagcctcatcgacacaaaagtgaaggagatttctaatcaggaacccctgaaactttga

SEQ ID NO: 6984 - RNA, 1278 nt, synthetic construct
  misc_feature 1..1278: note = derived and/or modified CDS sequence (opt5) from Araraquara virus(9480)__KP202360.1__N
  source 1..1278: mol_type = other RNA
atgagcaacctgcaggagctccaagaaaatatcaccgcccacgagcagcagctggtgacagctagacagaagctcaaagacgccgaaaaggcggtcgatgttgaccccgatgaggtgaacaaatccacgctgcaaggccggcgcgctgccgtgtctaccctcgaaacaaagctgggggagcttaaaagacagctggccgacctcgtcgctgcccagcggctggctagcaagcctgtggatccgaccggaattgagcccgacgatcatctgaaggaaaaatcctctctccgctacggcaatgttctggacgtgaacagcatcgatcttgaggaaccttccgggcagacagccgactggaaggcgattggagcctatatcctgggcttcgctattcccatcatcctcaaagccctgtacatgctttctaccagagggcggcaaacagtcaaggataataaaggaacccgcattagatttaaggacgatagctccttcgaggaggtgaacggcatccggaagcctaaacacctgtatattagcatgcccacggctcagtctaccatgaaggccgaagagatcacacctggccgctttagaaccattgcgtgcgggcttttcccggcccaggttaaagctcggaatatcatttcccccgtgatgggagtcatcggctttgccttctttgtgaaggactggatggaacgcatcgaggacttcctggctagcgaatgtccttttctgcccaaacctaagaacccctctgaggccttcatggccacaaataaggcttactttctcaacagacagaagcaagtggatgagtcccaggtcccggacattgttgatctgatcgaccatgcggaagccgagagcgctacccttttcaaggaaattgcctctcctcactccgtgtgggtgtttgcctgcgctcccgatcggtgtcctcccacggccctgtatgtcgcggggatgcccgagctcggagctttcttcgccatcctgcaggacatgcgcaatacaattatggccagcaaatccgtgggcaccgctgaagagaaacttaaaaagaaatctgccttttaccaaagctatctgagacggacacagtccatggggatccagctcgatcagaagatcattatcctgtacatgctgagctggggaaaggaggctgttaaccatttccacctcggcgacgatatggaccctgaactgagacaacttgcccagtctctgattgataccaaagtgaaggagtcccagaccaaaagcctctga

SEQ ID NO: 6985 - RNA, 1287 nt, synthetic construct
  misc_feature 1..1287: note = derived and/or modified CDS sequence (opt5) from Araraquara-like virus(P5/Cajuru)__EF571895.1__N
  source 1..1287: mol_type = other RNA
atgagcaacctgcaggagctccaagaaaatatcaccgcccacgagcagcagctggtgacagctagacagaagctcaaagacgccgaaaaggcggtcgatgttgaccccgatgaggtgaacaaatccacgctgcaaggccggcgcgctgccgtgtctaccctcgaaacaaagctgggggagcttaaaagacagctggccgacctcgtcgctgcccagcggctggctagcaagcctgtggatccgaccggaattgagcccgacgatcatctgaaggaaaaatcctctctccgctacggcaatgttctggacgtgaaccctatcgatcttgaggaacccagcgggcagacagccgactggaaggcgattggagcctatatcctgggcttcgctattcctatcatcctcaaagccctgtacatgctttccaccagagggcggcaaacagtcaaggataataaaggaacccgcattagatttaaggacgattctagcttcgaggaggtgaacggcatccggaagcccaaacacctgtatatttccatgcctacggctcagagcaccatgaaggccgaagagatcacaccgggccgctttagaaccattgcgtgcgggcttttccccgcccaggttaaagctcggaatatcatttctcctgtgatgggagtcatcggctttgggttctttgtgaaggactggatggaacgcatcgaggacttcctggcctccgaatgtccctttctgcctaaacccaagaacccgagcgaggctttcatggccacaaataaagcctactttctcaacagacagaagcaagtggatgagtctcaggtccctgacattgttgatctgatcgaccatgctgaagcggagtccgccacccttttcaaggaaattgctagcccccactctgtgtgggtgtttgcctgcgcccctgatcggtgtcctcccacggctctgtatgtcgccggactccccgagctgggcgcgttcttcgctatccttcaggacatgcgcaatacaattatggcctccaaaagcgtggggaccgccgaagagaagctgaaaaagaaatccgctttttaccaatcttatctcagacggacacagagcatgggaatccagctggatcagaagatcattatcctgtacatgctctcctggggcaaggaggccgttaaccatttccacctgggcgacgatatggacccggaacttagacaactggctcagagcctcattgataccaaagtgaaggagatctctaatcaggggcccctgaaactttga

SEQ ID NO: 6986 - RNA, 1287 nt, synthetic construct
  misc_feature 1..1287: note = derived and/or modified CDS sequence (opt5) from BMJV(Oc22531)__AF482713.1__N
  source 1..1287: mol_type = other RNA
atgagcaccctgcaggagctccaagaaaacatcacagcccacgagcagcagctggtgacggctagacagaaacttaaggacgccgaaaagaccgtcgaggttgatcccgacgaagtgaataagtccacactgcaatctcggcgcgcggctgtgagcaccctcgagacaaagctgggcgagcttaaaagacagctggccgatctcgtcgccgctcagaagctggccaccaagcctgtggacccgacagggctggaacccgatgaccatctcaaagagaagtcctctctgcggtacggaaacgttcttgatgtgaatagcattgacctggaggaaccttccggccagaccgctgattggcgctctatcggggcctatattctcggattcgcgatccccattatcctgaaagccctttacatgctgagcacgagaggccggcaaaccgtcaaggacaacaaagggacacgcatcagatttaaggatgactccagcttcgaggaagtgaatggcattcggaagcctaaacacctctatgtttctatgcccaccgctcagtccacaatgaaggccgaggaaatcacccctggacgctttagaacgattgcttgcggcctgttcccggcccaggtgaaagcgcggaacatcattagccccgtcatgggggtgatcggattttctttctttgtgaaggattggatggagcgcattgaagacttcctggccgctgagtgtccttttctccccaaacctaaggccccctccgaggctttcatggccacaaataaagcctactttctgaacagacagcggcaagtcaatgaaagcaaggttcaggacatcgtggatcttatcgaccatgctgagaccgaatctgcgacactgttcaccgatattgccaccccgcactccgtgtgggtctttgcttgcgcccctgaccgctgtccccctacagccctctatgtggctggcgttcccgagctgggggccttcttcgcgatccttcaggatatgagaaacacgattatggctagcaagtccgtgggaaccgccgaagagaaactgaagaaaaagtctgccttttaccaaagctatctccggagaacacagtccatgggcatccagctggaccagaaaattatcatcctgtacatgctcagctgggggaaggaggctgtcaatcatttccacctgggagatgacatggatcccgaacttcgccaactggcccagtctctcattgacaccaaggtgaaagagatctccaaccaggaacctctgaaactttga

SEQ ID NO: 6987 - RNA, 1287 nt, synthetic construct
  misc_feature 1..1287: note = derived and/or modified CDS sequence (opt5) from LECV(22819)__AF482714.1__N
  source 1..1287: mol_type = other RNA
atgagcaccctgcaggagctccaagaaaacatcacagcccacgagcagcagctggtgacggctagacagaaacttaaggacgccgaaaagaccgtcgaggttgatcccgacgaagtgaataagtccacactgcaatctcggcgcgcggctgtgagcaccctcgagacaaagctgggcgagcttaaaagacagctggccgatctcgtcgccgctcagaagctggccaccaagcctgtggacccgacagggctggaacccgatgaccatctcaaagagaagtcctctctgcggtacggaaacgttcttgatgtgaatagcattgacctggaggaaccttccggccagaccgctgattggcgctctatcggggcctatattctcggattcgcgatccccattatcctgaaagccctttacatgctgagcacgagaggccggcaaaccgtcaaggacaacaaagggacacgcatcagatttaaggatgactccagcttcgaggaagtgaatggcattcggaagcctaaacacctctatgtttctatgcccaccgctcagtccacaatgaaggccgaggaaatcacccctggacgctttagaacgattgcttgcggcctgttcccggcccaggtgaaagcgcggaacatcattagccccgtcatgggggtgatcggattttctttctttgtgaaggattggatggagcgcattgaagacttcctggccgctgagtgtccttttctccccaaacctaaggccccctccgaggctttcatggccacaaataaagcctactttctgaacagacagcggcaagtcaatgaaagcaaggttcaggagatcgtggaccttatcgatcatgctgaaaccgagtctgcgacactgttcaccgacattgccaccccgcactccgtgtgggtctttgcttgcgcccctgatcgctgtccccctacagccctctatgtggctggcgttcccgaactgggggccttcttcgcgatccttcaggacatgagaaacacgattatggctagcaagtccgtgggaaccgccgaggagaaactgaagaaaaagtctgccttttaccaaagctatctccggagaacacagtccatgggcatccagctggatcagaaaattatcatcctgtacatgctcagctgggggaaggaagctgtcaatcatttccacctgggagacgatatggaccccgagcttcgccaactggcccagtctctcattgataccaaggtgaaagaaatctccaaccaggagcctctgaaactttga

SEQ ID NO: 6988 - RNA, 1287 nt, synthetic construct
  misc_feature 1..1287: note = derived and/or modified CDS sequence (opt5) from MCLV(13796)__AF482716.1__N
  source 1..1287: mol_type = other RNA
atgagcaacctgcaggagctccaagaaaatatcaccgcccacgagcagcagctggtgacagctagacagaagctcaaagacgccgaaaaggcggtcgatgttgaccccgatgaggtgaacaaatccacgctgcaaggccggcgcgctgccgtgtctaccctcgaaacaaagctgggggagcttaaaagacagctggccgacctcgtcgctgcccagaagctggctaccaagcctgtggatccgacaggaattgagcccgacgatcatctgaaagaaaagagctccctccggtacggcaatgttctggacgtgaactctatcgatcttgaggaacctagcgggcagaccgccgactggaaagcgattggagcctatatcctgggcttcgctattcccatcatcctcaaggccctgtacatgctttccacacgcgggagacaaaccgtcaaagataataagggaacgcggattcgctttaaggacgattctagcttcgaggaggtgaacggcatcagaaaacctaagcacctgtatatttccatgcccaccgctcagagcacaatgaaagccgaagagatcacccctggccggtttcgcacaattgtttgcgggcttttcccggcgcaagtgaaggccagaaatatcatttctcccgtcatgggagtgatcggcttttccttctttgtgaaagactggatggaacggatcgaggggttcctggctgccgaatgtccttttctgcccaagcctaaaaccgctgccgagacgttcatggccacaaacaaggcttactttttcaatcgccagagacaagtcgacgagagccaggttcccgatattgtggaactcatcgaccaggcggagtctgaatccgccaccctgtttacagagattgctagcccgcattctgtgtgggtcttcgcctgcgcccctgatcggtgtccccctaccgctctttatgtggccggagttcccgaactgggcgcgttctttgctatcctccaagacatgcgcaacaccattatggcctccaagagcgtggggacagccgaggagaaactgaagaaaaagtccgctttctaccagtcttatcttagacggacgcagagcatgggaatccagctggatcagaaaatcattatcctctacatgctgtcctggggcaaggaagccgtcaatcactttcatctgggcgacgatatggaccccgagctcagacagctggctcaggcccttattgataccaaggtgaaagaaatcagcaaccaggagcctctgaagctctga

SEQ ID NO: 6989 - RNA, 1287 nt, synthetic construct
  misc_feature 1..1287: note = derived and/or modified CDS sequence (opt5) from Neembucu(Neembucu)__DQ345763.1__N
  source 1..1287: mol_type = other RNA
atgagcaccctgcaggagctccaagaaaacatcacagcccacgagcagcagctggtgacggctagacagaaacttaaggacgccgaaaagaccgtcgaggttgatcccgacgaagtgaataaatccacactgcaatctcggcgcgcggctgtgagcaccctcgagacaaagctgggcgagcttaaaagacagctggccgatctcgtcgccgctcagaagctggccacccggcctgtggacccgacagggctggaacccgatgaccatctcaaggagaaatcctctctgcgctacggaaacgttcttgatgtgaatagcattgacctggaggaaccttccggccagaccgctgattggagatctatcggggcctatattctcggattcgcgatccccattatcctgaaggccctttacatgctgagcacgcggggccgccaaaccgtcaaagacaacaaggggacaagaatccggtttaaagatgactccagcttcgaggaagtgaatggcattcgcaagcctaagcacctctatgtttctatgcccaccgctcagtccacaatgaaagccgaggaaatcacccctggaagactgcggacgattgcttgcggcctgtttccggcccaggtgaaggcgcgcagcatcatttctcccgtcatgggggtgatcggattctcctttttcgtgaaagattggatggagagaattgaagactttctcgccgctgagtgtcctttcctgcccaagcctaaagcccccagcgaggcttttatggccacaaacaaggcctacttccttaatcggcagcgccaagtcaacgaatctaaagttcaggacatcgtggatctgatcgaccatgctgagaccgaatccgcgacactctttaccgatattgccaccccgcacagcgtgtgggtcttcgcttgcgcccctgacagatgtccccctacagccctgtatgtggctggcgttcccgagcttggggcctttttcgcgatcctgcaggatatgcggaatacgattatggcttccaagtctgtgggaaccgccgaagagaagctcaaaaagaaaagcgccttctaccaatcctatctgagacgcacacagagcatgggcatccagctggaccagaagattatcatcctctacatgctgtcttgggggaaagaggctgtcaaccattttcaccttggagatgacatggatcccgaactgcggcaactcgcccagtccctgattgacaccaaggtgaaggagatcagcaatcaggaacctcttaaactgtga

SEQ ID NO: 6990 - RNA, 1287 nt, synthetic construct
  misc_feature 1..1287: note = derived and/or modified CDS sequence (opt5) from ORNV(22996)__AF482715.1__N
  source 1..1287: mol_type = other RNA
atgagcaccctgcaggagctccaagaaaacatcacagcccacgagcagcagctggtgacggctagacagaaacttaaggacgccgaaaagaccgtcgaggttgatcccgacgaagtgaataaatccacactgcaatctcggcgcgcggctgtgagcaccctcgagacaaagctgggcgagcttaaaagacagctggccgatctcgtcgccgctcagaagctggccaccaagcctgtggacccgacagggctggaacccgatgaccatctcaaagagaagtcctctctgcggtacggaaacgttcttgatgtgaatagcattgacctggaggaaccttccggccagaccgctgattggaaagccatcggggcgtatattctcggattcgccatccccattatcctgaaggctctttacatgctgtctacgcgcggcagacaaaccgtcaaagacaacaaggggacacggatccgctttaaggatgacagctccttcgaggaagtgaatggaattagaaaacctaagcacctctatgttagcatgcccaccgcccagtctacaatgaaagctgaggaaatcacccctggccggtttcgcacgattgcctgcggcctgttcccggcccaggtgaaggcgagaaacatcatttcccccgtcatgggggtgatcggatttagcttctttgtgaaagattggatggagcggattgaagacttcctggctgccgagtgtccttttctccccaagcctaaagctctgtctgaggccttcatggccacaaataaggcttactttcttaaccgccagagacaagtcaatgactccaaggttcaggatatcgtggacctgatcgatcatgcggaaattgagagcgccaccctcttcacagacatcgctacaccccactctgtgtgggtctttgcctgcgccccggatcggtgtcctcccaccgctctgtatgtggccggcgttcctgaacttggggcgttcttcgctattctgcaggacatgcgcaacaccatcatggcctccaaaagcgtgggaacggccgaggaaaagctcaaaaagaaatccgctttttaccaatcttatctgagacggacccagagcatgggcattcagctggatcagaagatcatcattctctacatgctgtcctgggggaaggaggccgtcaatcatttccaccttggagacgatatggaccccgagctgagacaactcgctcagagcctgatcgatacaaaagtgaaggaaatttctaaccaggagccccttaaactgtga

SEQ ID NO: 6991 - RNA, 1287 nt, synthetic construct
  misc_feature 1..1287: note = derived and/or modified CDS sequence (opt5) from PRGV(14403)__AF482717.1__N
  source 1..1287: mol_type = other RNA
atgagcaccctgcaggagctccaagaaaacatcacagcccacgagcagcatctggtgacggctagacagaaacttaaggacgccgaaaagaccgtcgaggttgatcccgacgaagtgaataagtccacactgcagtctcggcgcgcggctgtgagcaccctcgagacaaagctgggcgagcttaaaagacaactggccgatctcgtcgccgctcagaagctggccgctaagcctgtggacccgaccgggctggaacccgatgaccacctcaaagagaagtcctctctgcggtacggaaacgttcttgatgtgaatagcattgacctggaggaaccttccggccagacagccgattggaaagcgatcggggcctatattctcggattcgctatccccattatcctgaaggccctttacatgctgtctacccgcggcagacagacggtcaaagacaacaaggggacccggatccgctttaaggatgacagctccttcgaggaagtgaatggaattagaaaacctaagcatctctatgttagcatgcccacagctcaatctaccatgaaagccgaggaaatcacacctggccggtttcgcaccattgcgtgcggcctgttcccggcccaggtgaaggctagaaacatcatttcccccgtcatgggggtgatcggatttagcttctttgtgaaagattggatggagcggattgaagacttcctggccgctgagtgtccttttctccccaagcctaaaacgacatctgaggccttcatgtccaccaataaggcctactttctgaaccgccagagacaggtcgacgaaagccaagttcccgatatcgctgagcttatcgaacaggcggagtctgaatccgccacactgttcaccgagattgctagcccgcactccgtgtgggtgtttgcctgcgcccctgaccggtgtccccctaccgctctctatgtcgccggcgtgcccgagctgggggcgttcttcgctatccttcaggatatgcgcaatacaattatggcctctaagagcgttggaacggccgaagagaaactgaagaaaaagtccgctttttaccaaagctatctcagacggacccagtctatgggcatccagctggaccagaaaattatcatcctgtacatgctctcctgggggaaggaagccgtgaaccatttccacctgggagatgacatggatcccgagcttagacaactggctcaggccctcattgacacaaaggtcaaagaaatcagcaatcaggagcctctgaaactttga

SEQ ID NO: 6992 - RNA, 1287 nt, synthetic construct
  misc_feature 1..1287: note = derived and/or modified CDS sequence (opt5) from TUNV(FVB554)__JF750419.1__N
  source 1..1287: mol_type = other RNA
atgagcaacctgcaggagctccaagaaaatatcaccgcccacgagcagcagctggtgacagctagacagaaacttaaggacgccgaaaaggcggtcgagatggatcccgacgatgttaacaaatccacgctgcaatctcggcgcgctgccgtgagcaccctcgaaacaaagctgggcgagcttaaaagacagctggccgacatggtggctgcccagaagctcgctaccaagcctgtcgatccgacagggctggagcccgacgatcatctgaaagaaaagtcctctctccggtacggaaatgtgctggacgttaacagcattgatcttgaggaaccttccggccagaccgccgactggaaatctatcggggcgtatattctgggattcgccatccccattatcctcaaggctctgtacatgcttagcacacgcggcagacaaaccgtgaaagataataaggggacgcggatccgctttaaggacgattccagcttcgaggaggtcaacggaattagaaaacctaagcacctgtatgtgtctatgcccaccgcccagtccacaatgaaagctgaagagatcacccctggccggtttcgcacaattgcctgcggcctcttcccggcgcaggttaaggccagaaatatcattagccccgtgatgggggtcatcggattttctttctttgtgaaagactggatggaacggattgaggacttcctggctgatgaatgtccttttctgcccaagcctaaatcccccagcgaggccttcatggctaccaacaaggcctactttctcaatcgccagagacaagtgaacgactctaaggtccaggatatcgttgacctgatcgatcatgccgagacggaatccgctacacttttcaccgacattgcgacaccgcacagcgtgtgggtgtttgcctgcgctcctgatcggtgtccccctaccgccctgtatgtcgccggcgtgcccgagctcggggctttcttcgccatcctgcaggacatgcgcaataccattatggcgtccaaatctgttggaacagctgaagagaaacttaagaagaaaagcgccttttaccaatcctatctgagacggacgcagagcatgggcatccagctcgatcagaagattatcatcctgtacatgctgtcttgggggaaggaagccgtgaaccatttccacctcggagacgatatggaccccgagctgagacaacttgctcaggccctgattgacaccaaagtcaaggagatctccaatcaggaacctctcaaactgtga

SEQ ID NO: 6993 - RNA, 1287 nt, synthetic construct
  misc_feature 1..1287: note = derived and/or modified CDS sequence (opt5) from BCCV(BCCV)__AB689163.1__N
  source 1..1287: mol_type = other RNA
atgagcaacctgaaggaggtgcaggacaatatcaccacacacgaacaacagctcgtcgccgctagacagaaactgaaggatgccgagcggacggttggcgtggaccccgatgacgtgaacaaatccacccttcagaatcgcagagcggctgtctctgccctggaagccaagattggggagctcaaacggcaactggctgatcttgtggccgctcagaagctggccacaaagagcgttgaccctaccggaatcgaaccggatgaccatctcaaagagaagtcctctctgcgctacggcaacgtgctggatgtcaatagcattgacctcgaggaaccctccgggcagacagcggattggaaagccatcggaacctatattctgtctttcgtgcttcctatcgttctgaaggctctctacatgctgagcacaagaggccggcagaccgtgaaagagaacaaggggacgcgcatcagatttaaggacgattccagctatgaagacgtcaatggcattcggaaacccaagcacctttacgtgtctctgcctaccgcccaatccacaatgaaagctgacgagatcacccccggacgcttcagaacaattgtgtgcggcctctttcctgcccagatcaaggcgcggaacattatcagcccggtcatgggggttattggattctcctttttcgtgaaagattgggtggacaagatcgaggattttctgcgcgccgaatgtcccttcctgcctaaacccagagctcaggccgagtcttttctcagcaccaatggcgcttatttcatgaaccggcagacgcaagtcgaagagtctaaggtgcaggacatcctggatcttattgacacagccgaatccgggggagccaccctgtttgataatatcgctagccctcagtccgcgtggattttcgcctgcgctcccgaccgctgtccgcctacagccctctacgttgccggcgtgcccgagctgggggcctttttctctatccttcaagatatgagaaacaccattatggctagcaagtccgtcggaaccgcggaggaaaaactgaagaaaaagagcgctttctatcagtcttacctccggagaacacagtccatgggcatccagctggaccagaaaatcattatcctgtacatgattaattggggcaaggaggccgtgaaccattttcacctcggggatgacatggaccctgaactgcgccaacttgcccaggctctggttgatacgaaggtgaaagagatcagcaatcaggaacccctcaagatttga

SEQ ID NO: 6994 - RNA, 1287 nt, synthetic construct
  misc_feature 1..1287: note = derived and/or modified CDS sequence (opt5) from BCCV(BCCV)__L39949.1__N
  source 1..1287: mol_type = other RNA
atgagcaacctgaaggaggtgcaggacaatatcaccacacacgaacaacagctcgtcgccgctagacagaaactgaaggatgccgagcggacggttgaagtggaccccgatgacgtgaacaaatccacccttcagaatcgcagagcggctgtctctgccctggaggccaagattggcgaactcaaacggcaactggctgatcttgtggccgctcagaagctggccacaaagagcgttgaccctaccgggatcgagccggatgaccatctcaaagagaagtcctctctgcgctacggaaacgtgctggatgtcaatagcattgacctcgaggaaccctccggccagacagcggattggaaagccatcgggacctatattctgtctttcgtgcttcctatcgttctgaaggctctctacatgctgagcacaagaggacggcagaccgtgaaagaaaacaagggcacgcgcatcagatttaaggacgattccagctatgaggacgtcaatgggattcggaaacccaagcacctttacgtgtctctgcctaccgcccaatccacaatgaaagctgacgagatcacccccggacgcttcagaacaattgtgtgcggcctctttcctgcccagatcaaggcgcggaacattatcagcccggtcatgggcgttattgggttctcctttttcgtgaaagattgggtggacaagatcgaagattttctgcgcgccgagtgtcccttcctgcctaaacccagagctcaggccgaatcttttctcagcaccaatggagcttatttcatgaaccggcagacgcaagtcgaggaatctaaggtgcaggacatcctggatcttattgacacagccgagtccggcggggccaccctgtttgataatatcgctagccctcagtccgcgtggattttcgcctgcgctcccgaccgctgtccgcctacagccctctacgttgccggagtgcccgagctgggcgcctttttctctatccttcaagatatgagaaacaccattatggctagcaagtccgtcgggaccgcggaagagaaactgaagaaaaagagcgctttctatcagtcttacctccggagaacacagtccatgggaatccagctggaccagaaaatcattatcctgtacatgattaattggggcaaggaagccgtgaaccattttcacctcggcgatgacatggaccctgagctgcgccaacttgcccaggctctggttgatacgaaggtgaaagaaatcagcaatcaggagcccctcaagatttga

SEQ ID NO: 6995 - RNA, 1290 nt, synthetic construct
  misc_feature 1..1290: note = derived and/or modified CDS sequence (opt5) from DOBV(DOBV/Ano-Poroia/Afl9/1999)__NC_005233.1__N
  source 1..1290: mol_type = other RNA
atggccaccctggaggaactccagaaggagatcaacaatcacgaaggccaactggtgattgctagacagaaagtcaaggacgccgagaaacagtacgaaaaggatcccgacgatcttaacaaacgggcgctgagcgaccgcgagtccatcgctcagtctattcaagggaagatcgatgagctcagacggcagctggccgaccgcgttgccgctggaaagaatattggcaaagaaagagatcctacagggcttgacccgggagatcatctgaaggagaaaagcatgctctcctatggcaacgtgatcgacctgaatcacctggatatcgacgaacccacggggcagaccgccgattggctctctattgtggtctacctgaccagcttcgtggttcctatccttctgaaggctctctatatgctgacaacacggggacgccagaccacaaaagacaacaagggcatgcggattagatttaaggacgattcctctttcgaggacgtgaatggcatccgcaaacccaagcatctttttctgagcatgcctaacgcccaatccagcatgaaagcggatgagattacccccgggagattccggacggccatctgcggactctaccctgctcaggtcaaggcccgcaatctgatttctccggtgatgtccgttatcggctttctggctctcgccaaaaactggaccgaaagagtggaggaatggctggaccttccctgtaagctgctcagcgagccttctcccacatccctgaccaaagggcctagcacaaatcgggattatcttaaccagcgccagggagcgctggccaagatggaaaccaaggaggctcaagccgtcagaaaacacgctatcgacgccggctgcaatctcattgatcatatcgactctccctccagcatttgggtgttcgccggggctccggatcggtgtcctcccacgtgcctgtttatcgcgggaatggccgagctgggcgctttctttgccgtgctccaggacatgagaaacacaattatggcctccaagaccatcggcacatctgaagagaaactgaagaaaaagagctccttctaccagagctatcttcgccggacccaatctatggggatccagctggatcagagaattatcgtcctctttatggttgactggggaaaggaagctgtggactccttccacctgggcgatgacatggatcctgagcttcgcgggctggcccaggcgctcattgaccaaaaagtgaaggaaatcagcaatcaggagcccctgaaactgtga

SEQ ID NO: 6996 - RNA, 1290 nt, synthetic construct
  misc_feature 1..1290: note = derived and/or modified CDS sequence (opt5) from DOBV(DOB/Saaremaa/160V)__AJ009773.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctatcgctcagagcattcaagggaagatcgatgagctcagacggcagctggccgaccgcgttgccgctggaaagaacattggcaaagaaagagatcctacagggcttgacccgggagatcatctgaaggagaaatccatgctctcttatggcaatgtgatcgacctgaaccacctggatatcgacgaacccacggggcagaccgccgattggctcagcattgtgatctacctgacatccttcgtcgtgcctattcttctgaaggctctctatatgctgaccacacggggacgccagaccacaaaagacaataagggcatgagaatccggtttaaggacgattctagcttcgaggacgttaacggcattcgcaaacccaagcatctttttctgtccatgcctaatgcccaaagctctatgaaagcggatgagatcacccccgggagattccggacggccgtgtgcggactctaccctgctcaggtcaaggcccgcaacctgatttccccggtgatgagcgttatcggctttctgaccctcgctaaaaattggacagaaagagtggaggaatggctggaccttccctgtaagctgctctctgagccttcccccaccagcctgacaaaagggccttctaccaaccgggattatctttcccagcgccagggagccctggcgaagatggaaacgaaggaggcccaagtcgtgagaaaacacgctatcgacgccggctgcaatattatcgatcatattgacagcccctcctctatctgggtgttcgctggggccccggatcggtgtcctcccacatgcctctttattgccggaatggctgagctgggcgcgttctttgccgtcctgcaggacatgagaaacaccatcatggctagcaagacaatcggcacctccgaagagaaactccgcaagaaaagctctttctaccagtcctatctgcggagaacccaaagcatggggattcagcttgatcagcgcatcattgttctgtttatgatcgaatggggaaaggaggccgtggactctttccacctcggcgacgatatggaccctgaaattcggagcctggcccaggctcttatcgatcaaaaggtgaaagagatctccaatcaggagcccctgaagctctga

SEQ ID NO: 6997 - RNA, 1290 nt, synthetic construct
  misc_feature 1..1290: note = derived and/or modified CDS sequence (opt5) from DOBV(Slovakia/400Af/98)__AY168576.1__N
  source 1..1290: mol_type = other RNA
atggccaccctggaggaactccagaaggagatcaacaatcacgaaggccaactggtgattgctagacagaaagtcaaggacgccgagaaacagtacgaaaaggatcccgacgatcttaacaaacgggcgctgagcgaccgcgagtccatcgctcagtctattcaagggaagatcgatgagctcagacggcagctggccgaccgcgttgccgctggaaagaatattggcaaagaaagagatcctacagggcttgacccgggagatcatctgaaggagaaaagcatgctctcctatggcaacgtgatcgacctgaatcacctggatatcgacgaacccacggggcagaccgccgattggctctctattgtggtctacctgaccagcttcgtggttcctatccttctgaaggctctctatatgctgacaacacggggacgccagaccacaaaagacaacaagggcatgcggattagatttaaggacgattcctctttcgaggacgtgaatggcatccgcaaacccaagcatctttttctgagcatgcctaacgcccaatccagcatgaaagcggatgagattacccccgggagattccggacggccatctgcggactctaccctgctcaggtcaaggcccgcaatctgatttctccggtgatgtccgttatcggctttctggctctcgccaaaaactggaccgaaagagtggaggaatggctggaccttccctgtaagctgctcagcgagccttctcccacatccctgaccaaagggcctagcacaaatcgggattatcttaaccagcgccagggagcgctggccaagatggaaaccaaggaggctcaagccgtcagaaaacacgctatcgacgccggctgcaatctcattgatcatatcgactctccctccagcatttgggtgttcgccggggctccggatcggtgtcctcccacgtgcctgtttatcgcgggaatggccgagctgggcgctttctttgccgtgctccaggacatgagaaacacaattatggcctccaagaccatcggcacatctgaagagaaactgaagaaaaagagctccttctaccagagccttctgcgccggacccaatctatggggatccagctcgatcagagaattatcgtcctgtttatggttgactggggaaaggaagctgtggactccttccaccttggcgatgacatggatcctgagctgcgcgggctcgcccaggcgctgattgaccaaaaagtgaaggaaatcagcaatcaggagcccctgaaactctga

SEQ ID NO: 6998 - RNA, 1290 nt, synthetic construct
  misc_feature 1..1290: note = derived and/or modified CDS sequence (opt5) from DOBV(Slovakia-856-Aa)__AJ269549.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctgttgctcagagcatccaatccaagattgatgagctcagacggcagctggccgaccgcgtggccgctgggaagaacatcggaaaagaaagagatcctacaggccttgacccgggggatcatctgaaggagaaatctatgctcagctatggaaatgtgattgacctgaaccacctggatatcgacgaacccacgggccagaccgccgattggctctccatcgtcgtgtacctgacatctttcgttgtgcctattcttctgaaggctctctatatgctgaccacacgggggcgccagaccacaaaagacaataagggaatgagaatccggtttaaggacgatagctccttcgaggacgtcaacggcattcgcaaacccaagcatctttttctgagcatgcctaatgcccaatcttccatgaaagcggatgagatcacccccggcagattccggacggccatttgcgggctctaccctgctcaggtgaaggcccgcaacctggttagcccggtgatgtctgtcatcggatttatggctctggccaaaaattggaccgaaagagtggaggaatggctcgacctgccctgtaaacttctgtccgagcctagccccacatctctcaccaagggcccttccacaaaccgggattatctgaatcagcgccagggggcgcttgccaagatggaaaccaaggaggctcaagccgtgagaaaacacgctattgacgccggatgcaacatcatcgatcatattgacagcccctcctctatctgggtcttcgccccggctcctgatcggtgtccccctacgtgcctgtttattgcgggcatggccgagctcggggctttctttagcgttctgcaggacatgagaaatacaatcatggcctccaagaccattggaacaagcgaagagaaactgcgcaagaaatcttccttctaccagagctatctccggagaacccaatctatgggcatccagctggatcagcgcatcattgtgctttttatggtggactggggcaaggaagccgtcgacagcttccacctgggggatgacatggatcccgagctccggggactggctcaggcccttatcgaccaaaaggtgaaagaaatttccaaccaggagcccctgaagctctga

SEQ ID NO: 6999 - RNA, 1290 nt, synthetic construct
  misc_feature 1..1290: note = derived and/or modified CDS sequence (opt5) from DOBV(Slovakia-862-Aa)__AJ269550.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctgttgctcagagcatccaatccaagattgatgagctcagacggcagctggccgaccgcgtggccgctgggaagaacatcggaaaagaaagagatcctacaggccttgacccgggggatcatctgaaggagaaatctatgctcagctatggaaatgtgattgacctgaaccacctggatatcgacgaacccacgggccagaccgccgattggctctccatcgtcgtgtacctgacatctttcgttgtgcctattcttctgaaggctctctatatgctgaccacacgggggcgccagaccacaaaagacaataagggaatgagaatccggtttaaggacgatagctccttcgaggacgtcaacggcattcgcaaacccaagcatctttttctgagcatgcctaatgcccaatcttccatgaaagcggatgagatcacccccggcagattccggacggccatttgcgggctctaccctgctcaggtgaaggcccgcaacctggttagcccggtgatgtctgtcatcggatttatggctctggccaaaaattggaccgaaagagtggaggaatggctcgacctgccctgtaaacttctgtccgagcctagccccacatctctcaccaagggcccttccacaaaccgggattatctgaatcagcgccagggggcgcttgccaagatggaaaccaaggaggctcaagccgtgagaaaacacgctattgacgccggatgcaacatcatcgatcatattgacagcccctcctctatctgggtcttcgccggccggccggatagatgtcctcccacgtgcctgtttattgctgggatggcggagctcggagccttctttagcgttctgcaggacatgcgcaatacaatcatggcttccaagaccattggcacaagcgaagagaaactgcggaagaaatcttccttctaccagagctatctcagacgcacccaatctatgggcatccagctggatcagcggatcattgtgctttttatggtggactgggggaaggaagccgtcgacagcttccacctgggagatgacatggatcctgagctcagaggcctggcccaggctcttatcgaccaaaaggtgaaagaaatttccaaccaggagcccctgaagctctga

SEQ ID NO: 7000 - RNA, 1290 nt, synthetic construct
  misc_feature 1..1290: note = derived and/or modified CDS sequence (opt5) from DOBV(Esl/29Aa/01)__AY533118.2__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctgttgctcagagcatccaatccaagattgatgagctcagacggcagctggccgaccgcgtggccgctgggaagaacatcggaaaagaaagagatcctacaggccttgacccgggggatcatctgaaggagaaatctatgctcagctatggaaatgtgattgacctgaaccacctggatatcgacgaacccacgggccagaccgccgattggctctccatcgtcgtgtacctgacatctttcgttgtgcctattcttctgaaggctctctatatgctgaccacacgggggcgccagaccacaaaagacaataagggaatgagaatccggtttaaggacgatagctccttcgaggacgtcaacggcattcgcaaacccaagcatctttttctgagcatgcctaatgcccaatcttccatgaaagcggatgagatcacccccggcagattccggacggccatttgcgggctctaccctgctcaggtgaaggcccgcaacctggttagcccggtgatgtctgtcatcggatttctggctctcgccaaaaattggaccgaaagagtggaggaatggctggaccttccctgtaagctgctctccgagcctagccccacatctctgaccaaaggcccttccacaaaccgggattatcttaatcagcgccagggggcgctggccaagatggaaaccaaggaggctcaagccgtgagaaaacacgctattgacgccggatgcaacatcatcgatcatattgacagcccctcctctatctgggtcttcgccggcgctccggatcggtgtcctcccacgtgcctctttattgcggggatggccgagctgggagctttctttagcgttctgcaggacatgagaaatacaatcatggcctccaagaccattggcacaagcgaagagaaactccgcaagaaatcttccttctaccagagctatctgcggagaacccaatctatgggcatccagcttgatcagcgcatcattgtgctgtttatggtggactgggggaaggaagccgtcgacagcttccacctcggagatgacatggatcctgagctgcggggccttgctcaggccctgatcgaccaaaaggtgaaagaaatttccaaccaggagcccctcaagctgtga

SEQ ID NO: 7001 - RNA, 1290 nt, synthetic construct
  misc_feature 1..1290: note = derived and/or modified CDS sequence (opt5) from DOBV(Kurkino/44Aa/98)__AJ131672.1__N
  source 1..1290: mol_type = other RNA
atggccaccctggaggaactccagaaggagatcaacagccacgaaggccaactggtgattgctagacagaaagtcaaggacgccgagaaacagcatgaaaaggatcccgacgatcttaataaacgggcgctgtccgaccgcgagtctgttgctcagagcatccaatccaagattgatgagctcagacggcagctggccgaccgcgtggccgctgggaagaacatcggaaaagaaagagatcctacaggccttgacccgggggatcacctgaaggagaaatctatgctcagctacggaaatgtgattgacctgaaccatctggatatcgacgaacccacgggccagaccgccgattggctctccatcgtcgtgtatctgacatctttcgttgtgcctattcttctgaaggctctctacatgctgaccacacgggggcgccagaccacaaaagacaataagggaatgagaatccggtttaaggacgatagctccttcgaggacgtcaacggcattcgcaaacccaagcacctttttctgagcatgcctaatgcccaatcttccatgaaagcggatgagatcacccccggcagattccggacggccatttgcgggctctatcctgctcaggtgaaggcccgcaacctggttagcccggtgatgtctgtcatcggatttctggctctcgccaaaaattggaccgaaagagtggaggaatggctggaccttccctgtaagctgctctccgagcctagccccacatctctgaccaaaggcccttccacaaaccgggattaccttaatcagcgccaggcggccctggctaagatggaaaccaaggaggcccaagctgtgagaaaacatgccattgacgccgggtgcacgatcatcgattatattgacagcccctcctctatctgggtcttcgctggagcgccggatcggtgtcctcccacatgcctctttattgccggcatggctgagctgggggccttctttagcgttctgcaggacatgagaaacaccatcatggcctccaagacagtgggaaccagcgaagagaaactccgcaagaaatcttccttctaccagagctatctgcggagaacccaatctatgggcattcagcttgatcagcgcatcatcgtgctgtttatggtcgactggggcaaggaagctgtggacagcttccacctcggggatgacatggatcctgagctgcggggacttgcccaggcgctgattgaccaaaaggttaaagaaatctccaatagagagcccctcaagctgtga

SEQ ID NO: 7002 - RNA, 1290 nt, synthetic construct
  misc_feature 1..1290: note = derived and/or modified CDS sequence (opt5) from DOBV(Kurkino/53Aa/98)__AJ131673.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctgttgctcagagcatccaatccaagattgatgagctcagacggcagctggccgaccgcgtggccgctgggaagaacatcggaaaagaaagagatcctacaggccttgacccgggggatcatctgaaggagaaatctatgctcagctatggaaatgtgattgacctgaaccacctggatatcgacgaacccacgggccagaccgccgattggctctccatcgtcgtgtacctgacatctttcgttgtgcctattcttctgaaggctctctatatgctgaccacacgggggcgccagaccacaaaagacaataagggaatgagaatccggtttaaggacgatagctccttcgaggacgtcaacggcattcgcaaacccaagcatctttttctgagcatgcctaatgcccaatcttccatgaaagcggatgagatcacccccggcagattccggacggccatttgcgggctctaccctgctcaggtgaaggcccgcaacctggttagcccggtgatgtctgtcatcggatttctggctctcgccaaaaattggaccgaaagagtggaggaatggctggaccttccctgtaagctgctctccgagcctagccccacatctctgaccaaaggcccttccacaaaccgggattatcttaatcagcgccaggcggccctggctaagatggaaaccaaggaggcccaagctgtgagaaaacacgccattgacgccgggtgcacgatcatcgatcatattgacagcccctcctctatctgggtcttcgctggagcgccggatcggtgtcctcccacatgcctctttattgccggcatggctgagctgggggccttctttagcgttctgcaggacatgagaaacaccatcatggcctccaagacagtgggaaccagcgaagagaaactccgcaagaaatcttccttctaccagagctatctgcggagaacccaatctatgggcattcagcttgatcagcgcatcatcgtgctgtttatggtcgactggggcaaggaagctgtggacagcttccacctcggggatgacatggatcctgagctgcggggacttgcccaggcgctgattgaccaaaaggttaaagaaatctccaatagagagcccctcaagctgtga

SEQ ID NO: 7003 - RNA, 1290 nt, synthetic construct
  misc_feature 1..1290: note = derived and/or modified CDS sequence (opt5) from DOBV(Saar/90Aa/97)__AJ009775.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctatcgctcagagcattcaagggaagatcgatgagctcagacggcagctggccgaccgcgttgccgctggaaagaacattggcagagaacgggatcctacagggcttgacccgggagatcatctgaaagagaagtccatgctctcttatggcaatgtgatcgacctgaaccacctggatatcgacgaacccacggggcagaccgccgattggctcagcattgtgatctacctgacatccttcgtcgtgcctattcttctgaaagctctctatatgctgaccacacgcggaagacagaccacaaaggacaataaaggcatgcggatccgctttaaggacgattctagcttcgaggacgttaacggcattagaaagcccaaacatctttttctgtccatgcctaatgcccaaagctctatgaaggcggatgagatcacccccgggcggttccgcacggccgtgtgcggactctaccctgctcaggtcaaagccagaaacctgatttccccggtgatgagcgttatcggctttctgaccctcgctaagaattggacagaacgggtggaggaatggctggaccttccctgtaaactgctctctgagccttcccccaccagcctgacaaaggggccttctaccaaccgcgattatctttcccagagacagggagccctggcgaaaatggaaacgaaggaggcccaagctgtccggaagcacgccatcgacgctggctgcaatattatcgatcatattgacagcccctcctctatctgggtgttcgccggggccccggatagatgtcctcccacatgcctctttattgctggaatggcggagctgggcgccttctttgctgtgctgcaggacatgcgcaacaccatcatggccagcaaaacaatcggcacctccgaagagaagctccggaaaaagagctctttctaccagtcctatctgagacgcacccaaagcatggggattcagcttgatcagcggatcattgtcctgtttatgatcgaatggggaaaagaggccgttgactctttccacctcggcgacgatatggaccctgaaattagaagcctggctcaggcccttatcgatcaaaaggtgaaggagatctccaatcaggagcccctgaaactctga

SEQ ID NO: 7004 - RNA, 1290 nt, synthetic construct
  misc_feature 1..1290: note = derived and/or modified CDS sequence (opt5) from DOBV(SK/Aa)__AY961615.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacggacactgtccgaccgcgagtctgttgcgcagagcatccaatccaagattgatgagctcagacggcagctggctgaccgcgtggccgccgggaagaacatcggaaaagaaagagatcctacgggccttgacccgggggatcatctgaaggagaaatctatgctcagctatggaaatgtgattgacctgaaccacctggatatcgacgaacccaccggccagacagctgattggctctccatcgtcgtgtacctgacctctttcgttgtgcctattcttctgaaggccctctatatgctgacaacccgggggcgccagacaaccaaagacaataagggaatgagaatccggtttaaggacgatagctccttcgaggacgtcaacggcattcgcaaacccaagcatctttttctgagcatgcctaatgctcaatcttccatgaaagccgatgagatcacgcccggcagattccggaccgcgatttgcgggctctaccctgcccaggtgaaggctcgcaacctggttagcccggtgatgtctgtcatcggatttctggccctcgctaaaaattggacagaaagagtggaggaatggctggaccttccctgtaagctgctctccgagcctagccccacctctctgacaaaaggcccttccaccaaccgggattatcttaatcagcgccagggggccctggcgaagatggaaacgaaggaggcccaagctgtgagaaaacacgccattgacgctggatgcaacatcatcgatcatattgacagcccctcctctatctgggtcttcgccggcgccccggatcggtgtcctcccacatgcctctttattgctgggatggcggagctgggagccttctttagcgttctgcaggacatgagaaataccatcatggcttccaagacaattggcaccagcgaagagaaactccgcaagaaatcttccttctaccagagctatctgcggagaacccaatctatgggcatccagcttgatcagcgcatcattgtgctgtttatggtggactgggggaaggaagccgtcgacagcttccacctcggagatgacatggatcctgagctgcggggccttgcccaggctctgatcgaccaaaaggtgaaagaaatttccaaccaggagcccctcaagctgtga

SEQ ID NO: 7005 - RNA, 1290 nt, synthetic construct
  misc_feature 1..1290: note = derived and/or modified CDS sequence (opt5) from DOBV(A35)__GU904030.1__N
  source 1..1290: mol_type = other RNA
atggccaccctggaggaactccagaaggagatcaacaatcacgaaggccaactggtgattgctagacagaaagtcaaggacgccgagaaacagtacgaaaaggatcccgacgatcttaacaaacgggcgctgagcgaccgcgagtccatcgctcagtctattcaagggaagatcgatgagctcagacggcagctggccgaccgcgttgccgctggaaagaatattggcaaagaaagagatcctacagggcttgacccgggagatcatctgaaggagaaaagcatgctctcctatggcaacgtgatcgacctgaatcacctggatatcgacgaacccacggggcagaccgccgattggctctctattgtgatctacctgaccagcttcgtcgtgcctattcttctgaaggctctctatatgctgacaacacggggacgccagaccacaaaagacaacaagggcatgagaatccggtttaaggacgattcctctttcgaggacgttaatggcattcgcaaacccaagcatctttttctgagcatgcctaacgcccaatccagcatgaaagcggatgagatcacccccgggagattccggacggccatttgcggactctaccctgctcaggtgaaggcccgcaatctgatctctccggtcatgtccgtgatcggctttgttgctctggccaaaaactggaccgaaagagtggaggaatggctcgacctgccctgtaaacttctgagcgagccttctcccacatccctcaccaaggggcctagcacaaatcgggattatctgaaccagcgccagggagcgcttgccaagatggaaaccaaggaggctcaagccgtcagaaaacacgctattgacgccggctgcaatctgatcgatcatattgactctccctccagcatctgggtgttcgccggggctccggatcggtgtcctcccacgtgcctctttattgcgggaatggccgagctgggcgctttctttgccgtgctgcaggacatgagaaacacaatcatggcctccaagaccatcggcacatctgaagagaaactcaagaaaaagagctccttctaccagagctatctgcgccggacccaatctatggggattcagcttgatcagagaatcattgtcctgtttatggttgactggggaaaggaagctgtggactccttccacctcggcgatgacatggatcctgagctgcgcgggcttgcccaggcgctgatcgaccaaaaagtgaaggaaattagcaatcaggagcccctcaaactgtga

SEQ ID NO: 7006 - RNA, 1290 nt, synthetic construct
  misc_feature 1..1290: note = derived and/or modified CDS sequence (opt5) from DOBV(3970/87)__L41916.1__N
  source 1..1290: mol_type = other RNA
atggccaccctggaggaactccagaaggagatcaacaatcacgaaggccaactggtgattgctagacagaaagtcaaggacgccgagaaacagtacgaaaaggatcccgacgatcttaacaaacgggcgctgagcgaccgcgagtccatcgctcagtctattcaagggaagatcgatgagctcagacggcagctggccgaccgcgttgccgctggaaagaatattggcaaagaaagagatcctacagggcttgacccgggagatcatctgaaggagaaaagcatgctctcctatggcaacgtgatcgacctgaatcacctggatatcgacgaacccacggggcagaccgccgattggctctctattgtgatctacctgaccagcttcgtcgtgcctattcttctgaaggctctctatatgctgacaacacggggacgccagaccacaaaagacaacaagggcatgagaatccggtttaaggacgattcctctttcgaggacgttaatggcattcgcaaacccaagcatctttttctgagcatgcctaacgcccaatccagcatgaaagcggatgagatcacccccgggagattccggacggccatttgcggactctaccctgctcaggtgaaggcccgcaatctgatctctccggtcatgtccgtgatcggctttgttgctctggccaaaaactggaccgaaagagtggaggaatggctcgacctgccctgtaaacttctgagcgagccttctcccacatccctcaccaaggggcctagcacaaatcgggattatctgaaccagcgccagggagcgcttgccaagatggaaaccaaggaggctcaagccgtcagaaaacacgctattgacgccggctgcaatctgatcgatcatattgactctccctccagcatctgggtgttcgccggggctccggatcggtgtcctcccacgtgcctctttattgcgggaatggccgagctgggcgctttctttgcctgtctgcaggacatgagaaacacaatcatggcctccaagaccatcggcacatctgaagagaaactcaagaaaaagagctccttctaccagagctatctgcgccggacccaatctatggggattcagcttgatcagagaatcattgtgctgtttatggtcgactggggaaaggaagctgttgactccttccacctcggcgatgacatggatcctgagctgcgcgggcttgcccaggcgctgatcgaccaaaaagtgaaggaaattagcaatcaggagcccctcaaactgtga

SEQ ID NO: 7007 - RNA, 1290 nt, synthetic construct
  misc_feature 1..1290: note = derived and/or modified CDS sequence (opt5) from DOBV(Klyuch-2000)__AF442622.1__N
  source 1..1290: mol_type = other RNA
atggccaccctggaggaactccagaaggagatcaacagccacgaaggccaactggtgattgctagacggaaagtcaaggacgccgagaaacagtacgaaaaggatcccgacgatcttaataaacgcgcgctgtccgacagagagtctgttgctcagagcatccaggggaagattgatgagctccggcgccaactggccgacagagtggccgctggaaagaacatcggcaaagaacgggatcctacagggcttgacccgggagatcatctgaaggagaaatccatgctctcttatggcaatgtgattgacctgaaccacctggatatcgacgaacccacggggcagaccgccgattggctcagcatcgtcgtgtacctgacatccttcgttgtgcctattcttctgaaggctctctatatgctgaccacacgcggaagacagaccacaaaagacaataagggcatgcggatccgctttaaggacgattctagcttcgaggacgtcaacggcattagaaaacccaagcatctttttctgtccatgcctaatgcccagagctctatgaaagcggatgagatcacccccgggcggttccgcacggccgtgtgcggactctaccctgctcaagttaaggccagaaacctggtgtccccggtcatgagcgtgattggctttgtgtctctggctaaaaattggaccgaacgggtcgaggaatggctcgacctgccctgtaaacttctgtccgagcctagccccacatctctcaccaaggggccttccacaaaccgcgattatctgaatcagagacagggagcccttgcgaagatggaaaccaaggaggcccaggctgttcggaaacacgccatcaacgctggctgcaatctggtggaccatattgatagcccctcctctatctgggtgttcgccggggccccggacagatgtcctcccacgtgcctctttgtcgctggaatggcggagctgggcgccttctttgctgtgctgcaagatatgcgcaacacaatcatggccagcaagaccattggcacatccgaagagaaactccggaagaaaagctctttctaccagtcctatctgagacgcacccagagcatggggatccaacttgaccagcggattatcgttctgtttatggtggattggggaaaggaagccgtcgactctttccacctcggcgacgatatggaccctgagctgagagggcttgctcaggccctgattgaacagaaggtgaaagagatcagcaatcaagagcccctcaagctgtga

SEQ ID NO: 7008 - RNA, 1290 nt, synthetic construct
  misc_feature 1..1290: note = derived and/or modified CDS sequence (opt5) from DOBV(10636/Ap)__KP878311.1__N
  source 1..1290: mol_type = other RNA
atggccaccctggaggaactccagaaggagatcaacaatcacgaaggccaactggtgattgctagacagaaagtcaaggacgccgagaaacagtacgaaaaggatcccgacgatcttaacaaacgggcgctgagcgaccgcgagtccgttgctcagtctatccaagggaagattgatgagctcagacggcagctggccgaccgcgtggccgctggaaagaatatcggcaaagaaagagatcctacagggcttgacccgggagatcatctgaaggagaaaagcatgctctcctatggcaacgtgattgacctgaatcacctggatatcgacgaacccacggggcagaccgccgattggctctctatcgtcgtgtacctgaccagcttcgttgtgcctattcttctgaaggctctctatatgctgacaacacggggacgccagaccacaaaagacaacaagggcatgagaatccggtttaaggacgattcctctttcgaggacgtcaatggcattcgcaaacccaagcatctttttctgagcatgcctaacgcccaatccagcatgaaagcggatgagatcacccccgggagattccggacggccgtgtgcggactctaccctgctcaggttaaggcccgcaatctggtgtctccggtcatgtccgtgattggctttgtgagcctggctaaaaactggaccgaaagagtcgaggaatggctcgacctgccctgtaaacttctgtctgagccttcccccacaagcctcaccaaggggccttctacaaatcgggattatctgaaccagcgccagggagcccttgcgaagatggaaaccaaggaggcccaagctgttagaaaacacgccatcgacgctggctgcaatctggtggatcatattgactcccccagctccatctgggtgttcgccggggccccggatcggtgtcctcccacgtgcctctttgtcgctggaatggcggagctgggcgccttctttgctgtgctgcaggacatgagaaacacaatcatggcctctaagaccattggcacaagcgaagagaaactccgcaagaaatccagcttctaccagtcttatctgcggagaacccaatccatggggatccagcttgatcagcgcattatcgttctgtttatggtggactggggaaaggaagccgtcgacagcttccacctcggcgatgacatggatcctgagctgcggtctcttgctcaggccctgattgaccaaaaggtgaaagaaatcagcaatcaggagcccctcaagctgtga

SEQ ID NO: 7009 - RNA, 1290 nt, synthetic construct
  misc_feature 1..1290: note = derived and/or modified CDS sequence (opt5) from DOBV(10645/Ap)__KP878312.1__N
  source 1..1290: mol_type = other RNA
atggccaccctggaggaactccagaaggagatcaacaatcacgaaggccaactggtgattgctagacagaaagtcaaggacgccgagaaacagtacgaaaaggatcccgacgatcttaacaaacgggcgctgagcgaccgcgagtccgttgctcagtctatccaagggaagattgatgagctcagacggcagctggccgaccgcgtggccgctggaaagaatatcggcaaagaaagagatcctacagggcttgacccgggagatcatctgaaggagaaaagcatgctctcctatggcaacgtgattgacctgaatcacctggatatcgacgaacccacggggcagaccgccgattggctctctatcgtcgtgtacctgaccagcttcgttgtgcctattcttctgaaggctctctatatgctgacaacacggggacgccagaccacaaaagacaacaagggcatgagaatccggtttaaggacgattcctctttcgaggacgtcaatggcattcgcaaacccaagcatctttttctgagcatgcctaacgcccaatccagcatgaaagcggatgagatcacccccgggagattccggacggccgtgtgcggactctaccctgctcaggttaaggcccgcaatctggtgtctccggtcatgtccgtgattggctttgtgagcctggctaaaaactggaccgaaagagtcgaggaatggctcgacctgccctgtaaacttctgtctgagccttcccccacaagcctcaccaaggggccttctacaaatcgggattatctgaaccagcgccagggagcccttgcgaagatggaaaccaaggaggcccaagctgttagaaaacacgccatcgacgctggctgcaatctggtggatcatattgactcccccagctccatctgggtgttcgccggggccccggatcggtgtcctcccacgtgcctctttgtcgctggaatggcggagctgggcgccttctttgctgtgctgcaggacatgagaaacacaatcatggcctctaagaccattggcacaagcgaagagaaactccgcaagaaatccagcttctaccagtcttatctgcggagaacccaatccatggggatccagcttgatcagcgcattatcgttctgtttatggtggactggggaaaggaagccgtcgacagcttccacctcggcgatgacatggatcctgagctgcgggggcttgctcaggccctgattgaccaaaaggtgaaagaaatctctaatcaggagcccctcaagctgtga

SEQ ID NO: 7010 - RNA, 1290 nt, synthetic construct
  misc_feature 1..1290: note = derived and/or modified CDS sequence (opt5) from DOBV(Aa1854/Lipetsk-02)__EU188452.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctgttgctcagagcatccaatccaagattgatgagctcagacggcagctggccgaccgcgtggccgctgggaagaacatcggaaaagaaagagatcctacaggccttgacccgggggatcatctgaaggagaaatctatgctcagctatggaaatgtgattgacctgaaccacctggatatcgacgaacccacgggccagaccgccgattggctctccatcgtcgtgtacctgacatctttcgttgtgcctattcttctgaaggctctctatatgctgaccacacgggggcgccagaccacaaaagacaataagggaatgagaatccggtttaaggacgatagctccttcgaggacgtcaacggcattcgcaaacccaagcatctttttctgagcatgcctaatgcccaatcttccatgaaagcggatgagatcacccccggcagattccggacggccatttgcgggctctaccctgctcaggtgaaggcccgcaacctggttagcccggtgatgtctgtcatcggatttctggctctcgccaaaaattggaccgaaagagtggaggaatggctggaccttccctgtaagctgctctccgagcctagccccacatctctgaccaaaggcccttccacaaaccgggattatcttaatcagcgccaggcggccctggctaagatggaaaccaaggaggcccaagctgtgagaaaacacgccattgacgccgggtgcacgatcatcgatcatattgacagcccctcctctatctgggtcttcgctggagcgccggatcggtgtcctcccacatgcctctttattgccggcatggctgagctgggggccttctttagcgttctgcaggacatgagaaacaccatcatggcctccaagcctgtgggaacaagcgaagagaaactccgcaagaaatcttccttctaccagagctatctgcggagaacccaatctatgggcattcagcttgatcagcgcatcatcgtgctgtttatggtcgactggggcaaggaagctgtggacagcttccacctcggggatgacatggatcccgagctgcggggacttgcccaggcgctgattgaccaaaaggttaaagaaatctccaatcaggagcccctcaagctgtga

SEQ ID NO: 7011 - RNA, 1290 nt, synthetic construct
  misc_feature 1..1290: note = derived and/or modified CDS sequence (opt5) from DOBV(Ap/Sochi/43)__JF920151.1__N
  source 1..1290: mol_type = other RNA
atggccaccctggaggaactccagaaggagatcaacaatcacgaaggccaactggtgattgctagacagaaagtcaaggacgccgagaaacagtacgaaaaggatcccgacgatcttaacaaacgggcgctgagcgaccgcgagtccgttgctcagtctatccaagggaagattgatgagctcagacggcagctggccgaccgcgtggccgctggaaagaatatcggcaaagaaagagatcctacagggcttgacccgggagatcatctgaaggagaaaagcatgctctcctatggcaacgtgattgacctgaatcacctggatatcgacgaacccacggggcagaccgccgattggctctctatcgtcgtgtacctgaccagcttcgttgtgcctattcttctgaaggctctctatatgctgacaacacggggacgccagaccacaaaagacaacaagggcatgagaatccggtttaaggacgattcctctttcgaggacgtcaatggcattcgcaaacccaagcatctttttctgagcatgcctaacgcccaatccagcatgaaagcggatgagatcacccccgggagattccggacggccgtgtgcggactctaccctgctcaggttaaggcccgcaatctggtgtctccggtcatgtccgtgattggctttgtgagcctggctaaaaactggaccgaaagagtcgaggaatggctcgacctgccctgtaaacttctgtctgagccttcccccacaagcctcaccaaggggccttctacaaatcgggattatctgaaccagcgccagggagcccttgcgaagatggaaaccaaggaggcccaagctgttagaaaacacgccatcgacgctggctgcaatctggtggatcatattgactcccccagctccatctgggtgttcgccggggccccggatcggtgtcctcccacgtgcctctttgtcgctggaatggcggagctgggcgccttctttgctgtgctgcaggacatgagaaacacaatcatggcctctaagaccattggcacaagcgaagagaaactccgcaagaaatccagcttctaccagtcttatctgcggagaacccactccatggggatccaacttgatcagcgcattatcgttctgtttatggtggactggggaaaggaagccgtcgacagcttccacctcggcgatgacatggatcctgagctgcgggggcttgctcaggccctgattgaccagaaggtgaaagaaatctctaatcaagagcccctcaagctgtga

SEQ ID NO: 7012 - RNA, 1290 nt, synthetic construct
  misc_feature 1..1290: note = derived and/or modified CDS sequence (opt5) from DOBV(Ap/Sochi/hu)__JF920150.1__N
  source 1..1290: mol_type = other RNA
atggccaccctggaggaactccagaaggagatcaacaatcacgaaggccaactggtgattgctagacagaaagtcaaggacgccgagaaacagtacgaaaaggatcccgacgatcttaacaaacgggcgctgagcgaccgcgagtccgttgctcagtctatccaagggaagattgatgagctcagacggcagctggccgaccgcgtggccgctggaaagaatatcggcaaagaaagagatcctacagggcttgacccgggagatcatctgaaggagaaaagcatgctctcctatggcaacgtgattgacctgaatcacctggatatcgacgaacccacggggcagaccgccgattggctctctatcgtcgtgtacctgaccagcttcgttgtgcctattcttctgaaggctctctatatgctgacaacacggggacgccagaccacaaaagacaacaagggcatgagaatccggtttaaggacgattcctctttcgaggacgtcaatggcattcgcaaacccaagcatctttttctgagcatgcctaacgcccaatccagcatgaaagcggatgagatcacccccgggagattccggacggccgtgtgcggactctaccctgctcaggttaaggcccgcaatctggtgtctccggtcatgtccgtgattggctttctgagcctcgctaaaaactggaccgaaagagtggaggaatggctggaccttccctgtaagctgctctctgagccttcccccacaagcctgaccaaagggccttctacaaatcgggattatcttaaccagcgccagggagccctggcgaagatggaaaccaaggaggcccaagctgtcagaaaacacgccatcgacgctggctgcaatctcgttgatcatattgactcccccagctccatctgggtgttcgccggggccccggatcggtgtcctcccacgtgcctgtttgtggctggaatggcggagctgggcgccttctttgctgtcctccaggacatgagaaacacaatcatggcctctaagaccattggcacaagcgaagagaaactgcgcaagaaatccagcttctaccagtcttatcttcggagaacccactccatggggatccaactggatcagcgcattatcgtgctctttatggttgactggggaaaggaagccgtggacagcttccacctgggcgatgacatggatcctgagcttcgggggctggctcaggccctcattgaccagaaggtcaaagaaatctctaatcaagagcccctgaagctgtga

SEQ ID NO: 7013 - RNA, 1290 nt, synthetic construct
  misc_feature 1..1290: note = derived and/or modified CDS sequence (opt5) from DOBV(Ap1584/Sochi-01)__EU188449.1__N
  source 1..1290: mol_type = other RNA
atggccaccctggaggaactcaagaaagagatcaacaatcacgaaggccagctggtgattgctagacaaaaggtcaaagacgccgagaagcagtacgaaaaagatcccgacgatcttaacaagcgggcgctgagcgaccgcgagtccgttgctcagtctatccaggggaagattgatgagctcagacggcaactggccgaccgcgtggccgctggaaagaatatcggcaaggaaagagatcctacagggcttgacccgggagatcatctgaaagagaaaagcatgctctcctatggcaacgtgattgacctgaatcacctggatatcgacgaacccacggggcagaccgccgattggctctctatcgtcgtgtacctgaccagcttcgttgtgcctattcttctgaaagctctctatatgctgacaacacggggacgccagaccacaaaggacaacaagggcatgagaatccggtttaaagacgattcctctttcgaggacgtcaatggcattcgcaagcccaaacatctttttctgagcatgcctaacgcccagtccagcatgaaggcggatgagatcacccccgggagattccggacggccgtgtgcggactctaccctgctcaagttaaagcccgcaatctggtgtctccggtcatgtccgtgattggctttgtgagcctggctaagaactggaccgaaagagtcgaggaatggctcgacctgccctgtaaacttctgtctgagccttcccccacaagcctcaccaaggggccttctacaaatcgggattatctgaaccagcgccagggagcccttgcgaagatggaaaccaaagaggcccaggctgttagaaagcacgccatcgacgctggctgcaatctggtggatcatattgactcccccagctccatctgggtgttcgccggggccccggatcggtgtcctcccacgtgcctctttgtcgctggaatggcggagctgggcgccttctttgctgtgctgcaagacatgagaaacacaatcatggcctctaaaaccattggcacaagcgaagagaagctccgcaaaaagtccagcttctaccagtcttatctgcggagaacccagtccatggggatccaacttgatcagcgcattatcgttctgtttatggtggactggggaaaggaagccgtcgacagcttccacctcggcgatgacatggatcctgagctgcgggggcttgctcaggccctgattgaccagaaagtgaaggaaatctctaatcaagagcccctcaaactgtga

SEQ ID NO: 7014 - RNA, 1290 nt, synthetic construct
  misc_feature 1..1290: note = derived and/or modified CDS sequence (opt5) from DOBV(DOB/Gola/235Af/07)__KC848495.1__N
  source 1..1290: mol_type = other RNA
atggccaccctggaggaactccagaaggagatcaacaatcacgaaggccaactggtgattgctagacagaaagtcaaggacgccgagaaacagtacgaaaaggatcccgacgatcttaacaaacgggcgctgagcgaccgcgagtccatcgctcagtctattcaagggaagatcgatgagctcagacggcagctggccgaccgcgttgccgctggaaagaatattggcaaagaaagagatcctacagggcttgacccgggagatcatctgaaggagaaaagcatgctctcctatggcaacgtgatcgacctgaatcacctggatatcgacgaacccacggggcagaccgccgattggctctctattgtggtctacctgaccagcttcgtggttcctatccttctgaaggctctctatatgctgacaacacggggacgccagaccacaaaagacaacaagggcatgcggattagatttaaggacgattcctctttcgaggacgtgaatggcatccgcaaacccaagcatctttttctgagcatgcctaacgcccaatccagcagaaaagcggatgagattacccccgggcggttccgcacggccatctgcggactctaccctgctcaggtcaaggccagaaatctgatttctccggtgatgtccgttatcggctttctggctctcgccaaaaactggaccgaacgggtggaggaatggctggaccttccctgtaagctgctcagcgagccttctcccacatccctgaccaaagggcctagcacaaatcgcgattatcttaaccagagacagggagcgctggccaagatggaaaccaaggaggctcaagccgtccggaaacacgctatcgacgccggctgcaatctcattgatcatatcgactctccctccagcatttgggtgttcgccggggctccggatagatgtcctcccacgtgcctgtttatcgcgggaatggccgagctgggcgctttctttgccgtgctccaggacatgcgcaacacaattatggcctccaagaccatcggcacatctgaagagaaactgaagaaaaagagctccttctaccagagctatcttcggagaacccaatctatggggatccagctggatcagcgcattatcgtcctctttatggttgactggggaaaggaagctgtggactccttccacctgggcgatgacatggatcctgagcttcgggggctggcccaggcgctcattgaccaaaaagtgaaggaaatcagcaatcaggagcccctgaaactgtga

SEQ ID NO: 7015 - RNA, 1290 nt, synthetic construct
  misc_feature 1..1290: note = derived and/or modified CDS sequence (opt5) from DOBV(DOB/Gola/343Af/07)__KC848498.1__N
  source 1..1290: mol_type = other RNA
atggccaccctggaggaactccagaaggagatcaacaatcacgaaggccaactggtgattgctagacagaaagtcaaggacgccgagaaacagtacgaaaaggatcccgacgatcttaacaaacgggcgctgagcgaccgcgagtccatcgctcagtctattcaagggaagatcgatgagctcagacggcagctggccgaccgcgttgccgctggaaagaatattggcaaagaaagagatcctacagggcttgacccgggagatcatctgaaggagaaaagcatgctctcctatggcaacgtgatcgacctgaatcacctggatatcgacgaacccacggggcagaccgccgattggctctctattgtggtctacctgaccagcttcgtggttcctatccttctgaaggctctctatatgctgacaacacggggacgccagaccacaaaagacaacaagggcatgcggattagatttaaggacgattcctctttcgaggacgtgaatggcatccgcaaacccaagcatctttttctgagcatgcctaacgcccaatccagcatgaaagcggatgagattacccccgggagattccggacggccatctgcggactctaccctgctcaggtcaaggcccgcaatctgatttctccggtgatgtccgttatcggctttctggctctcgccaaaaactggaccgaaagagtggaggaatggctggaccttccctgtaagctgctcagcgagccttctcccacatccctgaccaaagggcctagcacaaatcgggattatcttaaccagcgccagggagcgctggccaagatggaaaccaaggaggctcaagccgtcagaaaacacgctacggacgccggctgcaatctcatcgatcatattgactctccctccagcatctgggtgttcgccggggctccggatcggtgtcctcccacatgcctgtttattgcgggaatggccgagctgggcgctttctttgccgtgctccaggacatgagaaacaccatcatggcctccaagacaattggcacctctgaagagaaactgaagaaaaagagctccttctaccagagctatcttcgccggacccaatctatggggatccagctggatcagagaatcattgtcctctttatggttgactggggaaaggaagctgtggactccttccacctgggcgatgacatggatcctgagcttcgcgggctggcccaggcgctcatcgaccaaaaagtgaaggaaattagcaatcaggagcccctgaaactgtga

SEQ ID NO: 7016 - RNA, 1290 nt, synthetic construct
  misc_feature 1..1290: note = derived and/or modified CDS sequence (opt5) from DOBV(DOB/Pecs/27Aa/06)__KC848499.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctgttgctcagagcatccaatccaagattgatgagctcagacggcagctggccgaccgcgtggccgctgggaagaacatcggaaaagaaagagatcctacaggccttgacccgggggatcatctgaaggagaaatctatgctcagctatggaaatgtgattgacctgaaccacctggatatcgacgaacccacgggccagaccgccgattggctctccatcgtcgtgtacctgacatctttcgttgtgcctattcttctgaaggctctctatatgctgaccacacgggggcgccagaccacaaaagacaataagggaatgagagtccggtttaaggacgatagctccttcgaggacgtgaacggcatccgcaaacccaagcatctttttctgagcatgcctaatgcccaatcttccatgaaagcggatgagattacccccggcagattccggacggccgtttgcgggctctaccctgctcaggtgaaggcccgcaacctggtcagcccggtgatgtctgtgatcggatttctggctctcgccaaaaattggaccgaaagagtcgaggaatggctggaccttccctgtaagctgctctccgagcctagccccacatctctgaccaaaggcccttccacaaaccgggattatcttaatcagcgccagggggcgctggccaagatggaaaccaaggaggctcaagccgttagaaaacacgctattgacgccggatgcaacatcattgatcatatcgacagcccctcctctatctgggtgttcgccggcgctccggatcggtgtcctcccacgtgcctctttattgcggggatggccgagctgggagctttctttagcgtgctgcaggacatgagaaatacaatcatggcctccaagaccattggcacaagcgaagagaaactccgcaagaaatcttccttctaccagagctatctgcggagaacccaatctatgggcatccagcttgatcagcgcattatcgtcctgtttatggtggactgggggaaggaagccgttgacagcttccacctcggagatgacatggatcctgagctgcggggccttgctcaggccctgatcgaccaaaaggtgaaagaaatttccaaccaggagcccctcaagctgtga

SEQ ID NO: 7017 - RNA, 1290 nt, synthetic construct
  misc_feature 1..1290: note = derived and/or modified CDS sequence (opt5) from DOBV(DOB/Pecs/31Aa/06)__KC848500.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctgttgctcagagcatccaatccaagattgatgagctcagacggcagctggccgaccgcgtggccgctgggaagaacatcggaaaagaaagagatcctacaggccttgacccgggggatcatctgaaggagaaatctatgctcagctatggaaatgtgattgacctgaaccacctggatatcgacgaacccacgggccagaccgccgattggctctccatcgtcgtgtacctgacatctttcgttgtgcctattcttctgaaggctctctatatgctgaccacacgggggcgccagaccacaaaagacaataagggaatgagaatccggtttaaggacgatagctccttcgaggacgtcaacggcattcgcaaacccaagcatctttttctgagcatgcctaatgcccaatcttccatgaaagcggatgagatcacccccggcagattccggacggccgtgtgcgggctctaccctgctcaggttaaggcccgcaacctggtgagcccggtcatgtctgtgattggatttctggctctcgccaaaaattggaccgaaagagtggaggaatggctggaccttccctgtaagctgctctccgagcctagccccacatctctgaccaaaggcccttccacaaaccgggattatcttaatcagcgccagggggcgctggccaagatggaaaccaaggaggctcaagccgtcagaaaacacgctatcgacgccggatgcaacattatcgatcatatcgacagcccctcctctatttgggttttcgccggcgctccggatcggtgtcctcccacgtgcctctttatcgcggggatggcccagctgggagctttctttagcgtgctgcaggacatgagaaatacaattatggcctccaagaccatcggcacaagcgaggaaaaactccgcaagaaatcttccttctaccaaagctatctgcggagaacccagtctatgggcattcagcttgatcagcgcatcatcgtgctgtttatggtcgactgggggaaggaggccgtggacagcttccacctcggagatgacatggatcctgaactgcggggccttgctcaagccctgattgaccagaagatgaaagagatctccaaccaggaacccctcaagctgtga

SEQ ID NO: 7018 - RNA, 1290 nt, synthetic construct
  misc_feature 1..1290: note = derived and/or modified CDS sequence (opt5) from DOBV(DOB/Sarmellek/77Aa/06)__KC848501.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctgttgctcagagcatccaatccaagattgatgagctcagacggcagctggccgaccgcgtggcctctgggaagaacatcggaaaagaaagagatcctacaggccttgacccgggggatcatctgacggaaaagagcatgctctcctatggaaatgtgattgacctgaaccacctggatatcgacgagcccaccggccagacagctgattggctctctatcgtcgtgtacctgaccagcttcgttgtgcctattcttctgaaagccctctatatgctgacaacccgggggcgccagacaaccaaggacaataaaggaatgagaatccggtttaaggacgattccagcttcgaggacgtcaacggcattcgcaagcccaaacatctttttctgtctatgcctaatgctcaatccagcatgaaggccgatgagatcacgcccggcagattccggaccgcgatttgcgggctctaccctgcccaggtgaaagctcgcaacctggtttctccggtgatgtccgtcatcggatttctggccctcgctaagaattggacagaaagagtggaggaatggctggaccttccctgtaaactgctcagcgagccttctcccacctccctgacaaagggccctagcaccaaccgggattatcttaatcagcgccagggggccctggcgaaaatggaaacgaaggaggcccaagctgtgagaaagcacgccattgacgctggatgcaacatcatcgatcatattgactccccctctagcatctgggtcttcgccggcgccccggatcggtgtcctcccacatgcctctttattgctgggatggcggagctgggagccttcttttccgttctgcaggacatgagaaataccatcatggctagcaaaacagtgggcacctctgaagagaagctccgcaaaaagtccagcttctaccagtcttatctgcggagaacccaaagcatgggcattcagcttgatcagcgcatcatcgtgctgtttatggtcgactgggggaaagaagccgtggactccttccacctcggagatgacatggatcctgagctgcggtctcttgcccaggctctgattgaccaaaaggttaaggaaatcagcaaccaggagcccctcaaactgtga

SEQ ID NO: 7019 - RNA, 1290 nt, synthetic construct
  misc_feature 1..1290: note = derived and/or modified CDS sequence (opt5) from DOBV(GER/05/239/Aa)__GQ205405.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctgttgctcagagcatccaagggaagattgatgagctcagacggcagctggccgaccgcgtggccgctggaaagaacatcggcaaagaaagagatcctacagggcttgacccgggagatcatctgaaggagaaatccatgctctcttatggcaatgtgattgacctgaaccacctggatatcgacgaacccacggggcagaccgccgattggctcagcatcgtcgtgtacctgacatccttcgttgtgcctattcttctgaaggctctctatatgctgaccacacggggacgccagaccacaaaagacaataagggcatgagaatccggtttaaggacgattctagcttcgaggacgtcaacggcattcgcaaacccaagcatctttttctgtccatgcctaatgcccaaagctctatgaaagcggatgagatcacccccgggagattccggacggccatttgcggactctaccctgctcaggtgaaggcccgcaacctggtttccccggtgatgagcgtcatcggctttctggctctcgccaaaaattggaccgaaagagtggaggaatggctggaccttccctgtaagctgctctctgagccttcccccacaagcctgaccaaagggccttctacaaaccgggattatctttcccagcgccagggagcgctggccaagatggaaaccaaggaggctcaagccgtgagaaaacacgctattgacgccggctgcaatatcatcgatcatattgacagcccctcctctatctgggtcttcgccggggctccggatcggtgtcctcccacgtgcctctttattgcgggaatggccgagctgggcgctttctttgccgttctgcaggacatgagaaacacaatcatggccagcaagaccattggcacatccgaagagaaactccgcaagaaaagctctttctaccagtcctatctgcggagaacccaaagcatggggatccagcttgatcagcgcatcattgtgctgtttatggtggactggggaaaggaagctgtcgactctttccacctcggcgatgacatggatcctgagctgcggagccttgcccaggcgctgatcgaccaaaaggtgaaagaaatttccaatcaggagcccctcaagctgtga

SEQ ID NO: 7020 - RNA, 1290 nt, synthetic construct
  misc_feature 1..1290: note = derived and/or modified CDS sequence (opt5) from DOBV(GER/05/477/Af)__GQ205406.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctgttgctcagagcatccaagggaagattgatgagctcagacggcagctggccgaccgcgtggccgctggaaagaacatcggcaaagaaagagatcctacagggcttgacccgggagatcatctgaaggagaaatccatgctctcttatggcaatgtgattgacctgaaccacctggatatcgacgaacccacggggcagaccgccgattggctcagcatcgtcgtgtacctgacatccttcgttgtgcctattcttctgaaggctctctatatgctgaccacacggggacgccagaccacaaaagacaataagggcatgagaatccggtttaaggacgattctagcttcgaggacgtcaacggcattcgcaaacccaagcatctttttctgtccatgcctaatgcccaaagctctatgaaagcggatgagatcacccccgggagattccggacggccatttgcggactctaccctgctcaggtgaaggcccgcaacctggtttccccggtgatgagcgtcatcggctttctggctctcgccaaaaattggaccgaaagagtggaggaatggctggaccttccctgtaagctgatttctgagccttcccccacaagcctcaccaaagggccttctacaaaccgggattatctgtcccagcgccagggagcgcttgccaagatggaaaccaaggaggctcaagccgtgagaaaacacgctatcgacgccggctgcaatatcattgatcatatcgacagcccctcctctatttgggtcttcgccggggctccggatcggtgtcctcccacgtgcctgtttatcgcgggaatggccgagctcggcgctttctttgccgttctgcaggacatgagaaacacaattatggccagcaagaccatcggcacatccgaagagaaactgcgcaagaaaagctctttctaccagtcctatctccggagaacccaaagcatggggatccagctggatcagcgcattatcgtgctttttatggtggactggggaaaggaagctgtcgactctttccacctgggcgatgacatggatcctgagctccggagcctggcccaggcgcttattgaccaaaaggtgaaagaaatctccaatcaggagcccctgaagctctga

SEQ ID NO: 7021 - RNA, 1290 nt, synthetic construct
  misc_feature 1..1290: note = derived and/or modified CDS sequence (opt5) from DOBV(GER/07/293/Aa)__GQ205401.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctgttgctcagagcatccaagggaagattgatgagctcagacggcagctggccgaccgcgtggccgctggaaagaacatcggcaaagaaagagatcctacagggcttgacccgggagatcatctgaaggagaaatccatgctctcttatggcaatgtgattgacctgaaccacctggatatcgacgaacccacggggcagaccgccgattggctcagcatcgtcgtgtacctgacatccttcgttgtgcctattcttctgaaggctctctatatgctgaccacacggggacgccagaccacaaaagacaataagggcatgagaatccggtttaaggacgattctagcttcgaggacgtcaacggcattcgcaaacccaagcatctttttctgtccatgcctaatgcccaaagctctatgaaagcggatgagatcacccccgggagattccggacggccatttgcggactctaccctgctcaggtgaaggcccgcaacctggtttccccggtgatgagcgtcatcggctttctggctctcgccaaaaattggaccgaaagagtggaggactggctggatcttccctgtaagctgctctctgaaccttcccccacaagcctgaccaaagggccttctacaaaccgggactatcttaatcagcgccagggagcgctggccaagatggagaccaaggaagctcaagccgtgagaaaacacgctattgatgccggctgcaacatcatcgaccatattgattcccccagctccatctgggtcttcgccggggctccggaccggtgtcctcccacgtgcctctttattgcgggaatggccgagctgggcgctttctttgccgttctgcaggatatgagaaatacaatcatggcctctaagaccattggcacaagcgaggaaaaactccgcaagaaatccagcttctaccagtcttatctgcggagaacccaatccatggggatccagcttgaccagcgcatcattgtgctgctcatggtggactggggaaaggaggctgtcgatagctttcacctgggcgacgatatggaccctgaacttcgggggctggcccaggcgctcatcgatcaaaaggtgaaagagatttctaaccaggaacccctgaagctgtga

SEQ ID NO: 7022 - RNA, 1290 nt, synthetic construct
  misc_feature 1..1290: note = derived and/or modified CDS sequence (opt5) from DOBV(GER/07/424/Aa)__GQ205403.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctgttgctcagagcatccaagggaagattgatgagctcagacggcagctggccgaccgcgtggccgctggaaagaacatcggcaaagaaagagatcctacagggcttgacccgggagatcatctgaaggagaaatccatgctctcttatggcaatgtgattgacctgaaccacctggatatcgacgaacccacggggcagaccgccgattggctcagcatcgtcgtgtacctgacatccttcgttgtgcctattcttctgaaggctctctatatgctgaccacacggggacgccagaccacaaaagacaataagggcatgagaatccggtttaaggacgattctagcttcgaggacgtcaacggcattcgcaaacccaagcatctttttctgtccatgcctaatgcccaaagctctatgaaagcggatgagatcacccccgggagattccggacggccatttgcggactctaccctgctcaggtgaaggcccgcaacctggtttccccggtgatgagcgtcatcggctttctggctctcgccaaaaattggaccgaaagagtggaggactggctggatcttccctgtaagctgctctctgaaccttcccccacaagcctgaccaaagggccttctacaaaccgggactatcttaatcagcgccagggagcgctggccaagatggagaccaaggaagctcaagccgtgagaaaacacgctattgatgccggctgcaacatcatcgaccatattgattcccccagctccatctgggtcttcgccggggctccggaccggtgtcctcccacgtgcctctttattgcgggaatggccgagctgggcgctttctttgccgttctgcaggatatgagaaatacaatcatggcctctaagaccattggcacaagcgaggaaaaactccgcaagaaatccagcttctaccagtcttatctgcggagaacccaatccatggggatccagcttgaccagcgcatcattgtgctgtttatggtggactggggaaaggaggctgtcgatagcttccacctcggcgacgatatggaccctgaactgcgggggcttgcccaggcgctgatcgatcaaaaggtgaaagagatttctaaccaggaacccctcaagctgtga

SEQ ID NO: 7023 - RNA, 1290 nt, synthetic construct
  misc_feature 1..1290: note = derived and/or modified CDS sequence (opt5) from DOBV(GER/08/118/Aa)__GQ205407.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctgttgctcagagcatccaagggaagattgatgagctcagacggcagctggccgaccgcgtggccgctggaaagaacatcggcaaagaaagagatcctacagggcttgacccgggagatcatctgaaggagaaatccatgctctcttatggcaatgtgattgacctgaaccacctggatatcgacgaacccacggggcagaccgccgattggctcagcatcgtcgtgtacctgacatccttcgttgtgcctattcttctgaaggctctctatatgctgaccacacggggacgccagaccacaaaagacaataagggcatgagaatccggtttaaggacgattctagcttcgaggacgtcaacggcattcgcaaacccaagcatctttttctgtccatgcctaatgcccaaagctctatgaaagcggatgagatcacccccgggagattccggacggccatttgcggactctaccctgctcaggtgaaggcccgcaacctggtttccccggtgatgagcgtcatcggctttctggctctcgccaaaaattggaccgaaagagtggaggactggctggatcttccctgtaagctgctctctgaaccttcccccacaagcctgaccaaagggccttctacaaaccgggactatcttaatcagcgccagggagcgctggccaagatggagaccaaggaagctcaagccgtgagaaaacacgctattgatgccggctgcaacatcatcgaccatattgattcccccagctccatctgggtcttcgccggggctccggaccggtgtcctcccacgtgcctctttattgcgggaatggccgagctgggcgctttctttgccgttctgcaggatatgagaaatacaatcatggcctctaagaccgtgggcacaagcgaggagaaaatgcgcaagaaatccagcttctaccagtcttatctccggagaacccaatccatggggattcagctggaccagcgcatcatcgtgctttttatggtcgactggggaaaggaagctgtggatagcttccacctgggcgacgatatggaccctgaactccgggggctggcccaggcgcttattgatcaaaaggttaaagagatctctaaccaggaacccctgaagctctga

SEQ ID NO: 7024 - RNA, 1290 nt, synthetic construct
  misc_feature 1..1290: note = derived and/or modified CDS sequence (opt5) from DOBV(GER/08/131/Af)__GQ205408.1__N
  source 1..1290: mol_type = other RNA
atggccaccctggaggaactccagaaggagatcaacagccacgaaggccaactggtgattgctagacagaaagtcaaggacgccgagaaacagtacgaaaaggatcccgacgatcttaataaacgggcgctgtccgaccgcgagtctgttgctcagagcatccaagggaagattgatgagctcagacggcagctggccgaccgcgtggccgctggaaagaacatcggcaaagaaagagatcctacagggcttgacccgggagatcatctgaaggagaaatccatgctctcttatggcaatgtgattgacctgaaccacctggatatcgacgaacccacggggcagaccgccgattggctcagcatcgtcgtgtacctgacatccttcgttgtgcctattcttctgaaggctctctatatgctgaccacacggggacgccagaccacaaaagacaataagggcatgagaatccggtttaaggacgattctagcttcgaggacgtcaacggcattcgcaaacccaagcatctttttctgtccatgcctaatgcccaaagctctatgaaagcggatgagatcacccccgggagattccggacggccgtgtgcggactctaccctgctcaggttaaggcccgcaacctggtgtccccggtcatgagcgtgattggctttctggctctcgccaaaaattggaccgaaagagtggaggactggctggatcttccctgtaagctgctctctgaaccttcccccacaagcctgaccaaagggccttctacaaaccgggactatcttaatcagcgccagggagcgctggccaagatggagaccaaggaagctcaagccgtcagaaaacacgctatcgatgccggctgcaacattatcgaccatatcgattcccccagctccatttgggttttcgccggggctccggaccggtgtcctcccacgtgcctctttatcgcgggaatggccgagctgggcgctttctttgccgtgctgcaggatatgagaaatacaattatggcctctaagaccatcggcacaagcgaggaaaaactccgcaagaaatccagcttctaccagtcttatctgcggagaacccaatccatggggattcagcttgaccagcgcatcatcgtgctgtttatggtcgactggggaaaggaggctgtggatagcttccacctcggcgacgatatggaccctgaactgcgggggcttgcccaggcgctgattgatcaaaaggttaaagagatctctaaccaggaacccctcaagctgtga

SEQ ID NO: 7025 - RNA, 1290 nt, synthetic construct
  misc_feature 1..1290: note = derived and/or modified CDS sequence (opt5) from HTNV(76-118/POR)__KT885049.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacaaaccgggagggggttgccgtgagcatccaggccaagattgatgaactgaaaatgcaactcgctgaccgcatcgccacgggaaagaatctgggcaaggagcaggatcctaccggggtggaaccgggagaccatcttaaagagagatccatgctgtcttatggcaacgtcctcgatctgaatcacctggacattgatgagcccacagggcagaccgctgactggctcagcatcatcgtgtacctgacatccttcgttgtgcctattcttctgaaggccctctatatgctgaccacacggggacgccagaccacgaaagataacaagggcaccagaatccggtttaaagacgattctagcttcgaagacgtcaatggcattcgcaagcccaagcatctttacgtgtccctgcctaacgcgcaatctagcatgaaagccgaggaaatcacacccgggagatatcggaccgctgtttgcggactctaccctgcccagattaaggctcgccagatgatctccccggtgatgagcgtcattggctttctggccctggcgaaagactggtctgatagaatcgagcagtggctcatcgaaccctgtaagctgcttcctgacacagccgctgtgtccctgctcgggggacccgccaccaatcgggattatctgcgccaaagacaggtggctcttggcaacatggagacgaaagagagcaaggccattcggcagcacgccgaagctgcggggtgctctatgatcgaggacattgaatcccctagctctatctgggtcttcgccggagctcccgatagatgtccgcctacatgcctgtttattgccggcatcgccgagctcggcgctttcttttccatcctgcaagacatgcgcaataccattatggccagcaaaacagttgggacctccgaagagaagctgcggaagaaatctagcttctaccagtcctacctcagacgcacccagagcatgggaatccagctggatcaacggattatcgtgctttttatggtggcgtggggcaaggaggctgtcgacaacttccatctgggggatgacatggatcccgaactcagaacactggcccagtctcttattgacgtgaaagttaaggagatctccaatcaggaacctctgaaactctga

SEQ ID NO: 7026 - RNA, 1290 nt, synthetic construct
  misc_feature 1..1290: note = derived and/or modified CDS sequence (opt5) from HTNV(A16)__AF288646.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggaggggctggccgccagcatccaggctaagattgacgaactcaaacgccaactggccgatagaatcgctacgggaaagaaccttggcaaggagcaggaccctaccggggttgaaccgggagatcatctgaaagagcggtccatgctctcttatggcaatgtgctggacctgaaccacctcgatattgacgagcccacagggcagaccgccgattggctgagcatcgtgatctaccttacatccttcgtcgtgcctattctgctcaaggcgctgtatatgcttaccacacgcggaagacagaccacgaaagacaataagggcacccggatccgctttaaagatgactctagcttcgaagacgttaacggcattagaaagcccaagcatctgtacgtgtccctccctaatgcccaatctagcatgaaagctgaggaaatcacacccgggcggtatcgcaccgccatttgcggactgtaccctgctcagatcaaggccagacagatgatttccccggtcatgagcgtgatcggctttctggcgctcgccaaagattggtctgaccggatcgagcagtggctgtccgaaccctgtaaacttctgcctgatacagctgccgttagcctccacgggggacccgctaccaaccgcgactatctgagacaaagacaggtggcccttggcaatatggagacgaaggagtctaaggccattcggcagcatgctgaatccgcggggtgcagcatggtcgaggatatcgaatctccttccagcatttgggtgttcgccggagctcccaaccgctgtccgcctacatgcctgtttatcgccggcattgccgagctcggcgctttcttttccatcctgcaagacatgcggaataccatcatggcctctaaaacagtggggaccagcgaagagaagctgagaaagaaatccagcttctaccagtcttacctccgccggacccagtccatgggcattcagctggatcaaagaatcattgtcctttttatggttgcgtggggaaaggaggctgtggacaacttccacctgggggatgacatggatcccgtgctccgcacactggcccagagccttatcgacgtcaaagtgaaggaaatttctaatcaggagcctctgaaactctga

SEQ ID NO: 7027 - RNA, 1290 nt, synthetic construct
  misc_feature 1..1290: note = derived and/or modified CDS sequence (opt5) from HTNV(CA09082007)__HQ834499.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatccaggctaagattgacgaactgaaacgccaactcgccgatagaatcgctacgggaaagaacctgggcaaggagcaggaccctaccggggtggaaccgggagatcatcttaaagagcggtccatgctgtcttatggcaatgtgctcgacctgaaccacctggatattgacgagcccacagggcagaccgccgattggctcagcatcgtcatctacctgacatccttcgtggttcctattcttctgaaggcgctctatatgctgaccacacgcggaagacagaccacgaaagacaataagggcacccggatccgctttaaagatgactctagcttcgaagacgtgaacggcattagaaagcccaagcatctttacgtctccctgcctaatgcccaatctagcatgaaagctgaggaaatcacacccgggcggtatcgcaccgccatttgcggactctaccctgctcagatcaaggccagacagatgatttccccggtgatgagcgttatcggctttctggcgctggccaaagattggtctgaccggatcgagcagtggctctccgaaccctgtaagctgcttcctgatacagctgccgtgagcctgcacgggggacccgctaccaaccgcgactatctcagacaacggcaggtcgccctgggcaatatggagacgaaagagtctaaggccattagacagcatgctgaatccgcggggtgcagcatggtggaggatatcgaatctccttccagcatttgggtgttcgccggagctcccgaccgctgtccgcctacatgcctttttatcgccggcattgccgagctgggcgctttcttttccatcctccaagatatgcggaacaccatcatggcctctaaaacagtcgggaccagcgaagagaagctgagaaagaaatccagcttctaccagtcttacattcgccggacccagtccatgggaatccagctggaccaaagaattatcgttctctttatggtggcgtggggcaaggaggctgtggataatttccacctgggggacgatatggaccccgaacttcgcacactggcccagagcctcattgacctgaaagtcaaggagatctctaaccaggaacctcttaaactgtga

SEQ ID NO: 7028 - RNA, 1290 nt, synthetic construct
  misc_feature 1..1290: note = derived and/or modified CDS sequence (opt5) from HTNV(CA10081109)__HQ834500.1__N
  source 1..1290: mol_type = other RNA
atgcccaccagcggcgagctgcagagagaaatcaacgcccacgaggggcaactcgtgattgctcggcagaaggtccgcgacgccgaaaagcagtacgagaaggatcctgacgaactgaataaaagagcgcttacagatcgggagggagttgctgcctccatccaggccaagattgacgagctgaaacgccaactcgctgatagaatcgccacgggcaagaacctggggaaggaacaggacccgaccggagtggagcccggcgatcatcttaaagaacggtctatgctgagctatgggaatgtgctcgacctgaaccacctggatattgacgagcctacaggacagaccgctgattggctctccatcgtcatctacctgacatctttcgtggttcccattcttctgaaggccctctatatgctgaccacacgcggcagacagaccacgaaagacaataagggcacccggatccgctttaaagatgacagctccttcgaggacgtgaacgggattagaaagcctaagcatctttacgtctctctgcccaatgcgcaaagctccatgaaagccgaagagatcacacctggacggtatcgcaccgctatttgcgaactctacccggcccagatcaaggctagcaaaatgatttctcccgtgatgtccgttatcggctttctggccctggcgaaggattggagcgacagaatcgagcagtggctctctgaaccttgtaaactgcttcccgatacagccgctgtgtccctgcacgggggacctgccaccaaccgggactatctccgccagagacaagtcgctctgggcaatatggagacgaaggagagcaaagccattcggcagcatgccgaatctgctgggtgctccatggtggaggatatcgaaagcccctcctctatttgggtgttcgcgggagccccggacagatgtcctcccacatgcctttttatcgctggcattgccgagctgggcgccttctttagcatcctccaggatatgcgcaacaccatcatggcttccaagacagtcgggaccagcgaagagaagctgcggaaaaagtcttccttctaccaaagctacctgagacgcacccagtctatgggcattcagctcgaccagcggatcattgttctgtttatggtggcctggggaaaagaggcggtggataatcctcacgctggggacgatgtcgaccccagccttggaatgctggcccaatccctcatcgacgtgaaggttaaagaaatttctaaccaggagcccctgaaactttga

SEQ ID NO: 7029 - RNA, 1290 nt, synthetic construct
  misc_feature 1..1290: note = derived and/or modified CDS sequence (opt5) from HTNV(CA10081113)__HQ834501.1__N
  source 1..1290: mol_type = other RNA
atggccaccagcggcgagctgcagagagaaatcaacgctcacgaggggcaactcgtgattgcccggcagaaggtccgcgacgcggaaaaacagtacgagaaggatcccgacgaactgaataaaagagctcttacagatcgggagggagttgccgcctccatccaggctaagattgacgagctgaaacgccaactcgccgatagaatcgctacgggcaagaacctggggaaggaacaggaccctaccggagtggagccgggcgatcatcttaaagaacggtctatgctgagctatgggaatgtgctcgacctgaaccacctggatattgacgagcccacaggacagaccgccgattggctctccatcgtcatctacctgacatctttcgtggttcctattcttctgaaggcgctctatatgctgaccacacgcggcagacagaccacgaaagacaataagggcacccggatccgctttaaagatgacagctccttcgaggacgtgaacgggattagaaagcccaagcatctttacgtctctctgcctaatgcccaaagctccatgaaagctgaagagatcacacccggacggtatcgcaccgccatttttgaactctaccctgctcagatcaaggccagacagatgattagcccggtgatgtctgttatcggcttcctggcgctggccaaagattggtccgaccggatcgagcagtggctcagcgaaccctgcaagctgcttcctgatacagctgccgtgtctctgcacgggggacccgctaccaaccgcgactatctcagacaacggcaggtcgccctgggcaatatggagacgaaagagtccaaggccattagacagcatgctgaaagcgcggggtgttctatggtggaggatatcgaatcccctagctccatttgggtgtttgccggagctcccgaccgctgcccgcctacatgtcttttcatcgccggcattgccgagctgggcgcctttttctctatcctccaagatatgcggaacaccatcatggctagcaaaacagtcgggacctccgaagagaagctgagaaagaaaagctctttttaccagtcctacctgcgccggacccagagcatgggcattcagctcgaccaaagaatcattgttctgttcatggtggcgtggggaaaggaggctgtggataatcgccaccttatgaacatcgtcgaccccgaacctcgggccctggcccagtctctcattgatgtgaaagttaaggagatcagcaatcaggaacccctgaaactttga

SEQ ID NO: 7030 - RNA, 1290 nt, synthetic construct
  misc_feature 1..1290: note = derived and/or modified CDS sequence (opt5) from HTNV(CA10081203)__HQ834502.1__N
  source 1..1290: mol_type = other RNA
atggccaccaacggcgagctgcagagagaaatcaatgctcacgaggggcaactcgtgattgcccggcagaaggtccgcgacgcggaaaaacagtacgagaaggatcccgacgaactgaacaaaagagctcttacagatcgggagggagttgccgccagcatccaggctaagattgacgagctgaaacgccaactcgccgatagaatcgctacgggcaagaatctggggaaggaacaggaccctaccggagtggagccgggcgatcatcttaaagaacggtccatgctgtcttatgggaacgtgctcgacctgaatcacctggatattgacgagcccacaggacagaccgccgattggctcagcatcgtcatctacctgacatccttcgtggttcctattcttctgaaggcgctctatatgctgaccacacgcggcagacagaccacgaaagacaacaagggcacccggatccgctttaaagatgactctagcttcgaggacgtgaatgggattagaaagcccaagcatctttacgtctccctgcctaacgcccaatctagcatgaaagctgaagagatcacacccggacggtatcgcaccgccatttttggcctctaccctgctcagatcaaggccagacagatgatttccccggtgatgagcgttatcgggttcctggcgctggccaaagattggtctgaccggatcgaacagtggctctccgagccctgcaagctgcttcctgatacagctgccgtgagcctgcacggaggccccgctaccaatcgcgactatctcagacaacggcaggtcgccctggggaacatggaaacgaaagagtctaaggccattagacagcatgctgagtccgcgggatgtagcatggtggaagatatcgagtctccttccagcatttgggtgtttgccggcgctcccgaccgctgcccgcctacatgtcttttcatcgccggcattgccgaactgggggcctttttctccatcctccaagatatgcggaataccatcatggcttctaaaacagtcggaaccagcgaggaaaagctgagaaagaaatccagcttttaccagtcttacctgcgccggacccagtccatgggcattcagctcgaccaaagaatcattgttctgttcatggtggcgtgggggaaggaggctgtggatgagcttcacagcggagacggcgaacaccatgcctctcgcacactggcccagagcctcatcgatgtcaaagtgaaggagatttccaaccaggaacccctgaaactttga

SEQ ID NO: 7031 - RNA, 1290 nt, synthetic construct
  misc_feature 1..1290: note = derived and/or modified CDS sequence (opt5) from HTNV(CA10081206)__HQ834503.1__N
  source 1..1290: mol_type = other RNA
atggccaccatcgaggaactgcagagagagattaacgctcacgaaggccaactcgtgatcgcccggcagaaggtccgcgacgcggagaaacagtacgaaaaggatcccgacgagctgaataaaagagctcttacagatcgggagggggttgccgccagcattcaggctaagatcgacgaactgaaacgccaactcgccgatagaattgctacgggaaagaacctgggcaaggagcaggaccctaccggggtggaaccgggagatcatcttaaagagcggtccatgctgtcttatggcaatgtgctcgacctgaaccacctggatatcgacgagcccacagggcagaccgccgattggctcagcatcgtcatttacctgacatccttcgtggttcctatccttctgaaggcgctctatatgctgaccacacgcggaagacagaccacgaaagacaataagggcacccggattcgctttaaagatgactctagcttcgaagacgtgaacggcatcagaaagcccaagcatctttacgtctccctgcctaatgcccaatctagcatgaaagctgaggaaattacacccgggcggtatcgcaccgccatctgcggactctaccctgctcagattaaggccagacagatgatctccccggtgatgagcgttatcggctttctggcgctggccaaagattggtctgaccggattgagcagtggctctccgaaccctgtaagctgcttcctgatacagctgccgtgagcctgcacgggggacccgctaccaaccgcgactatctcagacaacggcaggtcgccctgggcaatatggagacgaaagagtctaaggccatcagacagcatgctgaatccgcggggtgcagcatggtggaggatattgaatctccttccagcatctgggtgttcgccggagctcccgaccgctgtccgcctacatgcctttttattgccggcatcgccgagctgggcgctttcttttccatcctccaagatatgcggaacaccattatggcctctaaaacagtcgggaccagcgaagagaagctgagaaagaaatccagcttctaccagtcttacctgcgccggacccagtccatgggaatccagctcgaccaaagaattatcgttctgtttatggtggcgtggggcaaggaggctgtggataatttccacgcctgggacgggatggatcccgaacttcgcacactggcccagagcctcattgacgtcaaagtgaaggagatctctaaccaggaacctctgaaactttga

SEQ ID NO: 7032 - RNA, 1290 nt, synthetic construct
  misc_feature 1..1290: note = derived and/or modified CDS sequence (opt5) from HTNV(CA10081708)__HQ834504.1__N
  source 1..1290: mol_type = other RNA
atgcccaccagcggcgagctgcagagagaaatcaacgcccacgaggggcaactcgtgattgctcggcagaaggtccgcgacgccgaaaagcagtacgagaaggatcctgacgaactgaataaaagagcgcttacagatcgggagggagttgctgcctccatccaggccaagattgacgagctgaaacgccaactcgctgatagaatcgccacgggcaagaacctggggaaggaacaggacccgaccggagtggagcccggcgatcatcttaaagaacggtctatgctgagctatgggaatgtgctcgacctgaaccacctggatattgacgagcctacaggacagaccgctgattggctctccatcgtcatctacctgacatctttcgtggttcccattcttctgaaggccctctatatgctgaccacacgcggcagacagaccacgaaagacaataagggcacccggatccgctttaaagatgacagctccttcgaggacgtgaacgggattagaaagcctaagcatctttacgtctctctgcccaatgcgcaaagctccatgaaagccgaagagatcacacctggacggtatcgcaccgctatttttgaactctacccggcccagatcaaggctagaaaaatgattagccccgtgatgtctgttatcggcttcctggccctggcgaaggattggtccgaccggatcgagcagtggctcagcgaaccttgcaaactgcttcccgatacagccgctgtgtctctgcacgggggacctgccaccaaccgcgactatctcagacagcggcaagtcgctctgggcaatatggagacgaaggagtccaaagccattagacagcatgccgaaagcgctgggtgttctatggtggaggatatcgaatcccccagctccatttgggtgtttgcgggagccccggaccgctgccctcccacatgtcttttcatcgctggcattgccgagctgggcgcctttttctctatcctccaggatatgcggaacaccatcatggctagcaagacagtcgggacctccgaagagaagctgcgcaaaaagagctctttttaccaatcctacctgagacggacccagagcatgggcattcagctcgaccagagaatcattgttctgttcatggtggcctggggaaaagaggcggtggataatcctcacacaggggacgatgctgaccccgaacttcgcacgctggcccaatctctcatcgacgtcaaggtgaaagagattagcaaccaggaacccctgaaactttga

SEQ ID NO: 7033 - RNA, 1290 nt, synthetic construct
  misc_feature 1..1290: note = derived and/or modified CDS sequence (opt5) from HTNV(CA10081905)__HQ834505.1__N
  source 1..1290: mol_type = other RNA
atggccaccagcggcgagctgcagagagaaatcaacgctcacgaggggcaactcgtgattgcccggcagaaggtccgcgacgcggaaaaacagtacgagaaggatcccgacgaactgaataaaagagctcttacagatcgggagggagttgccgcctccatccaggctaagattgacgagctgaaacgccaactcgccgatagaatcgctacgggcaagaacctggggaaggaacaggaccctaccggagtggagccgggcgatcatcttaaagaacggtctatgctgagctatgggaatgtgctcgacctgaaccacctggatattgacgagcccacaggacagaccgccgattggctctccatcgtcatctacctgacatctttcgtggttcctattcttctgaaggcgctctatatgctgaccacacgcggcagacagaccacgaaagacaataagggcacccggatccgctttaaagatgacagctccttcgaggacgtgaacgggattagaaagcccaagcatctttacgtctctctgcctaatgcccaaagctccatgaaagctgaagagatcacacccggacggtatcgcaccgccatttttgaactctaccctgctcagatcaaggccagaaaaatgattagcccggtgatgtctgttatcggcttcctggcgctggccaaggattggtccgaccggatcgagcagtggctcagcgaaccctgcaaactgcttcctgatacagctgccgtgtctctgcacgggggacccgctaccaaccgcgactatctcagacagcggcaagtcgccctgggcaatatggagacgaaggagtccaaagccattagacagcatgctgaaagcgcggggtgttctatggtggaggatatcgaatcccctagctccatttgggtgtttgccggagctcccgaccgctgcccgcctacatgtcttttcatcgccggcattgccgagctgggcgcctttttctctatcctccaggatatgcggaacaccatcatggctagcaagacagtcgggacctccgaagagaagctgcgcaaaaagagctctttttaccaatcctacctgagacggacccagagcatgggcattcagctcgaccagagaatcattgttctgttcatggtggcgtggggaaaagaggctgtggataatcaccaccttatcaacgccggggaccatgaactgcgcacactcgcccaatctctgattgatgtcaaggtgaaagagatcagcaatcaggaaccccttaagctgtga

SEQ ID NO: 7034 - RNA, 1290 nt, synthetic construct
  misc_feature 1..1290: note = derived and/or modified CDS sequence (opt5) from HTNV(E142)__AF288644.1__N
  source 1..1290: mol_type = other RNA
atggccaccatggaggaactgcagagagagatcaacgctcacgaaggccaactcgtgattgcccggcagaaggtccgcgacgcggagaaaagatacgaaaaggatcccgacgagctgaataaacggacacttacggatcgcgagggggttgctgccagcatccaggccaagattgacgaactgaaaagacagctcgctgatcggatcgccaccggaaagaacctgggcaaggagcaagaccctacaggggtggaaccgggagatcatcttaaagagcgctccatgctgtcttatggcaatgtgctcgacctgaaccacctggatattgacgagcccaccgggcagacagctgattggctcagcatcgtcatctacctgacctccttcgtggttcctattcttctgaaggccctctatatgctgacaaccagaggacggcagacgaccaaagacaataagggcacacgcatcagatttaaagatgactctagctccgaagacgtgaacggcattcggaagcccaagcatctttacgtctctctgcctaatgcgcagagctccatgaaagccgaggaaatcacccccgggcgctatagaacagctatttgcggactctaccctgcccaaatcaaggctcggcagatgattagcccggtgatgtctgttatcggcttcctggccctggcgaaagattggtccgaccgcatcgagcagtggctcagcgaaccctgtaagctgcttcctgataccgccgctgtgtctctgcacgggggacccgccacgaacagagactatctccggcagagacaagtcgctctgggcaatatggagacaaaagagtccaaggccattcgccagcatgccgaaagcgctgggtgctctatgatcgaggatattgaatcccctagctccatctgggtgtttgcgggagcccccgaccggtgtccgcctacctgccttttcattgctggcatcgccgagctgggcgcctttttctctatcctccaggatatgagaaacacaattatggctagcaaaaccgtggggacctccgaagagaagctgcgcaagaaaagctctttttaccaatcctacctgcggagaacacagagcatgggaatccagctcgaccagcgcattatcgtcctgttcatggttgcctggggcaaggaggtggtggataattttcaccttggggacgatatggaccccgaactgcggacgctcgcgcaatctctgattgacgtcaaagtgaaggagatcagcaaccaggaacctcttaaactgtga

SEQ ID NO: 7035 - RNA, 1290 nt, synthetic construct
  misc_feature 1..1290: note = derived and/or modified CDS sequence (opt5) from HTNV(H10150)__HQ834506.1__N
  source 1..1290: mol_type = other RNA
atggccaccatgggcgagctgcagagagaaatcaacgctcacgaggggcaactcgtgattgcccggcagaaggtccgcgacgcggaaaaacagtacgagaaggatcccgacgaactgaataaaagagctcttacagatcgggagggagttgccgccagcatccaggctaagattgacgagctgaaacgccaactcgccgatagaatcgctacgggcaagaacctggggaaggaacaggaccctaccggagtggagccgggcgatcatcttaaagaacggtccatgctgtcttatgggaatgtgctcgacctgaaccacctggatattgacgagcccacaggacagaccgccgattggctcagcatcgtcatctacctgacatccttcgtggttcctattcttctgaaggcgctctatatgctgaccacacgcggcagacagaccacgaaagacaataagggcacccggatccgctttaaagatgactctagcttcgaggacgtgaacgggattagaaagcccaagcatctttacgtctccctgcctaatgcccaatctagcatgaaagctgaagagatcacacccggacggtatcgcaccgccatttttggcctctaccctgctcagatcaaggccagacagatgatttccccggtgatgagcgttatcgggttcctggcgctggccaaagattggtctgaccggatcgaacagtggctctccgagccctgcaagctgcttcctgatacagctgccgtgagcctgcacggaggccccgctaccaaccgcgactatctcagacaacggcaggtcgccctggggaatatggaaacgaaagagtctaaggccattagacagcatgctgagtccgcgggatgtagcatggtggaagatatcgagtctccttccagcatttgggtgtttgccggcgctcccgaccgctgcccgcctacatgtcttttcatcgccggcattgccgaactgggggcctttttctccatcctccaagatatgcggaacaccatcatggcttctaaaacagtcggaaccagcgaggaaaagctgagaaagaaatccagcttttaccagtcttacctgcgccggacccagtccatgggcattcagctcgaccaaagaatcattgttctgttcatggtggcgtgggggaaggaggctgtggataatcaccactgggccaacgccatcggaagcgagcttcgcacactggctcagtctctcattgacgtcaaagtgaaggaaatcagcaatcaggagcccctgaaactttga

SEQ ID NO: 7036 - RNA, 1290 nt, synthetic construct
  misc_feature 1..1290: note = derived and/or modified CDS sequence (opt5) from HTNV(Aa03-161)__KT935024.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttacgtttccctgcctaatgcgcaatctagcatgaaagccgaggaaattacacccgggcggtatcgcaccgctgtgtgcggactctaccctgcccagatcaaggctagacagatgatttccccggtcatgagcgtgatcggctttctggccctggcgaaagattggtctgaccggattgagcagtggctctccgaaccctgtaagctgcttcctgatgccgctgccgtgagcctgctcgggggacccgctacaaaccgcgactatctgagacaacggcaggtcgcccttggcaatatggagaccaaagagtctaaggccatcagacagcacgctgaagcggccgggtgctccatgatcgaggatattgaaagcccttcttccatctgggttttcgctggagcccccgaccgctgtccgcctacgtgcctgtttattgccggcatcgctgagctcggcgccttctttagcattctgcaagatatgcggaacacaatcatggcgtccaaaaccgtggggacatctgaagagaagctgagaaagaaaagctccttctaccagagctacctccgccggacccagtctatgggaatccagctggaccaaagaattatcgtgctttttatggtcgcttggggcaaggaggccgtggataatttccatctgggggacgatatggaccccgaactccgcaccctggcccagtcccttattgacgttaaagtgaaggagatcagcaaccaggaacctctgaaactctga

SEQ ID NO: 7037 - RNA, 1290 nt, synthetic construct
  misc_feature 1..1290: note = derived and/or modified CDS sequence (opt5) from HTNV(Aa04-722)__KU207190.1__N
  source 1..1290: mol_type = other RNA
atggccaccatggaggaactgcagagagagatcaacgctcacgaaggccaactcgtgattgcccggcagaaggtccgcgacgcggagagacagtacgaaaaagatcccgacgagctgaataagcgggctcttacagatcgcgagggggttgccgtgagcatccaggccaaaattgacgaactgaagagacaactcgctgatcggatcgccacgggaaagaacctgggcaaggagcaggaccctaccggggtggaaccgggagatcatcttaaggagcgctccatgctgtcttatggcaatgtcctcgacctgaaccacctggatattgacgagcccacagggcagaccgctgattggctcagcatcgtggtttacctgacatccttcgtggtccctatccttctgaaagccctctatatgctgaccacaagaggacggcagaccacgaaggacaataaaggcacccgcattagatttaaggatgactctagcttcgaagacgtgaacggcatccggaaacccaagcatctttacgtttccctgcctaatgcgcaatctagcatgaaggccgaggaaattacacccgggcgctatagaaccgctgtgtgcggactctaccctgcccagatcaaagctcggcagatgatttccccggtcatgagcgtgatcggctttctggccctggcgaaggattggtctgaccgcattgagcagtggctctccgaaccctgtaaactgcttcctgatacagccgctgtgagcctgctcgggggacccgccaccaacagagactatctgcggcaaagacaggtcgctcttggcaatatggagacgaaggagtctaaagccatccgccagcacgccgaagctgcggggtgctccatgatcgaggatattgaaagcccttcttccatctgggttttcgccggagctcccgaccggtgtccgcctacatgcctgtttattgccggcatcgccgagctcggcgctttctttagcattctgcaagatatgagaaacaccatcatggcctccaagacagtggggacctctgaagagaaactgcgcaaaaagagctccttctaccagagctacctccggagaacccagtctatgggaatccagctggaccaacgcattatcgtgctttttatggtcgcgtggggcaaagaggctgtggataatttccatctgggggacgatatggaccccgaactccggacactggcccagtcccttattgacgttaaggtgaaagagatcagcaaccaggaacctctgaagctctga

SEQ ID NO: 7038 - RNA, 1290 nt, synthetic construct
  misc_feature 1..1290: note = derived and/or modified CDS sequence (opt5) from HTNV(Aa05-190)__KT935027.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttacgtttccctgcctaatgcgcaatctagcatgaaagccgaggaaattacacccgggcggtatcgcaccgctgtgtgcggactctaccctgcccagatcaaggctagacagatgatttccccggtcatgagcgtgatcggctttctggccctggcgaaagattggtctgaccggattgagcagtggctctccgaaccctgtaagctgcttcctgatacagccgctgtgagcctgctcgggggacccgccaccaaccgcgactatctgagacaacggcaggtcgctcttggcaatatggagacgaaagagtctaaggccatcagacagcacgccgaagctgcggggtgctccatgatcgaggatattgaaagcccttcttccatctgggttttcgccggagctcccgaccgctgtccgcctacatgcctgtttattgccggcatcgccgagctcggcgctttctttagcattctgcaagatatgcggaacaccatcatggcctccaaaacagtggggacctctgaagagaagctgagaaagaaaagctccttctaccagagctacctccgccggacccagtctatgggaatccagctggaccaaagaattatcgtgctttttatggtcgcgtggggcaaggaggctgtggataatttccatctgggggacgatatggaccccgaactccgcacactggcccagtcccttattgacgttaaagtgaaggagatcagcaaccaggaacctctgaaactctga

SEQ ID NO: 7039 - RNA, 1290 nt, synthetic construct
  misc_feature 1..1290: note = derived and/or modified CDS sequence (opt5) from HTNV(Aa10-123)__KT935036.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttacgtttccctgcctaatgcgcaatctagcatgaaagccgaggaaattacacccgggcggtatcgcaccgctgtgtgcggactctaccctgcccagatcaaggctagacagatgatttccccggtcatgagcgtgatcggctttctggccctggcgaaagattggtctgaccggattgagcagtggctctccgaaccctgtaagctgcttcctgatacaaccgccgtgagcctgctcgggggacccgctacgaaccgcgactatctgagacaacggcaggtcgcccttggcaatatggagacaaaagagtctaaggctatcagacagcacgccgaagccgctgggtgctccatgatcgaggatattgaaagcccttcttccatctgggttttcgcgggagcccccgaccgctgtccgcctacctgcctgtttgtggctggcattgccgagctcggcgccttctttagcatcctgcaagatatgcggaacacaattatggcttccaaaaccgtggggacctctgaagagaagctgagaaagaaaagctccttctaccagagctacctccgccggacacagtctatgggaatccagctggaccaaagaatcattgtcctttttatggtggcctggggcaaggaggcggttgataatttccatctgggggacgatatggaccccgaactccgcacgctggctcagtcccttatcgacgtgaaagtcaaggagattagcaaccaggaacctctgaaactctga

SEQ ID NO: 7040 - RNA, 1290 nt, synthetic construct
  misc_feature 1..1290: note = derived and/or modified CDS sequence (opt5) from HTNV(Aa10-265)__KU207194.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttacgtttccctgcctaatgcgcaatctagcatgaaagccgaggaaattacacccgggcggtatcgcaccgctgtgtgcggactctaccctgcccagatcaaggctagacagatgatttccccggtcatgagcgtgatcggctttctggccctggcgaaagattggtctgaccggattgagcagtggctctccgaaccctgtaagctgcttcctgatacagccgctgtgagcctgctcgggggacccgccaccaaccgcgactatctgagacaacggcaggtcgctcttggcaatatggagacgaaagagtctaaggccatcagacagcacgccgaagctgcggggtgctccatgatcgaggatattgaaagcccttcttccatctgggttttcgccggagctcccgaccgctgtccgcctacatgcctgtttgtggccggcattgccgagctcggcgctttctttagcatcctgcaagatatgcggaacaccattatggcctccaaaacagtggggacctctgaagagaagctgagaaagaaaagctccttctaccagagctacctccgccggacccagtctatgggaatccagctggaccaaagaatcattgtcctttttatggtggcgtggggcaaggaggctgttgataatttccatctgggggacgatatggaccccgaactccgcacactggcccagtcccttatcgacgtgaaagtcaaggagattagcaaccaggaacctctgaaactctga

SEQ ID NO: 7041 - RNA, 1290 nt, synthetic construct
  misc_feature 1..1290: note = derived and/or modified CDS sequence (opt5) from HTNV(AA1028)__AF427318.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttacgtttccctgcctaatgcgcaatctagcatgaaagccgaggaaattacacccgggcggtatcgcaccgctatctgcggactctaccctgcccagattaaggctagacagatgatctccccggtgatgagcgtcattggctttctggccctggcgaaagattggtctgaccggatcgagcagtggctctccgaaccctgtaagctgcttcctgatacagccgctgtgagcctgctcgggggacccgccaccaaccgcgactatctgagacaaagacaggtggctcttggcaatatggagacgaaagagtctaaggccatccggcagcacgccgaagctgcggggtgctccatgattgaggatatcgaaagcccttcttccatttgggtcttcgccggagctcccgaccgctgtccgcctacatgcctgtttatcgccggcattgccgagctcggcgctttctttagcatcctgcaagatatgcggaacaccatcatggcctccaaaacagttgggacctctgaagagaagctgagaaagaaaagctccttctaccagagctacctccgccggacccagtctatgggcattcagctggaccaaagaatcattgtgctttttatggtggcgtggggaaaggaggctgtcgataatttccatctgggggacgatatggaccccgaactccgcacactggcccagtcccttatcgacgtgaaagttaaggagattagcaaccaggaacctctgaaactctga

SEQ ID NO: 7042 - RNA, 1290 nt, synthetic construct
  misc_feature 1..1290: note = derived and/or modified CDS sequence (opt5) from HTNV(Aa10-434)__KT935038.1__N
  source 1..1290: mol_type = other RNA
atggccaccatggaggaactgcagagagagatcaacgctcacgaaggccaactcgtgattgcccggcagaaggtccgcgacgcggagaaacagtacgggaaggatcccgacgaactgaataaaagagctcttacagatcgggagggagttgccgtgagcatccaggccaagattgacgagctgaaacgccaactcgctgatagaatcgccacgggcaagaacctggggaaggaacaggaccctaccggagtggagccgggcgatcatcttaaagaacggtccatgctgtcttatgggaatgtcctcgacctgaaccacctggatattgacgagcccacaggacagaccgctgattggctcagcatcgtggtttacctgacatccttcgtggtccctatccttctgaaggccctctatatgctgaccacacgcggcagacagaccacgaaagacaataagggcacccggattcgctttaaagatgactctagcttcgaggacgtgaacgggatcagaaagcccaagcatctttacgtttccctgcctaatgcgcaatctagcatgaaagccgaagagattacacccggacggtatcgcaccgctgtgtgcggcctctaccctgcccagatcaaggctagacagatgatttccccggtcatgagcgtgatcgggtttctggccctggcgaaagattggtctgaccggattgaacagtggctctccgagccctgtaagctgcttcctgatacagccgctgtgagcctgctcggaggccccgccaccaaccgcgactatctgagacaacggcaggtcgctcttgggaatatggaaacgaaagagtctaaggccatcagacagcacgccgaggctgcgggatgctccatgatcgaagatattgagagcccttcttccatctgggttttcgccggcgctcccgaccgctgtccgcctacatgcctgtttattgccggcatcgccgaactcggggctttctttagcattctgcaagatatgcggaacaccatcatggcctccaaaacagtgggaacctctgaggaaaagctgagaaagaaaagctccttctaccagagctacctccgccggacccagtctatgggcatccagctggaccaaagaattatcgtgctttttatggtcgcgtgggggaaggaggctgtggataatttccatctgggagacgatatggaccccgagctccgcacactggcccagtcccttattgacgttaaagtgaaggaaatcagcaaccaggagcctctgaaactctga

SEQ ID NO: 7043 - RNA, 1290 nt, synthetic construct
  misc_feature 1..1290: note = derived and/or modified CDS sequence (opt5) from HTNV(Aa14-362)__KT935049.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttacgtttccctgcctaatgcgcaatctagcatgaaagccgaggaaattacacccgggcggtatcgcaccgctgtgtgcggactctaccctgcccagatcaaggctagacagatgatttccccggtcatgagcgtgatcggctttctggccctggcgaaagattggtctgaccgggtggagcagtggctctccgaaccctgtaagctgcttcctgatacagccgctgtcagcctgctcgggggacccgccaccaaccgcgactatctgagacaacggcaggttgctcttggcaatatggagacgaaagagtctaaggccattagacagcacgccgaagctgcggggtgctccatgatcgaggatatcgaaagcccttcttccatttgggtgttcgccggagctcccgaccgctgtccgcctacatgcctgtttatcgccggcattgccgagctcggcgctttctttagcatcctgcaagatatgcggaacaccattatggcctccaaaacagtggggacctctgaagagaagctgagaaagaaaagctccttctaccagagctacctccgccggacccagtctatgggaatccagctggaccaaagaatcattgtcctttttatggtggcgtggggcaaggaggctgttgataatttccatctgggggacgatatggaccccgaactccgcacactggcccagtcccttatcgacgtgaaagtcaaggagattagcaaccaggaacctctgaaactctga

SEQ ID NO: 7044 - RNA, 1290 nt, synthetic construct
  misc_feature 1..1290: note = derived and/or modified CDS sequence (opt5) from HTNV(Aa14-404)__KT935052.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttacgtttccctgcctaatgcgcaatctagcatgaaagccgaggaaattacacccgggcggtatcgcaccgctgtgtgcggactctaccctgcccagatcaaggctagacagatgatttccccggtcatgagcgtgatcggctttctggccctggcgaaagattggtctgaccggattgagcagtggctctccgaaccctgtaagctgcttcctgatacagccgctgtgagcctgctcgggggacccgccaccaaccgcgactatctgagacaacggcaggtcgctcttggcaatatggagacgaaagagtctaaggccatcagacagcacgccgaagctgcggggtgctccatgatcgaggatattgaaagcccttcttccatctgggttttcgccggagctcccgaccgctgtccgcctacatgcctgtttattgccggcatcgccgagctcggcgctttctttagcattctgcaagatatgcggaacaccatcatggcctccaaaacagtggggacctctgaagagaagctgagaaagaaaagctccttctaccagagctacctccgccggacccagtctatgggaatccagctggaccaaagaattatcgtgctttttatggtcgcgtggggcaaggaggctgtggataatttccatctgggggacgatatggaccccgaactccgcacactggcccagtcccttattgacgttaaagtgaaggagatcagctctcaggaacctctgaaactctga

SEQ ID NO: 7045 - RNA, 1290 nt, synthetic construct
  misc_feature 1..1290: note = derived and/or modified CDS sequence (opt5) from HTNV(Aa15-56)__KU207195.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttacgtttccctgcctaatgcgcaatctagcatgaaagccgaggaaattacacccgggcggtatcgcaccgctgtgtgcggactctaccctgcccagatcaaggctagacagatgatttccccggtcatgagcgtgatcggctttctggccctggcgaaagattggtctgaccggattgagcagtggctcaacgaaccctgtaagctgcttcctgatacagccgctgtgtccctgctcgggggacccgccaccaatcgcgactatctgagacaacggcaggtcgctcttggcaacatggagacgaaagagagcaaggccatcagacagcacgccgaagctgcggggtgctctatgatcgaggatattgaatcccctagctctatctgggttttcgccggagctcccgaccgctgtccgcctacatgcctgtttattgccggcatcgccgagctcggcgctttcttttccattctgcaagatatgcggaataccatcatggccagcaaaacagtggggacctccgaagagaagctgagaaagaaatctagcttctaccagtcctacctccgccggacccagagcatgggaatccagctggaccaaagaattatcgtgctttttatggtcgcgtggggcaaggaggctgtggataacttccatctgggggacgatatggaccccgaactccgcacactggcccagtctcttattgacgttaaagtgaaggagatctccaatcaggaacctctgaaactctga

SEQ ID NO: 7046 - RNA, 1290 nt, synthetic construct
  misc_feature 1..1290: note = derived and/or modified CDS sequence (opt5) from HTNV(AA1719)__AF427319.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttacgtttccctgcctaatgcgcaatctagcatgaaagccgaggaaattacacccgggcggtatcgcaccgctatctgcggactctaccctgcccagattaaggctagacagatgatctccccggtgatgagcgtcattggctttctggccctggcgaaagattggtctgaccggatcgagcagtggctctccgaaccctgtaagctgcttcctgatacagccgctgtgagcctgctcgggggacccgccaccaaccgcgactatctgagacaaagacaggtggctcttggcaatatggagacgaaagagtctaaggccatccggcagcacgccgaagctgcggggtgctccattatcgaggatattgaaagcccttcttccatctgggtcttcgccggagctcccgaccgctgtccgcctacatgcctgtttattgccggcatcgccgagctcggcgctttctttagcatcctgcaagatatgcggaacaccattatggcctccaaaacagttgggacctctgaagagaagctgagaaagaaaagctccttctaccagagctacctccgccggacccagtctatgggaatccagctggaccaaagaattatcgtgctttttatggtggcgtggggcaaggaggctgtcgataatttccatctgggggacgatatggaccccgaactccgcacactggcccagtcccttattgacgtgaaagttaaggagatcagcaaccaggaacctctgaaactctga

SEQ ID NO: 7047 - RNA, 1290 nt, synthetic construct
  misc_feature 1..1290: note = derived and/or modified CDS sequence (opt5) from HTNV(AP1168)__AF427323.1__N
  source 1..1290: mol_type = other RNA
atggccaccatggaggaactgcagaaggagatcaacgctcacgaaggccaactcgtgattgccagacagaaagtccgggacgcggagcgccagtacgaaaaggatcccgacgagctgaataaaagagctcttacagatcgggagggggttgccgccagcatccaggctaagattgacgaactgaaacgccaactcgccgatagaatcgctacgggaaagaacctgggcaaggagcaggaccctaccggggtggaaccgggagatcatcttaaagagcggtccatgctgtcttatggcaatgtgctcgacctgaaccacctggatattgacgagcccacagggcagaccgccgattggctcagcatcgtcgtgtacctgacatccttcgttgtgcctatccttctgaaggcgctctatatgctgaccacacgcggaagacagaccacgaaagacaataagggcacccggattcgctttaaagatgactctagcttcgaagacgtcaacggcatcagaaagcccaagcatctttacgtgtccctgcctaatgcccaatctagcatgaaagctgaggaaattacacccgggcggtatcgcaccgccatctgcggactctaccctgctcagattaaggccagacagatggtttccccggtgatgagcgtcatcggctttctggcgctggccaaagattggggagaccggattgagcagtggctctctgaaccctgtaagctgcttcctgatacagctgccgtgtccctgcacgggggccccgctaccaaccgcgactatctcagacaacggcaggccgccctggggaatatggagacgaaagagagcaaggctatcagacagcatgcggaaacagccggatgctctatgatcgaggatattgaatcccctagctctatctgggtgttcgctggcgcccccgaccgctgtccgcctacctgcctttttattgccggcatcgctgagctgggggccttcttttccattctccaagatatgcggaacacaatcatggcgagcaaaaccgtcggaacctccgaagagaagctgagaaagaaatctagcttctaccagtcctacctgcgccggacacagagcatgggcatccagctcgaccaaagaattatcgttctgtttatggtggcttgggggaaggaggccgtggataatttccaccttggagacgatatggaccccgaactgcgcacgctcgcccagtctctgattgaccttaaagtcaaggagatctccaaccaggaacctctgaaactctga

SEQ ID NO: 7048 - RNA, 1290 nt, synthetic construct
  misc_feature 1..1290: note = derived and/or modified CDS sequence (opt5) from HTNV(AP708)__AF427322.1__N
  source 1..1290: mol_type = other RNA
atggccaccatggaggaactgcagaaggagatcaacgctcacgaaggccaactcgtgattgccagacagaaagtccgggacgcggagcgccagtacgaaaaggatcccgacgagctgaataaaagagctcttacagatcgggagggggttgccgccagcatccaggctaagattgacgaactgaaacgccaactcgccgatagaatcgctacgggaaagaacctgggcaaggagcaggaccctaccggggtggaaccgggagatcatcttaaagagcggtccatgctgtcttatggcaatgtgctcgacctgaaccacctggatattgacgagcccacagggcagaccgccgattggctcagcatcgtcgtgtacctgacatccttcgttgtgcctatccttctgaaggcgctctatatgctgaccacacgcggaagacagaccacgaaagacaataagggcacccggattcgctttaaagatgactctagcttcgaagacgtcaacggcatcagaaagcccaagcatctttacgtgtccctgcctaatgcccaatctagcatgaaagctgaggaaattacacccgggcggtatcgcaccgccatctgcggactctaccctgctcagattaaggccagacagatggtttccccggtgatgagcgtcatcggctttctggcgctggccaaagattggggagaccggattgagcagtggctctctgaaccctgtaagctgcttcctgatacagctgccgtgtccctgcacgggggccccgctaccaaccgcgactatctcagacaacggcaggccgccctggggaatatggagacgaaagagagcaaggctatcagacagcatgcggaaacagccggatgctctatgatcgaggatattgaatcccctagctctgtgtgggtcttcgctggcgcccccgaccgctgtccgcctacctgcctttttatcgccggcattgctgagctgggggccttcttttccatcctccaagatatgcggaacacaattatggcgagcaaaaccgttggaacctccgaagagaagctgagaaagaaatctagcttctaccagtcctacctgcgccggacacagagcatgggcatccagctcgaccaaagaatcattgtgctgtttatggtggcttgggggaaggaggccgtcgataatttccaccttggagacgatatggaccccgaactgcgcacgctcgcccagtctctgatcgaccttaaagtgaaggagatttccaaccaggaacctctgaaactctga

SEQ ID NO: 7049 - RNA, 1290 nt, synthetic construct
  misc_feature 1..1290: note = derived and/or modified CDS sequence (opt5) from HTNV(DandongHu-32)__KC570386.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttacgtttccctgcctaatgcgcaatctagcatgaaagccgaggaaattacacccgggcggtatcgcaccgctatctgcggactctaccctgcccagattaaggctagacagatgatctccccggtgatgagcgtcattggctttctggccctggcgaaagattggtctgaccggatcgagcagtggctctccgaaccctgtaagctgcttcctgatacagccgctgtgagcctgctcgggggacccgccaccaaccgcgactatctgagacaaagacaggtggctcttggcaatatggagacgaaagagtctaaggccatccggcagcacgccgaagctgcggggtgctccatgattgaggatatcgaaagcccttcttccatttgggtcttcgccggagctcccgaccgctgtccgcctacatgcctgtttatcgccggcattgccgagctcggcgctttctttagcatcctgcaagatatgcggaacaccatcatggcctccaaaacagttgggacctctgaagagaagctgagaaagaaaagctccttctaccagagctacctccgccggacccagtctatgggcattcagctggaccaaagaatcattgtgctttttatggtggcgtggggaaaggaggctgtcgataatttccatctgggggacgatatggaccccgaactccgcatcctggcccagtcccttattgacgtgaaagttaaggagatcagcaaccaggaacctctgaaactctga

SEQ ID NO: 7050 - RNA, 1290 nt, synthetic construct
  misc_feature 1..1290: note = derived and/or modified CDS sequence (opt5) from HTNV(DandongHu-34)__KC570387.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttacgtttccctgcctaatgcgcaatctagcatgaaagccgaggaaattacacccgggcggtatcgcaccgctatctgcggactctaccctgcccagattaaggctagacagatgatctccccggtgatgagcgtcattggctttctggccctggcgaaagattggtctgaccggatcgagcagtggctctccgaaccctgtaagctgcttcctgatacagccgctgtgagcctgctcgggggacccgccaccaaccgcgactatctgagacaaagacaggtggctcttggcaatatggagacgaaagagtctaaggccatccggcagcacgccgaagctgcggggtgctccatgattgaggatatcgaaagcccttcttccatttgggtcttcgccggagctcccgaccgctgtccgcctacatgcctgtttatcgccggcatggccgagctcggcgctttctttagcattctgcaagatatgcggaacaccatcatggcctccaaaacagttgggacctctgaagagaagctgagaaagaaaagctccttctaccagagctacctccgccggacccagtctatgggaatccagctggaccaaagaattatcgtgctttttatggtggcgtggggcaaggaggctgtcgataatttccatctgggggacgatatggaccccgaactccgcacactggcccagtcccttattgacgtgaaagttaaggagatcagcaaccaggaacctctgaaactctga

SEQ ID NO: 7051 - RNA, 1290 nt, synthetic construct
  misc_feature 1..1290: note = derived and/or modified CDS sequence (opt5) from HTNV(DandongHu-89)__KC570389.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttgcgtttccctgcctaatgcgcaatctagcatgaaagccgaggaaattacacccgggcggtaccgcaccgctatctgtggactctatcctgcccagattaaggctagacagatgatctccccggtgatgagcgtcattggctttctggccctggcgaaagattggtctgaccggatcgagcagtggctctccgaaccctgcaagctgcttcctgatacagccgctgtgagcctgctcgggggacccgccaccaaccgcgactacctgagacaaagacaggtggctcttggcaatatggagacgaaagagtctaaggccatccggcagcacgccgaagctgcggggtgttccatgattgaggatatcgaaagcccttcttccatttgggtcttcgccggagctcccgaccgctgcccgcctacatgtctgtttatcgccggcattgccgagctcggcgctttctttagcatcctgcaagatatgcggaacaccatcatggcctccaaaacagttgggacctctgaagagaagctgagaaagaaaagctccttctatcagagctacctccgccggacccagtctatgggcattcagctggaccaaagaatcattgtgctttttatggtggcgtggggaaaggaggctgtcgataatttccatctgggggacgatatggaccccgaactccgcacactggcccagtcccttatcgacgtgaaagttaaggagattagcaaccaggaacctctgaaactctga

SEQ ID NO: 7052 - RNA, 1290 nt, synthetic construct
  misc_feature 1..1290: note = derived and/or modified CDS sequence (opt5) from HTNV(DandongHu-91)__KC570390.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcggaatcgtgatctacctgaccagcttcgttgtgcctattcttctgaaggccctctatatgctgacaacacgcggcagacagaccacgaaagacaataagggcacccggatccgctttaaagatgactcctctttcgaagacgtcaacgggattagaaagcccaagcatctttacgtgagcctgcctaatgcgcaatcctctatgaaagccgaggaaatcacacccggacggtatcgcaccgctatttgcggcctctaccctgcccagatcaaggctagacagatgattagcccggttatgtccgtgatcgggtttctggccctggcgaaagattggagcgaccggatcgagcagtggctctctgaaccctgtaagctgcttcctgatacagccgctgtctccctgctcggaggccccgccaccaaccgcgactatctgagacaaagacaggtggctcttgggaatatggagacgaaagagagcaaggccattcggcagcacgccgaagctgcgggatgctctatgatcgaggatattgaatcccctagctctatctgggtgttcgccggcgctcccgaccgctgtccgcctacatgcctgtttattgccggcatggccgagctcggggctttcttttccatcctgcaagatatgcggaacaccatcatggccagcaaaacagtcggaacctccgaagagaagctgagaaagaaatctagcttctaccagtcctacctccgccggacccagagcatgggcattcagctggaccaaagaatcattgttctttttatggtggcgtgggggaaggaggctgtggataatttccatctgggagacgatatggaccccgaactccgcacactggcccagtctcttatcgacgtcaaagtgaaggagatttccaaccaggaacctctgaaactctga

SEQ ID NO: 7053 - RNA, 1290 nt, synthetic construct
  misc_feature 1..1290: note = derived and/or modified CDS sequence (opt5) from HTNV(Fuyuan-Aa-145)__KJ857349.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttacgtttccctgcctaatgcgcaatctagcatgaaagccgaggaaattacacccgggcggtatcgcaccgctatctgcggactccaccctgcccagattaaggctagacagatgatctccccggtgatgagcgtcattggctttctggccctggcgaaagattggtctgaccggatcgagcagtggctctccgaaccctgtaagctgcttcctgatacagccgctgtgagcctgctcgggggacccgccaccaaccgcgactacctgagacaaagacaggtggctcttggcaatatggagacgaaagagtctaaggccatccggcagcatgccgaagctgcggggtgctccatgattgaggatatcgaaagcccttcttccatttgggtcttcgccggagctcccgaccgctgtccgcctacatgcctgtttatcgccggcattgccgagctcggcgctttctttagcatcctgcaagatatgcggaacaccatcatggcctccaaaacagttgggacctctgaagagaagctgagaaagaaaagctccttctatcagagctacctccgccggacccagtctatgggcattcagctggaccaaagaatcattgtgctttttatggtggcgtggggaaaggaggctgtcgataatttccacctgggggacgatatggaccccgaactccgcacactggcccagtcccttatcgacgtgaaagttaaggagattagcaaccaggaacctctgaaactctga

SEQ ID NO: 7054 - RNA, 1290 nt, synthetic construct
  misc_feature 1..1290: note = derived and/or modified CDS sequence (opt5) from HTNV(Fuyuan-Aa-26)__KJ857347.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgccgtgcctatccttctgaaggcgctctatatgctgaccacacgcggaagacagaccacgaaagacaataagggcacccggattcgctttaaagatgactctagccttgaagacgtcaacggcatcagaaagcccaagcatctgtacgtgtccctccctaatgcccaatctagcatgaaagctgaggaaattacacccgggcggtatcgcaccgccatctgcggactgtaccctgctcagattaaggccagacagatgatctccccggttatgagcgtgattggcttcctggcgctcgccaaagattggtctgaccggatcgagcagtggctgtccgaaccctgtaaacttctgcctgatacagctgccgtcagcctcctgggaggacccgctaccaaccgcgactatcttagacaaagacaggtggccctgggcaatatggagacgaaggagtctaaggccatccggcagcacgctgaagcggccgggtgctccatgattgaggatatcgaaagcccttcttccatttgggtgtttgctggagcccccgaccgctgtccgcctacatgccccttcatcgccggcattgctgagctcggcgcctttttcagcatcctgcaagatatgcggaacaccatcatggcgtccaaaacagtcgggacctctgaagagaagctgagaaagaaaagctccttttaccagagctacctccgccggacccagtctatggggattcagctggaccaaagaatcattgttcttttcatggtggcttggggcaaggaggccgtggataattttcatctgggggacgatatggaccctgaactccgcacactggcccagtcccttatcgacgtcaaagtgaaggagattagcaaccaggaacccctgaaactctga

SEQ ID NO: 7055 - RNA, 1290 nt, synthetic construct
  misc_feature 1..1290: note = derived and/or modified CDS sequence (opt5) from HTNV(JS1)__KP970572.1__N
  source 1..1290: mol_type = other RNA
atggccaccatggaggaactgcagagagagatcaacgctcacgaaggccaactcgtgattgcccggcagaaggtccgcgacgcggagaaacagtacgaaaatgatcccgacgagctgaacaagagagctcttacaaatcgggagggggttgccgtgagcatccaggccaaaattgatgaactgaagcgccaactcgctgacagaatcgccacgggcaaaaacctgggaaaggagcaggatcctaccggggtggaaccgggagaccatcttaaggagcggtccatgctgtcttatggcaatgtcctcgatctgaaccacctggacattgatgagcccacagggcagaccgctgactggctcagcatcatcgtgtacctgacatccttcgttgtgcctattcttctgaaagccctctatatgctgaccacacgcggaagacagaccacgaaggataataaaggcacccggatccgctttaaggacgattctagcttcgaagacgtcaacggcattagaaaacccaagcatctttacgtgtccctgcctaatgcgcaatctagcatgaaggccgaggaaatcacacccgggcggtatcgcaccgctgtttgcggactctaccctgcccagattaaagctagacagatgatctccccggtgatgagcgtcattggctttctggccctggcgaaggactggtctgatcggatcgagcagtggctcatcgaaccctgtaaactgcttcctgacacagccgctgtgtccctgctcgggggacccgccaccaaccgcgattatctgagacaaagacaggtggctcttggcaatatggagacgaaggagagcaaagccattcggcagcacgccgaagctgcggggtgctctatgatcgaggacattgaatcccctagctctatctgggtcttcgccggagctcccgatcgctgtccgcctacatgcctgtttattgccggcatcgccgagctcggcgctttcttttccatcctgcaagacatgcggaacaccattatggccagcaagacagttgggacctccgaagagaaactgagaaagaagtctagcttctaccagtcctacctccgccggacccagagcatgggaatccagctggatcaaagaattatcgtgctttttatggtggcgtggggcaaagaggctgtcgacaatttccatctgggggatgacatggatcccgaactccgcacactggcccagtctcttattgacgtgaaggttaaagagatctccaaccaggaacctctgaagctctga

SEQ ID NO: 7056 - RNA, 1290 nt, synthetic construct
  misc_feature 1..1290: note = derived and/or modified CDS sequence (opt5) from HTNV(LongquanAa-08-150)__JQ912697.1__N
  source 1..1290: mol_type = other RNA
atggccaccatggaggaactgcagagagagatcgacgctcacgaaggccaactcgtgattgcccggcagaaggtccgcgatgcggagaaacagtacgaaaaggaccccgatgagctgaacaaaagagctcttacagaccgggagggggttgccgccagcatccaggctaagattgatgaactgaaacgccaactcgccgacagaatcgctacgggaaagaatctgggcaaggagcaggatcctaccggggtggaaccgggagaccatcttaaagagcggtccatgctgtcttatggcaacgtgctcgatctgaatcacctggacattgatgagcccacagggcagaccgccgactggctcagcatcgtcgtgtacctgacatccttcgttgtgcctatccttctgaaggcgctctatatgctgaccacacgcggaagacagaccacgaaagataacaagggcacccggattcgctttaaagacgactctagcttcgaagatgtcaatggcatcagaaagcccaagcatctttacgtgtccctgcctaacgcccaatctagcatgaaagctgaggaaattacacccgggcggtatcgcaccgccatctgcggactctaccctgctcagattaaggccagacagatgatctccccggttatgagcgtgattggctttctggcgctggccaaagactgggctgatcggatcgagcagtggctctctgaaccctgtaagctgcttcctgacacagccgctgtctccctgcacgggggacccgccaccaatcgcgattatctcagacaaagacaggtggccctgggcaacatggagacgaaagagagcaaggctatccggcagcatgcggaaacagccgggtgctctatgattgaggacatcgaatcccctagctctatttgggtgttcgctggagcccccgatcgctgtccgcctacctgcctttttatcgccggcattgctgagctgggcgccttcttttccatcctccaagacatgcggaatacaatcatggcgagcaaaaccgtcgggacctccgaagagaagctgagaaagaaatctagcttctaccagtcctacctgcgccggacacagagcatgggcattcagctcgatcaaagaatcattgttctgtttatggtggcttggggaaaggaggccgtggacaacttccaccttggggatgacatggaccccgaactgcgcacgctcgcccagtctctgatcgatgtcaaagtgaaggagatttccaatcaggaacctcttaaactgtga

SEQ ID NO: 7057 - RNA, 1290 nt, synthetic construct
  misc_feature 1..1290: note = derived and/or modified CDS sequence (opt5) from HTNV(LongquanAa-08-157)__JQ912698.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatccaggctaagattgacgaactgaaacgccaactcgccgatagaatcgctacgggaaagaacctgggcaaggagcaggaccctaccggggtggaaccgggagatcatcttaaagagcggtccatgctgtcttatggcaatgtgctcgacctgaaccacctggatattgacgagcccacagggcagaccgccgattggctcagcatcgtcgtgtacctgacatccttcgttgtgcctatccttctgaaggcgctctatatgctgaccacacgcggaagacagaccacgaaagacaataagggcacccggattcgctttaaagatgactctagcttcgaagacgtcaacggcatcagaaagcccaagcatctttacgtgtccctgcctaatgcccaatctagcatgaaagctgaggaaattacacccgggcggtatcgcaccgccatctgcggactctaccctgctcagattaaggccagacagatgatctccccggttatgagcgtgattggctttctggcgctggccaaagattgggctgaccggatcgagcagtggctctctgaaccctgtaagctgcttcctgatacagccgctgtctccctgcacgggggacccgccaccaaccgcgactatctcagacaaagacaggtggccctgggcaatatggagacgaaagagagcaaggctatccggcagcatgcggaaacagccgggtgctctatgattgaggatatcgaatcccctagctctatttgggtgttcgctggagcccccgaccgctgtccgcctacctgcctttttatcgccggcattgctgagctgggcgccttcttttccatcctccaagatatgcggaacacaatcatggcgagcaaaaccgtcgggacctccgaagagaagctgagaaagaaatctagcttctaccagtcctacctgcgccggacacagagcatgggcattcagctcgaccaaagaatcattgttctgtttatggtggcttggggaaaggaggccgtggataatttccaccttggggacgatatggaccccgaactgcgcacgctcgcccagtctctgatcgacgtcaaagtgaaggagatttccaaccaggaacctcttaaactgtga

SEQ ID NO: 7058 - RNA, 1290 nt, synthetic construct
  misc_feature 1..1290: note = derived and/or modified CDS sequence (opt5) from HTNV(LongquanAa-08-314)__JQ912709.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatgcaggctaagatcgacgaactgaaacgccaactcgccgatagaattgctacgggaaagaacctgggcaaggagcaggaccctaccggggtggaaccgggagatcatcttaaagagcggtccatgctgtcttatggcaatgtgctcgacctgaaccacctggatatcgacgagcccacagggcagaccgccgattggctcagcattgtcgtgtacctgacatccttcgttgtgcctatccttctgaaggcgctctatatgctgaccacacgcggaagacagaccacgaaagacaataagggcacccggatccgctttaaagatgactctagcttcgaagacgtcaacggcattagaaagcccaagcatctttacgtgtccctgcctaatgcccaatctagcatgaaagctgaggaaatcacacccgggcggtatcgcaccgccatttgcggactctaccctgctcagatcaaggccagacagatgatttccccggttatgagcgtgatcggctttctggcgctggccaaagattgggctgaccggattgagcagtggctctctgaaccctgtaagctgcttcctgatacagccgctgtctccctgcacgggggacccgccaccaaccgcgactatctcagacaaagacaggtggccctgggcaatatggagacgaaagagagcaaggctatccggcagcatgcggaaacagccgggtgctctatgatcgaggatattgaatcccctagctctatctgggtgttcgctggagcccccgaccgctgtccgcctacctgcctttttattgccggcatcgctgagctgggcgccttcttttccattctccaagatatgcggaacacaatcatggcgagcaaaaccgtcgggacctccgaagagaagctgagaaagaaatctagcttctaccagtcctacctgcgccggacacagagcatgggaatccagctcgaccaaagaattatcgttctgtttatggtggcttggggcaaggaggccgtggataatttccaccttggggacgatatggaccccgaactgcgcacgctcgcccagtctctgattgacgtcaaagtgaaggagatctccaaccaggaacctcttaaactgtga

SEQ ID NO: 7059 - RNA, 1290 nt, synthetic construct
  misc_feature 1..1290: note = derived and/or modified CDS sequence (opt5) from HTNV(LongquanAa-08-573)__JQ912714.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatccaggctaagattgacgaactgaaacgccaactcgccgatagaatcgctacgggaaagaacctgggcaaggagcaggaccctaccggggtggaaccgggagatcatcttaaagagcggtccatgctgtcttatggcaatgtgctcgacctgaaccacctggatattgacgagcccacagggcagaccgccgattggctcagcatcgtcgtgtacctgacatccttcgttgtgcctatccttctgaaggcgctctatatgctgaccacacgcggaagacagaccacgaaagacaataagggcacccggattcgctttaaagatgactctagcttcgaagacgtcaacggcatcagaaagcccaagcatctttacgtgtccctgcctaatgcccaatctagcatgaaagctgaggaaattacacccgggcggtatcgcaccgccatctgcggactctaccctgctcagattaaggccagacagatgatctccccggttatgagcgtgattggctttctggcgctggccaaagattgggctgaccggatcgagcagtggctctctgaaccctgtaagctgcttcctgatacagccgctgtctccctgcacgggggacccgccaccaaccgcgactatctcagacaaagacaggtggccctgggcaatatggagacgaaagagagcaaggctatccggcagcatgcggccacagctgggtgctctatgattgaagatatcgagtcccctagctctatttgggtgttcgccggagcccccgaccgctgtccgcctacctgcctttttatcgctggcattgccgaactgggcgcgttcttttccatcctccaagatatgcggaacacaatcatggctagcaaaaccgtcgggacctccgaggaaaagctgagaaagaaatctagcttctaccagtcctacctgcgccggacacagagcatgggcattcagctcgaccaaagaatcattgttctgtttatggtggcctggggaaaggaggccgtggataatttccaccttggggacgatatggaccccgagctgcgcacgctcgctcagtctctgatcgacgtcaaagtgaaggaaatttccaaccaggagcctcttaaactgtga

SEQ ID NO: 7060 - RNA, 1290 nt, synthetic construct
  misc_feature 1..1290: note = derived and/or modified CDS sequence (opt5) from HTNV(LongquanAa-09-113)__JQ912716.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatccaggctaagattgacgaactgaaacgccaactcgccgatagaatcgctacgggaaagaacctgggcaaggagcaggaccctaccggggtggaaccgggagatcatcttaaagagcggtccatgctgtcttatggcaatgtgctcgacctgaaccacctggatattgacgagcccacagggcagaccgccgattggctcagcatcgtcgtgtacctgacatccttcgttgtgcctatccttctgaaggcgctctatatgctgaccacacgcggaagacagaccacgaaagacaataagggcacccggattcgctttaaagatgactctagcttcgaagacgtcaacggcacaagaaagcccaagcatctttacgtgtccctgcctaatgcccaatctagcatgaaagctgaggaaatcacccccgggcggtatcgcacagccatttgcggactctaccctgctcagatcaaggccagacagatgatttccccggttatgagcgtgatcggctttctggcgctggccaaagattgggctgaccggattgagcagtggctctctgaaccctgtaagctgcttcctgataccgccgctgtctccctgcacgggggacccgccacgaaccgcgactatctcagacaaagacaggtggccctgggcaatatggagacaaaagagagcaaggctatccggcagcatgcggaaaccgccgggtgctctatgatcgaggatattgaatcccctagctctatctgggtgttcgctggagcccccgaccgctgtccgcctacatgcctttttattgccggcatcgctgagctgggcgccttcttttccattctccaagatatgcggaacaccatcatggcgagcaaaaccgtcgggacatccgaagagaagctgagaaagaaatctagcttctaccagtcctacctgcgccggacgcagagcatgggaatccagctcgaccaaagaattatcgttctgtttatggtggcttggggcaaggaggccgtggataatttccaccttggggacgatatggaccccgaactgcgcaccctcgcccagtctctgattgacgtcaaagtgaaggagatctccaaccaggaacctcttaaactgtga

SEQ ID NO: 7061 - RNA, 1290 nt, synthetic construct
  misc_feature 1..1290: note = derived and/or modified CDS sequence (opt5) from HTNV(LongquanAa-09-191)__JQ912719.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatccaggctaagattgacgaactgaaacgccaactcgccgatagaatcgctacgggaaagaacctgggcaaggagcaggaccctaccggggtggaaccgggagatcatcttaaagagcggtccatgctgtcttatggcaatgtgctcgacctgaaccacctggatattgacgagcccacagggcagaccgccgattggctcagcatcgtcgtgtacctgacatccttcgttgtgcctatccttctgaaggcgctctatatgctgaccacacgcggaagacagaccattaaagacaataagggcacgcggatccgctttaaagatgactctagcttcgaagacgtcaacggcattagaaagcccaagcatctttacgtgtccctgcctaatgcccaatctagcatgaaagctgaggaaatcacccccgggcggtatcgcacagccatttgcggactctaccctgctcagatcaaggccagacagatgatttccccggttatgagcgtgatcggctttctggcgctggccaaagattgggctgaccggatcgagcagtggctctctgaaccctgtaagctgcttcctgataccgccgctgtctccctgcacgggggacccgccacaaaccgcgactatctcagacaaagacaggtggccctgggcaatatggagaccaaagagagcaaggctattcggcagcatgcggaaacggccgggtgctctatgatcgaggatattgaatcccctagctctatctgggtgttcgctggagcccccgaccgctgtccgcctacatgcctttttattgccggcatcgctgagctgggcgccttcttttccatcctccaagatatgcggaacaccattatggcgagcaaaacagtcgggacctccgaagagaagctgagaaagaaatctagcttctaccagtcctacctgcgccggacccagagcatgggaatccagctcgaccaaagaattatcgttctgtttatggtggcttggggcaaggaggccgtggataatttccaccttggggacgatatggaccccgaactgcgcacactcgcccagtctctgattgacgtcaaagtgaaggagatctccaaccaggaacctcttaaactgtga

SEQ ID NO: 7062 - RNA, 1290 nt, synthetic construct
  misc_feature 1..1290: note = derived and/or modified CDS sequence (opt5) from HTNV(LongquanAa-09-192)__JQ912720.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatgcagggaaagatcgacgaactgaaacgccaactcgctgatagaattgccacgggcaagaacctggggaaggagcaggaccctaccggagtggaaccgggcgatcatcttaaagagcggtccatgctgtcttatgggaatgtgctcgacctgaaccacctggatatcgacgagcccacaggacagaccgctgattggctcagcattgtcgtgtacctgacatccttcgttgtgcctatccttctgaaggccctctatatgctgaccacacgcggcagacagaccacgaaagacaataagggcacccggatccgctttaaagatgactctagcttcgaagacgtcaacgggattagaaagcccaagcatctttacgtgtccctgcctaatgcgcaatctagcatgaaagccgaggaaatcacacccggacggtatcgcaccgctatttgcggcctctaccctgcccagatcaaggctagacagatgatttccccggttatgagcgtgatcgggtttctggccctggcgaaagattgggccgaccggattgagcagtggctctctgaaccctgtaagctgcttcctgatacagctgccgtctccctgcacggaggccccgctaccaaccgcgactatctcagacaaagacaggtggccctggggaatatggagacgaaagagagcaaggccatccggcagcatgctgaaacagcgggatgctctatgatcgaggatattgaatcccctagctctatctgggtgttcgccggcgctcccgaccgctgtccgcctacctgcctttttattgccggcatcgccgagctgggggctttcttttccattctccaagatatgcggaacacaatcatggccagcaaaaccgtcggaacctccgaagagaagctgagaaagaaatctagcttctaccagtcctacctgcgccggacacagagcatgggcatccagctcgaccaaagaattatcgttctgtttatggtggcgtgggggaaggaggctgtggataatttccaccttggagacgatatggaccccgaactgcgcacgctcgcccagtctctgattgacgtcaaagtgaaggagatctccaaccaggaacctcttaaactgtga

SEQ ID NO: 7063 - RNA, 1290 nt, synthetic construct
  misc_feature 1..1290: note = derived and/or modified CDS sequence (opt5) from HTNV(LongquanAa-10-46)__JQ912754.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatccaggctaagattgacgaactgaaacgccaactcgccgatagaatcgctacgggaaagaacctgggcaaggagcaggaccctaccggggtggaaccgggagatcatcttaaagagcggtccatgctgtcttatggcaatgtgctcgacctgaaccacctggatattgacgagcccacagggcagaccgccgattggctcagcatcgtcgtgtacctgacatccttcgttgtgcctatccttctgaaggcgctctatatgctgaccacacgcggaagacagaccacgaaagacaataagggcacccggattcgctttaaagatgactctagcttcgaagacgtcaacggcatcagaaagcccgagcatctttacgtgtccctgcctaatgcccaatctagcatgaaggctgaagagattacacccgggcggtatcgcaccgccatctgcggactctaccctgctcagattaaagccagacagatgatctccccggttatgagcgtgattggctttctggcgctggccaaggattgggctgaccggatcgaacagtggctctctgagccctgtaaactgcttcctgatacagccgctgtctccctgcacgggggacccgccaccaaccgcgactatctcagacaaagacaggtggccctgggcaatatggagacgaaggaaagcaaagctatccggcagcatgcggagacagccgggtgctctatgattgaagatatcgagtcccctagctctatttgggtgttcgctggagcccccgaccgctgtccgcctacctgcctttttatcgccggcattgctgaactgggcgccttcttttccatcctccaagatatgcggaacacaatcatggcgagcaagaccgtcgggacctccgaggagaaactgagaaagaagtctagcttctaccagtcctacctgcgccggacacagagcatgggcattcagctcgaccaaagaatcattgttctgtttatggtggcttggggaaaagaagccgtggataatttccaccttggggacgatatggaccccgagctgcgcacgctcgcccagtctctgatcgacgtcaaggtgaaagaaatttccaaccaggagcctcttaagctgtga

SEQ ID NO: 7064 - RNA, 1290 nt, synthetic construct
  misc_feature 1..1290: note = derived and/or modified CDS sequence (opt5) from HTNV(LongquanAa-11-745)__KC344237.1__N
  source 1..1290: mol_type = other RNA
atggccaccatggaggaactgcagaaggagatcaacgctcacgaaggccaactcgtgattgccagacagaaagtccgggacgcggagaagcagtacgaaaaagatcccgacgagctgaataagcgcgctcttacagatagagagggggttgccgccagcatccaggctaaaattgacgaactgaagcggcaactcgccgatcgcatcgctacgggaaagaacctgggcaaagagcaggaccctaccggggtggaaccgggagatcatcttaaggagagatccatgctgtcttatggcaatgtgctcgacctgaaccacctggatattgacgagcccacagggcagaccgccgattggctcagcatcgtcgtgtacctgacatccttcgttgtgcctatccttctgaaagcgctctatatgctgaccacacggggacgccagaccacgaaggacaataaaggcacccggattagatttaaggatgactctagcttcgaagacgtcaacggcatccgcaagcccaaacatctttacgtgtccctgcctaatgcccaatctagcatgaaggctgaggaaattacacccgggagatatcggaccgccatctgcggactctaccctgctcagattaaagcccgccagatgatctccccggttatgagcgtgattggctttctggcgctggccaaggattgggctgacagaatcgagcagtggctctctgaaccctgtaaactgcttcctgatacagccgctgtctccctgcacgggggacccgccaccaaccgggactatctccgccaaagacaggtggccctgggcaatatggagacgaaggagagcaaagctatccggcagcatgcggaaacagccgggtgctctatgattgaggatatcgaatcccctagctctatttgggtgttcgctggagcccccgacagatgtccgcctacctgcctttttatcgccggcattgctgagctgggcgccttcttttccatcctccaagatatgcgcaacacaatcatggcgagcaagaccgtcgggacctccgaagagaagctgcggaaaaagtctagcttctaccagtcctacctgagacgcacacagagcatgggcattcagctcgaccaacggatcattgttctgtttatggtggcttggggaaaagaggccgtggataatttccaccttggggacgatatggaccccgaactgagaacgctcgcccagtctctgatcgacgtcaaggtgaaagagatttccaaccaggaacctcttaagctgtga

SEQ ID NO: 7065 - RNA, 1290 nt, synthetic construct
  misc_feature 1..1290: note = derived and/or modified CDS sequence (opt5) from HTNV(ROKA14-11)__KU207207.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttacgtttccctgcctaatgcgcaatctagcatgaaagccgaggaaattacacccgggcggtatcgcaccgctgtgtgcggactctaccctgcccagatcaaggctagacagatgatttccccggtcatgagcgtgatcggctttctggccctggcgaaagattggtctgaccggattgagcagtggctctccgaaccctgtaagctgcttcctgatacagccgctgtgagcctgctcgggggacccgccaccaaccgcgactatctgagacaacggcaggtcgctcttggcaatatggagacgaaagagtctaaggccatcagacagcacgccgaagctgcggggtgctccatgatcgaggatattgaaagcccttcttccatctgggttttcgccggagctcccgaccgctgtccgcctacatgcctgtttgtggccggcattgccgagctcggcgctttctttagcatcctgcaagatatgcggaacaccattatggcctccaaaacagtggggacctctgaagagaagatgagaaagaaaagctccttctaccagagctacctgcgccggacccagtctatgggaatccagctcgaccaaagaatcattgtcctgtttatggtggcgtggggcaaggaggctgttgataatttccatcttggggacgatatggaccccgaactgcgcacactcgcccagtccctgatcgacgtgaaagtcaaggagattagcaaccaggaacctcttaaactgtga

SEQ ID NO: 7066 - RNA, 1290 nt, synthetic construct
  misc_feature 1..1290: note = derived and/or modified CDS sequence (opt5) from HTNV(US8A14-2)__KU207208.1__N
  source 1..1290: mol_type = other RNA
atggccaccatggaggaactgcagagagagatcaacgctcacgaaggccaactcgtgattgcccggcagaaggtccgcgacgcggagaaacaggatgggaaggaccccgatgaactgaataaaagagctcttacagaccgggagggagttgccgtgagcatccaggccaagattgatgagctgaaacgccaactcgctgacagaatcgccacgggcaagaacctggggaaggaacaggatcctaccggagtggagccgggcgaccatcttaaagaacggtccatgctgtcttacgggaatgtcctcgatctgaaccacctggacattgatgagcccacaggacagaccgctgactggctcagcatcgtggtttatctgacatccttcgtggtccctatccttctgaaggccctctacatgctgaccacacgcggcagacagaccacgaaagataataagggcacccggattcgctttaaagacgactctagcttcgaggatgtgaacgggatcagaaagcccaagcatctttatgtttccctgcctaatgcgcaatctagcatgaaagccgaagagattacacccggacggtaccgcaccgctgtgtgcggcctctatcctgcccagatcaaggctagacagatgatttccccggtcatgagcgtgatcgggtttctggccctggcgaaagactggtctgatcggattgaacagtggctctccgagccctgtaagctgcttcctgacacagccgctgtgagcctgctcggaggccccgccaccaaccgcgattacctgagacaacggcaggtcgctcttgggaatatggaaacgaaagagtctaaggccatcagacagcacgccgaggctgcgggatgctccatgatcgaagacattgagagcccttcttccatctgggttttcgccggcgctcccgatcgctgtccgcctacatgcctgtttattgccggcatcgccgaactcggggctttctttagcattctgcaagacatgcggaacaccatcatggcctccaaaacagtgggaacctctgaggaaaagctgagaaagaaaagctccttctatcagagctacctccgccggacccagtctatgggcatccagctggatcaaagaattatcgtgctttttatggtcgcgtgggggaaggaggctgtggacaatttccatctgggagatgacatggaccccgagctccgcacactggcccagtcccttattgatgttaaagtgaaggaaatcagcaaccaggagcctctgaaactctga

SEQ ID NO: 7067 - RNA, 1290 nt, synthetic construct
  misc_feature 1..1290: note = derived and/or modified CDS sequence (opt5) from HTNV(US8A15-1)__KU207209.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttacgtttccctgcctaatgcgcaatctagcatgaaagccgaggaaattacacccgggcggtatcgcaccgctgtgtgcggactctaccctgcccagatcaaggctagacagatgatttccccggtcatgagcgtgatcggctttctggccctggcgaaagattggtctgaccggattgagcagtggctctccgaaccctgtaagctgcttcctgatacagccgctgtgagcctgctcgggggacccgccaccaaccgcgactatctgagacaacggcaggtcgctcttggcaatatggagacgaaagagtctaaggccatcagacagcacgccgaagctgcggggtgctccatgatcgaggatattgaaagcccttcttccatctgggttttcgccggagctcccgaccgctgtccgcctacatgcctgtttattgccggcatcgccgagctcggcgctttctttagcattctgcaagatatgcggaacaccatcatggcctccaaaatcgtggggacatctgaagagaagctgagaaagaaaagctccttctaccagagctacctccgccggacccagtctatgggcattcagctggaccaaagaatcattgtgctttttatggtcgcgtggggaaaggaggctgtggataatttccatctgggggacgatatggaccccgaactccgcaccctggcccagtcccttatcgacgttaaagtgaaggagattagcaaccaggaacctctgaaactctga

SEQ ID NO: 7068 - RNA, 1290 nt, synthetic construct
  misc_feature 1..1290: note = derived and/or modified CDS sequence (opt5) from HTNV(YaluRiver13)__HQ611981.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaggccagaccacgaaagacaataagggcacccggattagatttaaagatgactctagcttcgaagacgtgaacgggatccgcaagcccaagcatctttacgtttccctgcctaatgcgcaatctagcatgaaagccgaggaaattacacccggaagatatcggaccgctatctgcggcctctaccctgcccagattaaggctcgccagatgatctccccggtgatgagcgtcattgggtttctggccctggcgaaagattggtctgacagaatcgagcagtggctctccgaaccctgtaagctgcttcctgatacagccgctgtgagcctgctcggaggccccgccaccaaccgggactatctgcgccaaagacaggtggctcttgggaatatggagacgaaagagtctaaggccatccggcagcacgccgaagctgcgggatgctccatgattgaggatatcgaaagcccttcttccatttgggtcttcgccggcgctcccgacagatgtccgcctacatgcctgtttatcgccagcattggcgagctcggggccttcttttccatcctgcaagatatgcgcaacaccatcatggcttctaaaacagttggaaccagcgaagagaagctgcggaagaaatccagcttctaccagtcttacctcagacgcacccagtccatgggcattcagctggaccaacggatcattgtgctttttatggtgagctgggggaaggaggccgtcgataatttccatctgggagacgatatggaccccgaactcagaacactggcgcagtctcttatcgacgtgaaagttaaggagattcctaaccaggaacccctgaaactctga

SEQ ID NO: 7069 - RNA, 1290 nt, synthetic construct
  misc_feature 1..1290: note = derived and/or modified CDS sequence (opt5) from HTNV(84FLi)__AY017064.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaactacctggatattgacgagcccaccgggcagacagctgattggctcagcatcgtcatctatctgacctccttcgtggttcctattcttctgaaggccctctacatgctgacaacccgcggaagacagacgaccaaagacaataagggcacacggatccgctttaaagatgactctagcttcgaagacgtgaacggcattagaaagcccaagcacctttatgtctccctgcctaatgcgcaatctagcatgaaagccgaggaaatcacccccgggcggtaccgcacagctatttgcggactctatcctgcccagatcaaggctagacagatgatttccccggtgatgagcgttatcggctttctggccctggcgaaagattggtctgaccggatcgagcagtggctctccgaaccctgtaagctgcttcctgataccgccgctgtgagcctgcatgggggacccgccacgaaccgcgactacctcagacaacggcaggtcgctctgggcaatatggagacaaaagagtctaaggccattagacagcacgccgaatccgctgggtgcagcatgatcgaggatattgaatctccttccagcatctgggtgttcgcgggagcccccgaccgctgtccgcctacctgcctttttattgctggcatcgccgagctgggcgccttcttttccatcctccaagatatgcggaacacaattatggcttctaaaaccgtggggaccagcgaagagaagctgagaaagaaatccagcttctaccagtcttatctgcgccggacacagtccatgggaatccagctcgaccaaagaattatcgtcctgtttatggttgcctggggcaaggaggcggtggataatttccatcttggggacgatatggaccccgaactgcgcacgctcgctcagagcctgattgacgtgaaagtcaaggagatctctaaccaggaacctcttaaactgtga

SEQ ID NO: 7070 - RNA, 1290 nt, synthetic construct
  misc_feature 1..1290: note = derived and/or modified CDS sequence (opt5) from HTNV(Bao14)__AB127998.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgtgagcatccaggccaagattgacgaactgaaacgccaactcgccgatagaatcgctaccggaaagaacctgggcaaggagcaggaccctacaggggtggaaccgggagatcatcttaaagagcggtccatgctgtcttatggcaatgtcctcgacctgaaccacctggatattgacgagcccaccgggcagacagccgattggctcagcatcgtggtttacctgacctccttcgtggtccctatccttctgaaggctctctatatgctgacaacccgcggaagacagacgaccaaagacaataagggcacacggattcgctttaaagatgactctagcttcgaagacgtgaacggcatcagaaagcccaagcatctttacgtttccctgcctaatgcccaatctagcatgaaagcggaggaaattacccccgggcggtatcgcacagccatctgcggactctaccctgctcagattaaggccagacagatgatctccccggtgatgagcgtcattggctttctggctctggccaaagattggtctgaccggatcgagcagtggctctccgaaccctgtaagctgcttcctgataccgcggccgtgagcctgctcgggggacccgctacgaaccgcgactatctgagacaaagacaggtggcccttggcaatatggagacaaaagagtctaaggctatccggcagcacgccgaagccgctgggtgctccatgattgaggatatcgaaagcccttcttccatttgggtcttcgcgggagcccccgaccgctgtccgcctacctgcctgtttatcgctggcattgccgagctcggcgccttctttagcatcctgcaagatatgcggaacacaatcatggcttccaaaaccgttgggacctctgaagagaagctgagaaagaaaagctccttctaccagagctacctccgccggacacagtctatgggcattcagctggaccaaagaatcattgtgctttttatggtggcctggggaaaggaggcggtcgataatttccatctgggggacgatatggaccccgaactccgcacgctggctcagtcccttatcgacgtgaaagttaaggagattagcaaccaggaacctctgaaactctga

SEQ ID NO: 7071 - RNA, 1290 nt, synthetic construct
  misc_feature 1..1290: note = derived and/or modified CDS sequence (opt5) from HTNV(Chen4)__AB027101.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaaccacctggatattgacgagcccaccgggcagacagctgattggctcagcatcgtcatctacctgacctccttcgtggttcctattcttctgaaggccctctatatgctgacaacccgcggaagacagacgaccaaagacaataagggcacacggatccgctttaaagatgactctagcttcgaagacgtgaacggcattagaaagcccaagcatctttacgtctccctgcctaatgcgcaatctagcatgaaagccgaggaaatcacccccgggcggtatcgcacagctatttgcggactctaccctgcccagatcaaggctagacagatgatttccccggtgatgagcgttatcggctttctggccctggcgaaagattggtctgaccggatcgagcagtggctctccgccccctgtaagctgcttcctgataccgctgccgtgagcctgcacgggggacccgctacgaaccgcgacaatctcagacaacggcaggtcgccctgggcaacatggaaacaaaagagtctaaggccattagacagcatgctgagtccgcggggtgcagcatgatcgaagatattgagtctccttccagcatctgggtgttcgccggagctcccgaccgctgtccgcctacctgcctttttattgccggcatcgccgaactgggcgctttcttttccatcctccaagatatgcggaatacaattatggcctctaaaaccgtggggaccagcgaggaaaagctgagaaagaaatccagcttctatcagtcttacctgcgccggacacagtccatgggaatccagctcgaccaaagaattatcgtcctgtttatggttgcgtggggcaaggaggctgtggataacttccgccttggggacgatatggaccccgagctgcggacgctcgcccagagcctgattgacgtgaaagtcaaggaaatctctaatcaggagcctcttaaactgtga

SEQ ID NO: 7072 - RNA, 1290 nt, synthetic construct
  misc_feature 1..1290: note = derived and/or modified CDS sequence (opt5) from HTNV(Hu)__AB027111.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatccaggctaagattgacgaactgaaacgccaactcgccgatagaatcgctacgggaaagaacctgggcaaggagcaggaccctaccggggtggaaccgggagatcatcttaaagagcggtccatgctgtcttatggcaatgtgctcgacctgaaccacctggatattgacgagcccacagggcagaccgccgattggctcagcatcgtcatctacctgacatccttcgtggttcctattcttctgaaggcgctctatatgctgaccacacgcggaagacagaccacgaaagacaataagggcacccggatccgctttaaagatgactctagcttcgaagacgtgaacggcattagaaagcccaagcatctttacgtctccctgcctaatgcccaatctagcatgaaagctgaggaaatcacacccgggcggtatcgcaccgccatttgcggactctaccctgctcagatcaaggccagacagatgatttccccggtgatgagcgttatcggctttctggcgctggccaaagattggtctgaccggatcgagcagtggctctccgaaccctgtaagctgcttcctgatacagctgccgtgagcctgcacgggggacccgctaccaaccgcgactatctcagacaacggcaggtcgccctgggcaatatggagacgaaagagtctaaggccattagacagcatgctgaagcggccgggtgctccatgatcgaggatattgaaagcccttcttccatctgggtgttcgctggagcccccgaccgcagcccgcctacatgtatgtttattgccggcatcgatgagcttggcgctttcttttccatcctgcaagacatgcggaacaccattatggcctctaaaacagtggggaccagcgaagagaagctcagaaagaaatccagcttctaccagtcttacctgcgccggacccagtccatgggaatccagctggatcaaagaattatcgtcctctttatggttgcgtggggcaaggaggctgtggacaatttccacctgggggatgacatggaccccgaacttcgcacactggcccagagcctcattgatatcaaagtgaaggagatctctaaccaggaacctctgaaactttga

SEQ ID NO: 7073 - RNA, 1290 nt, synthetic construct
  misc_feature 1..1290: note = derived and/or modified CDS sequence (opt5) from HTNV(HubeiHu02)__JQ665905.1__N
  source 1..1290: mol_type = other RNA
atggccaccatggaggaactgcagaaggagatcaacgctcacgaaggccaactcgtgattgccagacagaaagtccgggacgcggagaagcagtacgaaaaagatcccgacgagctgaataagcgcacacttacggatagagagggggttgctgccagcatccaggccaaaattgacgaactgaagcggcaactcgctgatcgcatcgccaccggaaagaacctgggcaaagagcaggaccctacaggggtggaaccgggagatcatcttaaggagagatccatgctgtcttatggcaatgtgctcgacctgaaccacctggatattgacgagcccaccgggcagacagctgattggctcagcatcgtcatctacctgacctccttcgtggttcctattcttctgaaagccctctatatgctgacaacccggggacgccagacgaccaaggacaataaaggcacaagaatccggtttaaggatgactctagcttcgaagacgtgaacggcattcgcaagcccaaacatctttacgtctccctgcctaatgcgcaatctagcatgaaggccgaggatatcacccccgggagatatcggacagctatttgcggactctaccctgcccagatcaaagctcgccagatgatttccccggtgatgagcgttatcggctttctggccctggcgaaggactggtctgatagaatcgaacagtggctctccgagccctgtaaactgcttcctgacaccgccgctgtgagcctgcacgggggacccgccacgaaccgggattatctccgccaaagacaggtcgctctgggcaatatggaaacaaaggagtctaaagccattcggcagcatgccgagtccgctgggtgcagcatgatcgaagacattgagtctccttccagcatctgggtgttcgcgggagcccccgatagatgtccgcctacctgcctttttattgctggcatcgccgaactgggcgccttcttttccatcctccaagacatgcgcaacacaattatggcttctaagaccgtggggaccagcgaggaaaagctgcggaaaaagtccagcttctaccagtcttacctgagacgcacacagtccatgggaatccagctcgatcaacggattatcgtcctgtttatggttgcctggggcaaagaggcggtggacaatttccaccttggggatgacatggaccccgagctgagaacgctcgctcagagcctgattgatgtgaaggtcaaagaaatctctaaccaggagcctcttaagctgtga

SEQ ID NO: 7074 - RNA, 1290 nt, synthetic construct
  misc_feature 1..1290: note = derived and/or modified CDS sequence (opt5) from HTNV(HV004)__JQ083395.1__N
  source 1..1290: mol_type = other RNA
atggccaccatggaggaactgcagaaggagatcaacgctcacgaaggccaactcgtgattgccagacagaaagtccgggacgcggagaagcagtacgaaaaagatcccgacgagctgaataagcgcgctcttacagatagagagggggttgccgccagcatccaggctaaaattgacgaactgaagcggcaactcgccgatcgcatcgctacgggaaagaacctgggcaaagagcaggaccctaccggggtggaaccgggagatcatcttaaggagagatccatgctgtcttatggcaatgtgctcgacctgaaccacctggatattgacgagcccacagggcagaccgccgattggctcagcatcgtcatctacctgacatccttcgtggttcctattcttctgaaagcgctctatatgctgaccacacggggacgccagaccacgaaggacaataaaggcaccagaatccggtttaaggatgactctagcttcgaagacgtgaacggcattcgcaagcccaaacatctttacgtctccctgcctaatgcccaatctagcatgaaggctgaggaaatcacacccgggagatatcggaccgccatttgcggactctaccctgctcagatcaaagcccgccagatgatttccccggtgatgagcgttatcggctttctggcgctggccaaggattggtctgacagaatcgagcagtggctctccgaaccctgtaaactgcttcctgatacagctgccgtgagcctgcacgggggacccgctaccaaccgggactatctccgccaaagacaggtcgccctgggcaatatggagacgaaggagtctaaagccattcggcagcatgctgaatccgcggggtgcagcatgatcgaggatattgaatctccttccagcatctgggtgttcgccggagctcccgacagatgtccgcctacatgcctttttattgccggcatcgccgagctgggcgctttcttttccatcctccaagatatgcgcaacaccattatggcctctaagacagtggggaccagcgaagagaagctgcggaaaaagtccagcttctaccagtcttacctgagacgcacccagtccatgggaatccagctcgaccaacggattatcgtcctgtttatggttgcgtggggcaaagaggctgtggataatttccaccttggggacgatatggaccccgaactgagaacactcgcccagagcctgattgacgtgaaggtcaaagagatctctaaccaggaacctcttaagctgtga

SEQ ID NO: 7075 - RNA, 1290 nt, synthetic construct
  misc_feature 1..1290: note = derived and/or modified CDS sequence (opt5) from HTNV(Maaji-1)__AF321094.1__N
  source 1..1290: mol_type = other RNA
atggccaccatggaggaactgcagaaggagatcaacgctcacgaaggccaactcgtgattgccagacagaaagtccgggacgcggagcgccagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaaccacctggatattgacgagcccaccgggcagacagctgattggctcagcatcgtcatctacctgacctccttcgtggttcctattcttctgaaggccctctatatgctgacaacccgcggaagacagacgaccaaagacaataagggcacacggatccgctttaaagatgactctagcttcgaagacgtgaacggcattagaaagcccaagcatctttacgtctccctgcctaatgcgcaatctagcatgaaagccgaggaaatcacccccgggcggtatcgcacagctgtgtgcggactctaccctgcccagattaaggctagacagatgatctccccggttatgagcgtgattggctttatggccctggcgaaagattggtctgagcggatcgaacagtggctgtccgagccctgtaagctcctgcctgacaccagcgccgtctctcttctcgggggacccgctacgaacaaagattatctgcgccaaagacaggtggccctgggcaatatggagacaaaggaatccaaagctatccggcagcaagccgaggccagcgggtgctctatgattgaagacatcgagtcccctagctccatttgggtgttcgctggagcgcccgatagatgtccgcctacctgcctttttatcgccggcatggctgaactgggcgccttcttttctattctccaggacatgcgcaacacaatcatggccagcaagaccgtcgggacctccgaggagaagctgcggaaaaagagctctttctaccagtcctacctgagacgcacacagagcatgggaatccaactcgatcagcggattatcgttctgtttatggtggcttggggcaaagaagccgtggacaatttccaccttggggatgacatggatcccgagctgagaacgctcgcgcagtctctgattgacgtcaaggtgaaagaaatcagcaaccaggagcctcttaagctgtga

SEQ ID NO: 7076 - RNA, 1290 nt, synthetic construct
  misc_feature 1..1290: note = derived and/or modified CDS sequence (opt5) from HTNV(Maaji-2)__AF321095.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgtgagcatccaggccaagattgacgaactgaaacgccaactcgccgatagaatcgctaccggaaagaacttcggcaaggagcaggaccctacaggggtggaaccgggagatcatctgaaagagcggtccatgctttcttatggcaatgtcctggacctcaaccacctggatattgacgagcccaccgggcagacagccgattggctgagcatcgtggtttacctcacctcctttgtggtccctatcctgcttaaggctctgtatatgctcacaacccgcggaagacagacgaccaaagacaataagggcacacggattcgcttcaaagatgactctagctttgaagacgtgaacggcatcagaaagcccaagcatctgtacgtttcccttcctaatgcccaatctagcatgaaagcggaggaaattacccccgggcggtatcgcacagccgtgtgcggactgtaccctgctcagatcaaggccagacagatgatttccccggtcatgagcgtgatcggcttcctcgctctggccaaagattggtctgaccggattgagcagtggctgtccgaaccctgtaagctcctgcctgataccgcggccgtgagccttctcgggggacccgctacgaaccgcgactatctgagacaacggcaggtcgccctgggcaatatggagacaaaagagtctaaggctatcagacagcacgccgaagccgctgggtgctccatgatcgaggatattgaaagcccttcttccatctgggtttttgcgggagcccccgaccgctgtccgcctacctgccttttcattgctggcatcgccgagctgggcgcctttttcagcattctccaagatatgcggaacacaatcatggcttccaaaaccgtggggacctctgaagagaagctgagaaagaaaagctccttttaccagagctacctgcgccggacacagctcatgggaatccagctggaccaaagaattatcgtgcttttcatggtcgcctggggcaaggaggcggtggataattttcatctgggggacgatatggaccccgaactccgcacgctggctcagtctcttattgacgttaaagtgaaggagatctccaaccaggaacctctgaaactctga

SEQ ID NO: 7077 - RNA, 1290 nt, synthetic construct
  misc_feature 1..1290: note = derived and/or modified CDS sequence (opt5) from HTNV(N8)__DQ658415.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaaccacctggatattgacgagcccaccgggcagacagctgattggctcagcatcgtcatctacctgacctccttcgtggttcctattcttctgaaggccctctatatgctgacaacccgcggaagacagacgaccaaagacaataagggcacacggatccgctttaaagatgactctagcttcgaagacgtgaacggcattagaaagcccaagcatctttacctgtccctccctaatgcgcaatctagcatgaaagccgaggaaatcacccccgggcggtatcgcacagctatttgcggactgtaccctgcccagatcaaggctagacagatgatttccccggtcatgagcgtgatcggctttctggccctcgcgaaagattggtctgaccggatcgagcagtggctgtccgaaccctgtaaacttctgcctgatgccgctgccgttagcctccacgggggacccgctaccaaccgcgactatctgagacaaagacaggtggcccttggcaatatggagacgaaggagtctaaggccattcggcagcatgctgaaacagcggggtgctccatgatcgatgacattgagagcccttcttccatctgggtcttcgccggagctcccgatcgctgtccgcctacctgcctgtttattgccggcatcgccgaactcggcgctttctttagcatcctgcaagacatgcggaacacaattatggcctccaaaaccgtggggacctctgaggaaaagctgagaaagaaaagctccttctaccagagctacctccgccggacacagtctatgggaatccagctggatcaaagaattatcgtgctttttatggtcgcgtggggcaaggaggctgttgacaatttccacctgggggatgacatggaccccgagctccgcacgctggcccagtcccttattgatgtgaaagtgaaggaaatcagcaaccaggagcctctgaaactctga

SEQ ID NO: 7078 - RNA, 1290 nt, synthetic construct
  misc_feature 1..1290: note = derived and/or modified CDS sequence (opt5) from HTNV(Q32)__AB027097.1__N
  source 1..1290: mol_type = other RNA
atggccaccatggaggaactgcagagagagatcaacgctcacgaaggccaactcgtgattgcccggctgaaggtccgcgacgcggagaaaccctacgaaaaggatcctgacgagcttaatatgagaacactgacggatcgggagggggttgctgccagcatccaggccaaaattgacgaactcaagcgccagctggctgatagaatcgccaccggcaaaaaccttggaaaggagcaggacccgacaggggtggaacccggagatcatctgaaggagcggtccatgctctcttatggcaatgtgctggacctgaaccacctcgatattgacgagcctaccgggcaaacagctgattggctgagcatcgtcatctaccttacctccttcgtggttcccattctgctcaaagccctgtatatgcttacaacccgcggaagacagacgaccaaggacaataaaggcacacggatccgctttaaggatgactctagcttcgaagacgtgaacggcattagaaaacctaagcatctgtacgtctccctccccaatgcgcagtctagcatgaaggccgaggaaatcacccctgggcggtatcgcacagctatttgcggactgtacccggcccagatcaaagctagacaaatgatttcccccgtgatgagcgttatcggctttctggccctcgcgaaggattggtctgaccggatcgagcagtggctgtccgaaccttgtaaacttctgcccgataccgccgctgtgagcctccacgggggacctgccacgaaccgcgactatctgagacagcggcaggtcgctcttggcaatatggagacaaaggagtctaaagccattagacaacatgccgaatccgctgggtgcagcatggtggaggatatcgaatctccctccagcatttgggtgttcgcgggagccccggaccgctgtcctcctacctgcctgtttatcgctggcattgccgagctcggcgccttcttttccatcctgcaggatatgcggaacacaatcatggcttctaagaccgtcgggaccagcgaagagaaactgagaaagaagtccagcttctaccagtcttacctccgccggacacaatccatgggcattcagctggaccagagaatcattgttctttttatggtggcctggggaaaagaggcggtggataatttccagcccggggacgatatggaccccgaactgcgcacgctcgctcaaagcctgatcgacgtcaaggtgaaagagatttctaaccaggaaccccttaagctgtga

SEQ ID NO: 7079 - RNA, 1290 nt, synthetic construct
  misc_feature 1..1290: note = derived and/or modified CDS sequence (opt5) from HTNV(SXHu2012B1)__KC844226.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatccaggctaagattgacgaactgaaacgccaactcgccgatagaatcgctacgggaaagaacctgggcaaggagcaggaccctaccggggtggaaccgggagatcatcttaaagagcggtccatgctgtcttatggcaatgtgctcgacctgaaccacctggatattgacgagcccacagggcagaccgccgattggctcagcatcgtcatctacctgacatccttcgtggttcctattcttctgaaggcgctctatatgctgaccacacgcggaagacagaccacgaaagacaataagggcacccggatccgctttaaagatgactctagcttcgaagacgtgaacggcattagaaagcccaagcatctttacgtctccctgcctaatgcccaatctagcatgaaagctgaggaaatcacacccgggcggtatcgcaccgccatttgcggactctaccctgctcagatcaaggccagacagatgatttccccggtgatgagcgttatcggctttctggcgctggccaaagattggtctgaccggatcgagcagtggctctccgaaccctgtaagctgcttcctgatacagctgccgtgagcctgcacgggggacccgctaccaaccgcgactatctcagacaacggcaggtcgccctgggcaatatggagacgaaagagtctaaggccattagacagcatgctgaatccgcggggtgcagcatggtggaggatatcgaatctccttccagcatttgggtgttcgccggagctcccgaccgctgtccgcctacatgcctttttatcgccggcattgccgagctgggcgctttcttttccatcctccaagatatgcggaacaccatcatggcctctaaaacagtcgggaccagcgaagagaagctgagaaagaaatccagcttctaccagtcttacctgcgccggacccagtccatgggcattcagctcgaccaaagaatcattgttctgtttatggtggcgtggggaaaggaggctgtggataatttccaccttggggacgatatggaccccgaactgcgcacactcgcccagagcctgatcgacgtcaaagtgaaggagatttctaaccaggaacctcttaaactgtga

SEQ ID NO: 7080 - RNA, 1290 nt, synthetic construct
  misc_feature 1..1290: note = derived and/or modified CDS sequence (opt5) from HTNV(TJJ16)__AY839871.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggaggggctggccgccagcatccaggctaagattgacgaactcaaacgccaactggccgatagaatcgctacgggaaagaaccttggcaaggagcgggaccctaccggggttgaaccgggagatcatctgaaagagcgctccatgctctcttatggcaatgtgctggacctgaaccacctcgatattgacgagcccacagggcagaccgccgattggctgagcatcgtgatctaccttacatccttcgtcgtgcctattctgctcaaggcgctgtatatgcttaccacaagaggacggcagaccacgaaagacaataagggcacccgcatcagatttaaagatgactctagcttcgaagacgttaacggcattcggaagcccaagcatctgtacgtgtccctccctaatgcccagtctagcatgaaagctgaggaaatcacacccgggcgctatagaaccgccatttgcggactgtaccctgctcaaatcaaggcccggcagatgatttccccggtcatgagcgtgatcggctttctggcgctcgccaaagattggtctgaccgcatcgagcagtggctgtccgaaccctgtaaacttctgcctgatacagctgccgttagcctccacgggggacccgctaccaacagagactatctgcggcagagacaagtggcccttggcaatatggagacgaaggagtctaaggccattcgccagcatgctgaatccgcggggtgcagcatggtcgaggatatcgaatctccttccagcatttgggtgttcgccggagctcccgaccggtgtccgcctacatgcctgtacatcgccggcattgccgagctcggcgcctttttctccatcctgcaggatatgagaaacaccatcatggcttctaaaacagtggggaccagcgaagagaagctgcgcaagaaatccagcttttaccaatcttatctccggagaacccagtccatgggcattcagctggaccagcgcatcattgtccttttcatggttgcgtggggaaaggaggctgtggataattttcacctgggggacgatatggaccccgaactccggacactggcccaaagccttatcgacgtgaaagtcaaggagatttctaaccaggaacctctgaaactctga

SEQ ID NO: 7081 - RNA, 1290 nt, synthetic construct
  misc_feature 1..1290: note = derived and/or modified CDS sequence (opt5) from HTNV(WCL)__KM355414.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactggagcgccaactcgctgatagaatcgccacgggaaagaacctgggcaaggaacaggaccctaccggggtggagccgggagatcatcttaaggagcggtccatgctgtcttatggcaatgtcctcgacctgaaccacctggatattgacgaacccacagggcagaccgctgattggctcagcatcgtggtttacctgacatccttcgtggtccctatccttctgaaagccctctatatgctgaccacacgcggaagacagaccacgaaggacaataaaggcacccggattcgctttaaggatgactctagcttcgaggacgtgaacggcatcagaaaacccaagcatctttacgtttccctgcctaatgcgcaatctagcatgaaggccgaagagattacacccgggcggtatcgcaccgctatctgcggactctaccctgcccagattaaagctagacagatgatctccccggtgatgagcgtcattggctttctggccctggcgaaggattggtctgaccggatcgaacagtggctctccgagccctgtaaactgcttcctgatacagccgctgtgagcctgctcgggggacccgccaccaaccgcgactatctgagacaaagacaggtggctcttggcaatatggagacgaaggaatctaaagccatccggcagcacgccgaggctgcggggtgctccatgattgaagatatcgagagcccttcttccatttgggtcttcgccggagctcccgaccgctgtccgcctacatgcctgtttatcgccggcattgccgaactcggcgctttctttagcatcctgcaagatatgcggaacaccatcatggcctccaagacagttgggacctctgaggagaaactgagaaagaaaagctccttctaccagagctacctccgccggacccagtctatgggcattcagctggaccaaagaatcattgtgctttttatggtggcgtggggaaaagaagctgtcgataatttccatctgggggacgatatggaccccgagctccgcacactggcccagtcccttatcgacgtgaaggttaaagaaattagcaaccaggagcctctgaagctctga

SEQ ID NO: 7082 - RNA, 1290 nt, synthetic construct
  misc_feature 1..1290: note = derived and/or modified CDS sequence (opt5) from HTNV(YN509)__GU329991.1__N
  source 1..1290: mol_type = other RNA
atggccaccatggaggaactgcagaaggagatcaacgctcacgaaggccaactcattatcgccaaacagaaggtgaaagacgcggagaagcagtacgaaaaagatcccgacgagctgaataagagagctcttacagatcgggagggggtcgccgccagcattcaggctaagatcgacgaactgaaacgccaactcgccgatagaattgctacgggaaagaacctgggccaggaccgggatcctaccggggttgagccgggagaccatcttaaagaacgctccatgctgtcttatggcaatatcctcgatctgaaccacctggacatcgatgagcccacagggcagaccgccgactggctcagcattatcgtgtacctgacatccttcgtggtccctattcttctgaaggcgctctatatgctgaccacaagaggacggcagaccgccaaagataataagggcacgcgcatcagatttaaggacgactctagcttcgaggatgtgaacggcattcggaaacccaagcatctttacgtttccatgcctaatgctcaatctagcatgaaagccgaagagatcacccccgggcgctatagaacagctgtgtgcggactgtaccctgcccagattaaggcgcggcagatggtctccccggtgatgagcgttatcggctttatggccctcgctaaagactggaccgatcgcatcgaaaactggctgggggagccctgtaagctgctccctgacacatcttccgtgattctgcttggaggccccgccaccaatagagattatatccggcagcgccaagtcgctctggggaacatggaaacgaaagaggccaaggccgtgagacagcacgctgagagcgcgggatgctctatgattgacaatatcgattcccctagctctatttgggtgttcgccggcgctcccgaccggtgtccgcctacatgcctctttgtcgccggcctggccgaacttggggctttcttttccatcctgcaggatatgagaaacaccatcatggccagcaagacagttggaacctccgaggagaaaatgcgcaagaaatctagcttctaccaatcctacctccggagaacccagagcatgggcattcagctggaccagcgcatcattgtgctgtttatggtggcgtgggggaaggaagctgtcgataatttccatctcggagacgacatggatcccgaactgcggaaccttgcccaatctctgatcgaccagaaagtgaaggagatttccaatcaggagcctctcaagctgtga

SEQ ID NO: 7083 - RNA, 1290 nt, synthetic construct
  misc_feature 1..1290: note = derived and/or modified CDS sequence (opt5) from HTNV(YU62)__AY748309.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggaggggctggccgccagcatccaggctaagattgacgaactcaaacgccaactggccgatagaatcgctacgggaaagaaccttggcaaggagcaggaccctaccggggttgaaccgggagatcatctgaaagagcggtccatgctctcttatggcaatgtgctggacctgaaccacctcgatattgacgagcccacagggcagaccgccgattggctgagcatcgtgatctaccttacatccttcgtcgtgcctattctgctcaaggcgctgtatatgcttaccacacgcggaagacagaccacgaaagacaataagggcacccggatccgctttaaagatgactctagcttcgaagacgttaacggcattagaaagcccaagcatctgtacgtgtccctccctaatgcccaatctagcatgaaagctgaggaaatcacacccgggcggtatcgcaccgccatttgcggactgtaccctgctcagatcaaggccagacagatgatttccccggtcatgagcgtgatcggctttctggcgctcgccaaagattggtctgaccggatcgagcagtggctgtccgaaccctgtaaacttctgcctgatacagctgccgttagcctccacgggggacccgctaccaaccgcgactatctgagacaaagacaggtggcccttggcaatatggagacgaaggagtctaaggccattcggcagcatgctgaatccgcggggtgcagcatggtcgaggatatcgaatctccttccagcatttgggtgttcgccggagctcccgaccgctgtccgcctacatgcctgtttatcgccggcattgccgagctcggcgctttcttttccatcctgcaagatatgcggaacaccatcatggcctctaaaacagtggggaccagcgaagagaagctgagaaagaaatccagcttctaccagtcttacctccgccggacccagtccatgggcattcagctggaccaaagaatcattgtcctttttatggttgcgtggggaaaggaggctgtggataatttccacctgggggacgatatggaccccgaactccgcacactggcccagagccttatcgacgtgaaagtcaaggagatttctaaccaggaacctctgaaactctga

SEQ ID NO: 7084 - RNA, 1290 nt, synthetic construct
  misc_feature 1..1290: note = derived and/or modified CDS sequence (opt5) from HTNV(ZLS6-11)__FJ753396.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatccaggctaagattgacgaactgaaacgccaactcgccgatagaatcgctacgggaaagaacctgggcaaggagcaggaccctaccggggtggaaccgggagatcatcttaaagagcggtccatgctgtcttatggcaatgtgctcgacctgaaccacctggatattgacgagcccacagggcagaccgccgattggctcagcatcgtcatctacctgacatccttcgtggttcctattcttctgaaggcgctctatatgctgaccacacgcggaagacagaccacgaaagacaataagggcacccggatccgctttaaagatgactctagcttcgaagacattaacggcatcagaaagcccaagcatctttacgtgtccctgcctaatgcccaatctagcatgaaagctgaggaaattacacccgggcggtatcgcaccgccatctgcggactctaccctgctcagattaaggccagacagatgatctccccggtcatgagcgtgatcggctttctggcgctggccaaagattggtctgaccggattgagcagtggctctccgaaccctgtaagctgcttcctgatacagctgccgttagcctgcacgggggacccgctaccaaccgcgactatctcagacaaagacaggtggccctgggcaatatggagacgaaagagtctaaggccatccggcagcatgctgaaacagcggggtgctccatgattgaggatatcgaaagcccttcttccatttgggtcttcgccggagctcccgaccgctgtccgcctacctgcctttttatcgccggcatcgccgagctgggcgctttctttagcattctccaagatatgcggaacacaatcatggcctccaaaaccgtggggacctctgaagagaagctgagaaagaaaagctccttctaccagagctacctgcgccggacacagtctatgggcattcagctcgaccaaagaatcattgtgctgtttatggtcgcgtggggaaaggaggctgttgataatttccaccttggggacgatatggaccccgaactgcgcacgctcgcccagtccctgatcgacgtgaaagtgaaggagatcagcaaccaggaacctcttaaactgtga

SEQ ID NO: 7085 - RNA, 1290 nt, synthetic construct
  misc_feature 1..1290: note = derived and/or modified CDS sequence (opt5) from HTNV__AB027523.1__N
  source 1..1290: mol_type = other RNA
atggccaccatggaggaactgcagaaggagatcaacgctcacgaaggccaactcattatcgccaaacagaaggtgaaagacgcggagaagcagtacgaaaaagatcccgacgagctgaataagagagctcttacagatcgggagggggtcagcgcctccattcaggccaagatcgacgaactgaaacgccaactcgctgatagaattgccacgggaaagaacctgggccaggaccgggatcctaccggggttgagccgggagaccatcttaaagaacgctctatgctgagctatggcaatatcctcgatctgaaccacctggacatcgatgagcccacagggcagaccgctgactggctctccattatcgtgtacctgacatctttcgtggtccctattcttctgaaggccctctatatgctgaccacaagaggacggcagaccgcgaaagataataagggcacgcgcatcagatttaaggacgacagctccttcgaggatgtgaacggcattcggaaacccaagcatctttacgtttctatgcctaatgcccaaagctccatgaaagctgaagagatcacccccgggggatatcgcacagccgtgtgcggcctgtttcctgctcagattaaggccagacagatggtcagcccggtgatgtctgttatcgggttcatggcgctcgccaaagactggaccgatcggatcgaatcctggctgggagagccctgtaagctgctccctgacacaagcgctgtgtctctgcttggcgggcccgccaccaaccgcgattacattagacagcggcaagtcgctctgggaaatatggaaacgaaagaggccaaggccgtgcgccagcacgctgagtccgcgggctgcagcatgatcgacaacattgattctccttccagcatctgggtgtttgccggcgctcccgacagatgtccgcctacatgcctcttcattgccgggatcgccgaactgggagcctttttctccatccttcaggatatgcggaataccattatggcttctaagacagtcggcaccagcgaggagaaaatgagaaagaaatccagcttttatcaatcttacctgcgccggacccagtccatggggatccagctcgaccagagaattatcgttctgttcatggtggcgtggggaaaggaagctgccgataactttcaacatggcgacgacatggatcccgaactgcgcacactcgcccagagcctgattgaccagaaagtgaaggagatctctaatcaggagcctcttaagctgtga

SEQ ID NO: 7086 - RNA, 1293 nt, synthetic construct
  misc_feature 1..1293: note = derived and/or modified CDS sequence (opt5) from HTNV__D25530.1__N
  source 1..1293: mol_type = other RNA
atgatggccaccatggaggaactgcagagagagatcaacgctcacgaaggccaactcgtgattgcccggcagaaggtccgcgacgcggagaaacagtacgaaaaggatcccgacgagctgaataaaagagctcttacaaaccgggagggggttgccgtgagcatccaggccaagattgatgaactgaaaatgcaactcgctgaccgcatcgccacgggaaagaatctgggcaaggagcaggatcctaccggggtggaaccgggagaccatcttaaagagagatccatgctgtcttatggcaacgtcctcgatctgaatcacctggacattgatgagcccacagggcagaccgctgactggctcagcatcatcgtgtacctgacatccttcgttgtgcctattcttctgaaggccctctatatgctgaccacacggggacgccagaccacgaaagataacaagggcaccagaatccggtttaaagacgattctagcttcgaagacgtcaatggcattcgcaagcccaagcatctttacgtgtccctgcctaacgcgcaatctagcatgaaagccgaggaaatcacacccgggagatatcggaccgctgtttgcggactctaccctgcccagattaaggctcgccagatgatctccccggtgatgagcgtcattggctttctggccctggcgaaagactggtctgatagaatcgagcagtggctcatcgaaccctgtaagctgcttcctgacacagccgctgtgtccctgctcgggggacccgccaccaatcgggattatctgcgccaaagacaggtggctcttggcaacatggagacgaaagagagcaaggccattcggcagcacgccgaagctgcggggtgctctatgatcgaggacattgaatcccctagctctatctgggtcttcgccggagctcccgatagatgtccgcctacatgcctgtttattgccggcatcgccgagctcggcgctttcttttccatcctgcaagacatgcgcaataccattatggccagcaaaacagttgggacctccgaagagaagctgcggaagaaatctagcttctaccagtcctacctcagacgcacccagagcatgggaatccagctggatcaacggattatcgtgctttttatggtggcgtggggcaaggaggctgtcgacaacttccatctgggggatgacatggatcccgaactcagaacactggcccagtctcttattgacgtgaaagttaaggagatctccaatcaggaacctctgaaactctga

SEQ ID NO: 7087 - RNA, 1290 nt, synthetic construct
  misc_feature 1..1290: note = derived and/or modified CDS sequence (opt5) from HTNV__M14626.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgtgagcatccaggccaagattgacgaactgaaacgccaactcgccgatagaatcgctaccggaaagaacctgggcaaggagcaggaccctacaggggtggaaccgggagatcatcttaaagagcggtccatgctgtcttatggcaatgtcctcgacctgaaccacctggatattgacgagcccaccgggcagacagccgattggctcagcatcatcgtgtacctgacctccttcgttgtgcctattcttctgaaggctctctatatgctgacaacccgcggaagacagacgaccaaagacaataagggcacacggatccgctttaaagatgactctagcttcgaagacgtcaacggcattagaaagcccaagcatctttacgtgtccctgcctaatgcccaatctagcatgaaagcggaggaaatcacccccgggcggtatcgcacagccgtttgcggactctaccctgctcagattaaggccagacagatgatctccccggtgatgagcgtcattggctttctggctctggccaaagattggtctgaccggatcgagcagtggctcatcgaaccctgtaagctgcttcctgataccgcggccgtgtccctgctcgggggacccgctacgaaccgcgactatctgagacaaagacaggtggcccttggcaatatggagacaaaagagagcaaggctattcggcagcacgccgaagccgctgggtgctctatgatcgaggatattgaatcccctagctctatctgggtcttcgcgggagcccccgaccgctgtccgcctacctgcctgtttattgctggcatcgccgagctcggcgccttcttttccatcctgcaagatatgcggaacacaattatggctagcaaaaccgttgggacctccgaagagaagctgagaaagaaatctagcttctaccagtcctacctccgccggacacagagcatgggaatccagctgggccaaagaattatcgtgctttttatggtggcctgggggaaggaggcggtcgacaatttccatctgggagatgacatggatcccgaactccgcacgctggctcagtctcttattgacgtgaaagttaaggagatctccaaccaggaacctctgaaactctga

SEQ ID NO: 7088 - RNA, 1290 nt, synthetic construct
  misc_feature 1..1290: note = derived and/or modified CDS sequence (opt5) from HTNV__X95077.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgtgagcatccaggccaagattgacgaactgaaacgccaactcgccgatagaatcgctaccggaaagaacctgggcaaggagcaggaccctacaggggtggaaccgggagatcatcttaaagagcggtccatgctgtcttatggcaatgtcctcgacctgaaccacctggatattgacgagcccaccgggcagacagccgattggctcagcatcgtggtttacctgacctccttcgtggtccctacacttctgaaggctctctatatgctgaccacgcgcggaagacagaccacaaaagacaataagggcacccggatccgctttaaagatgactctagcttcgaagacgtgaacggcattagaaagcccaagcatctttacgtttccctgcctaatgcccaatctagcatgaaagcggaggaaatcacacccgggcggtatcgcaccgccgtgtgcggactctaccctgctcagattaaggccagacagatgatctccccggtcatgagcgtgattggctttctggctctggccaaagattggtctgaccggatcgagcagtggctctccgaaccctgtaagctgcttcctgatacgacagcggtgagcctgctcgggggacccgccaccaaccgcgactatctgagacaacggcaggtcgctcttggcaatatggagacaaaagagtctaaggccattagacagcacgctgaagccgccgggtgctccatgatcgaggatatcgaaagcccttcttccatttgggttttcgctggagcgcccgaccgctgtccgcctacctgcctgtttatcgccggcattgctgagctcggcgccttctttagcatcctgcaagatatgcggaacaccattatggcctccaaaacagtggggacgtctgaagagaagctgagaaagaaaagctccttctaccagagctacctccgccggacccagtctatgggaatccagctggaccaaagaatcattgtgctttttatggtcgcttggggcaaggaggccgtggataatttccatctgggggacgatatggaccccgaactccgcacactggcgcagtcccttatcgacgttaaagtgaaggagattagcaaccaggaacctctgaaactctga

SEQ ID NO: 7089 - RNA, 1290 nt, synthetic construct
  misc_feature 1..1290: note = derived and/or modified CDS sequence (opt5) from HTNV(CGAa1011)__EF990913.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaaccacctggatattgacgagcccaccgggcagacagctgattggctcagcatcgtcatctacctgacctccttcgtggttcctattcttctgaaggccctctatatgctgacaacccgcggaagacagacgaccaaagacaataagggcacacggatccgctttaaagatgactctagcttcgaagacgtgaacggcattagaaagcccaagcatcttgatgtctccctgcctaatgcgcaatctagcatgaaagccgaggaaatcacccccgggcggtaccgcacagctatttgcggactctatcctgcccagatcaaggctagacagatgatttccccggtgatgagcgttatcggctttctggccctggcgaaagactggtctgatcggatcgagcagtggctcggggaaccctgtaagctgcttcctgacaccgccgctgtgtccctgctcggaggccccgccacgaaccgcgattacctgagacaacggcaggtcgctcttgggaatatggagacaaaagagagcaaggccattagacagcacgccgaaaccgctggatgctctatgatcgaggacattgaatcccctagctctatctgggtgttcgcgggcgcccccgatcgctgtccgcctacatgcctgtttattgctggcatcgccgagctcggggccttcttttccgtgctgcaagacatgcggaacaccatcatggctagcaaaaccgtcggaacatccgaagagaagctgagaaagaaatctagcttctatcagtcctacctcggccgcacgcagagcatggggattcagctggatcaacggatcattgttctttttatggtggcctggggaaaggaggcggtggacaatttccatctgggcgatgacgtcgaccccgaactcagaaccctggctcagtctcttatcgatgtgaaagttaaggagatttccgaccaggaacctctgaaactctga

SEQ ID NO: 7090 - RNA, 1290 nt, synthetic construct
  misc_feature 1..1290: note = derived and/or modified CDS sequence (opt5) from HTNV(CGAa1015)__EF990912.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaaccacctggatattgacgagcccaccgggcagacagctgattggctcagcatcgtcatctacctgacctccttcgtggttcctattcttctgaaggccctctatatgctgacaacccgcggaagacagacgaccaaagacaataagggcacacggatccgctttaaagatgactctagcttcgaagacgtgaacggcattagaaagcccaagcatcttgatgtctccctgcctaatgcgcaatctagcatgaaagccgaggaaatcacccccgggcggtaccgcacagctatttgcggactctatcctgcccagatcaaggctagacagatgatttccccggtgatgagcgttatcggctacctggccctggcgaaagactggtctgatcggatcgagcagtggctcggggaaccctgtaagctgcttcctgacaccgccgctgtgtccctgctcggaggccccgccacgaaccgcgattatctgagacaacggcaggtcgctcttgggaatatggagacaaaagagagcaaggccattagacagcacgccgaaaccgctggatgctctatgatcgaggacattgaatcccctagctctatctgggtgtttgcgggcgcccccgatcgctgtccgcctacatgcctgttcattgctggcatcgccgagctcggggcctttatctccgtgctgcaagacatgcggaacaccattatggctagcaaaaccgtcggaacatccgaagagaagctgagaaagaaatctagcttctaccagtcctacctcggccgcacgcagagcatggggatccagctggatcaacggattatcgttctttttatggtggcctggggaaaggaggcggtggacaatttccatctgggcgatgacgtcgaccccgaactcagaaccctggctcagtctcttattgatgtgaaagttaaggagatctccgaccaggaacctctgaaactctga

SEQ ID NO: 7091 - RNA, 1290 nt, synthetic construct
  misc_feature 1..1290: note = derived and/or modified CDS sequence (opt5) from HTNV(CGAa2)__EU092219.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaaccacctggatattgacgagcccaccgggcagacagctgattggctcagcatcgtcatctacctgacctccttcgtggttcctattcttctgaaggccctctatatgctgacaacccgcggaagacagacgaccaaagacaataagggcacacggatccgctttaaagatgactctagcttcgaagacgtgaacggcattagaaagcccaagcatctttacgtctccctgcctaatgcgcaatctagcatgaaagccaaggagatcacccccgggcggtatcgcacagctatttgcggactctaccctgcccagatcaaagctagacagatgatttccccggtgatgagcgttatcggctttctggccctggcgaaggattggtctgaccggatcgaacagtggctctccgagccctgtaaactgcttcctgataccgccgctgtgagcctgcacgggggacccgccacgaaccgcgactatctcagacaacggcaggtcgctctgggcaatatggaacctaaggagtctaaagccattagacagcatgccgagtccgctgggtgcagcatggtggaagatatcgagtctccctccagcatttgggtgttcgcgggagccccggaccgctgtcctcccacatgcctttttatcgctggcattgccgaactgggcgccttcttttccatcctccaagatatgcggaacaccatcatggcttctaagacagtcgggaccagcgaggaaaagctgcgcaaaaagtccagcttctaccagtcttacctgagacggacccagtccatgggcattcagctcgaccaaagaatcattgttctgtttatggtggcctggggaaaagaggcggtggataatttccaccttggggacgatatggaccctgagctgcgcacactcgctcagagcctgatcgacgtcaaggtgaaagaaatttctaaccaggagccccttaagctgtga

SEQ ID NO: 7092 - RNA, 1290 nt, synthetic construct
  misc_feature 1..1290: note = derived and/or modified CDS sequence (opt5) from HTNV(CGAa31MP7)__EF990911.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaaccacctggatattgacgagcccaccgggcagacagctgattggctcagcatcgtcatctacctgacctccttcgtggttcctattcttctgaaggccctctatatgctgacaacccgcggaagacagacgaccaaagacaataagggcacacggatccgctttaaagatgactctagcttcgaagacgtgaacggcattagaaagcccaagcatctttacgtctccctgcctaatgcgcaatctagcatgaaagccgaggaaatcacccccgggcggtatcgcacagctatttgcggactctaccctgcccagatcaaggctagacagatgatttccccggtgatgagcgttatcggctttctggccctggcgaaagattggtctgaccggatcgagcagtggctctccgaaccctgtaagctgcttcctgataccgccgctgtgagcctgcacgggggacccgccacgaaccgcgactatctcagacaacggcaggtcgctctgggcaatatggagacaaaagagtctaaggccattagacagcatgccgaatccgctgggtgcagcatggtggaggatatcgaatctccttccagcatttgggtgttcgcgggagcccccgaccgctgtccgcctacctgcctttttatcgctggcattgccgagctgggcgccttcttttccatcctccaagatatgcggaacacaatcatggcttctaaaaccgtcgggaccagcgaagagaagctgagaaagaaatccagcttctaccagtcttacctgcgccggacacagtccatgggcattcagctcgaccaaagaatcattgttctgtttatggtggcctggggaaaggaggcggtggataatttccaccttggggacgatatggaccccgaactgcgcacgctcgctcagagcctgatcgacgtcaaagtgaaggagatttctaaccaggaacctcttaaactgtga

SEQ ID NO: 7093 - RNA, 1290 nt, synthetic construct
  misc_feature 1..1290: note = derived and/or modified CDS sequence (opt5) from HTNV(CGAa31P9)__EF990910.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaaccacctggatattgacgagcccaccgggcagacagctgattggctcagcatcgtcatctacctgacctccttcgtggttcctattcttctgaaggccctctatatgctgacaacccgcggaagacagacgaccaaagacaataagggcacacggatccgctttaaagatgactctagcttcgaagacgtgaacggcattagaaagcccaagcatctttacgtctccctgcctaatgcgcaatctagcatgaaagccgaggaaatcacccccgggcggtatcgcacagctatttgcggactctaccctgcccagatcaaggctagacagatgatttccccggtgatgagcgttatcggctttctggccctggcgaaagattggtctgaccggatcgagcagtggctctccgaaccctgtaagctgcttcctgataccgccgctgtgagcctgcacgggggacccgccacgaaccgcgactatctcagacaacggcaggtcgctctgggcaatatggagacaaaagagtctaaggccattagacagcatgccgaatccgctgggtgcagcatggtggaggatatcgaatctccttccagcatttgggtgttcgcgggagcccccgaccgctgtccgcctacctgcctttttatcgctgagattgccgaactgggcgccttcttttccatcctccaagatatgcggaacacaatcatggcttctaaaaccgtcggcaccagcgaggagaagctgagaaagaaatccagcttctaccagtcttacctgcgccggacacagtccatggggattcagctcgaccaaagaatcattgttctgtttatggtggcctggggaaaggaagcggtggataatttccaccttggcgacgatatggaccccgagctgcgcacgctcgctcagagcctgatcgacgtcaaagtgaaggaaatttctaaccaggagcctcttaaactgtga

SEQ ID NO: 7094 - RNA, 1290 nt, synthetic construct
  misc_feature 1..1290: note = derived and/or modified CDS sequence (opt5) from HTNV(CGAa4MP9)__EF990915.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaaccacctggatattgacgagcccaccgggcagacagctgattggctcagcatcgtcatctacctgacctccttcgtggttcctattcttctgaaggccctctatatgctgacaacccgcggaagacagacgaccaaagacaataagggcacacggatccgctttaaagatgactctagcttcgaagacgtgaacggcattagaaagcccaagcatctttacgtctccctgcctaatgcgcaatctagcatgaaagccgaggaaatcacccccgggcggtatcgcacagctatttgcggactctaccctgcccagatcaaggctagacagatgatttccccggtgatgagcgttatcggctttctggccctggcgaaagattggtctgaccggatcgagcagtggctcggggaaccctgtaagctgcttcctgataccgccgctgtgtccctgctcggaggccccgccacgaaccgcgactatctgagacaacggcaggtcgctcttgggaatatggagacaaaagagagcaaggccattagacagcacgccgaaaccgctggatgctctatgatcgaggatattgaatcccctagctctatctgggtgttcgcgggcgcccccgaccgctgtccgcctacatgcctgtttattgctggcatcgccgagctcggggccttcttttccgtgctgcaagatatgcggaacaccatcatggctagcaaaaccgtcggaacatccgaagagaagctgagaaagaaatctagcttctaccagtcctacctccgccggacgcagagcatgggcattcagctggaccaaagaatcattgttctttttatggtggcctgggggaaggaggcggtggataatttccatctgggagacgatatggaccccgaactccgcaccctggctcagtctcttatcgacgtcaaagtgaaggagatttccaaccaggaacctctgaaactctga

SEQ ID NO: 7095 - RNA, 1290 nt, synthetic construct
  misc_feature 1..1290: note = derived and/or modified CDS sequence (opt5) from HTNV(CGAa75)__EU092220.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaaccacctggatattgacgagcccaccgggcagacagctgattggctcagcatcgtcatctacctgacctcctctgtggttcctattcttctgaaggccctctatatgctgacaacccgcggaagacagacgaccaaagacaataagggcacacggatccgcttcaaagatgacagctcctttgaagacgtgaacggcattagaaagcccaagcatctttacgtctctctgcctaatgcgcaaagctccatgaaagccgaggaaatcacccccgggcggtatcgcacagctatttgcggactctaccctgcccagatcaaggctagacagatgattagcccggtgatgaacgttatcggcttcctggccctggcgaaagattggtctgaccggatcgagcagtggctctccgaaccctgtaagctgcttcctgataccgccgctgtgagcctgcacgggggacccgccacgaatcgcgactatctcagacaacggcaggtcgctctgggcaacatggagacaaaagagtctaaggccattagacagcatgccgaatccgctgggtgcagcatggtggaggatatcgaatctccttccagcatttgggtgtttgcgggagcccccgaccgctgtccgcctacctgccttttcatcgctggcattgccgagctgggcgcctttttctccatcctccaagatatgcggaatacaatcatggcttctaaaaccgtcgggaccagcgaagagaagctgagaaagaaatccagcttttaccagtcttacctgcgccggacacagtccatgggcattcagctcgaccaaagaatcattgttctgttcatggtggcctggggaaaggaggcggtggataactttcaccttggggacgatatggaccccgaactgcgcacgctcgctcagagcctgatcgacgtcaaagtgaaggagatttctaatcaggaacctcttaaactgtga

SEQ ID NO: 7096 - RNA, 1290 nt, synthetic construct
  misc_feature 1..1290: note = derived and/or modified CDS sequence (opt5) from HTNV(CGHu1)__EU092218.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatagcgacgagctgaataaaagaacacttacggatcgggagggggttgctgtgtccatccaggccaagattgacgaactgaaacgccaactcgccgatagaatcgctaccggaaagaacctgggcaaggagcaggaccccacaggggtggaacctggagatcatcttaaagagcggtctatgctgagctatggcaatgtcctcgacctgaaccacctggatattgacgagccgaccgggcagacagccgattggctctccatcgtggtttacctgacctctcttgtggtccccatcctgctcaaggctctgtatatgcttacaaccaaaggacgccagacgaccaaggacaataaaggcacacggattagattcaaggatgacagctcctttgaagacgtgaacggcatccgcaagcctaaacatctgtacgtttctctcctgaatgcccaaagctccatgaaggcggaggaaattacccccgggagatatcggacagccatctgcggaccttaccccgctcagattaaagcccgccagatgatcagccctgtgatgtctgtcattggcttcctggctctcgccaaggattggtccgacagaatcgagcagtggctgagcgaaccgtgtaaacttctgcccgataccgcggccgtgtctctcctgggaggacctgctacgaaccgggactatcttcgccaaagacaggtggccctgggcaatatggagacaaaggagtccaaagctatccggcagcacgccgaagccgctgggtgcagcatgattgaggatatcgaatctccctccagcatttgggtctccgcgggagcccctgacagatgtcccccgacctgcctctttatcgctggcattgccgagctgggcgccttcttttctatcctgcaagatatgcgcaacacaatcatggctagcaagaccgttgggacctccgaagagaagctccggaaaaagagctctttctaccagtcctacctgagacgcacacagagcatggggattcagcttgaccaacggatcattgtgctgtttatggtggcctggggcaaagaggcggtcgataatttccatctcggggacgatatggaccctgaactgagaacgcttgctcagtctctgatcgacgtgaaggttaaagagattagcaaccaggaacccctcaagctgtga

SEQ ID NO: 7097 - RNA, 1290 nt, synthetic construct
  misc_feature 1..1290: note = derived and/or modified CDS sequence (opt5) from HTNV(CGHu2)__EU363813.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaaccacctggatattgacgagcccaccgggcagacagctgattggctcagcatcgtcatctacctgacctcccttgtggttcctattctgctcaaggccctgtatatgcttacaacccgcggaagacagacgaccaaagacaataagggcacacggatccgcttcaaagatgactctagctttgaagacgtgaacggcattagaaagcccaagcatctgtacgtctccctccctaatgcgcaatctagcatgaaagccgaggaaatcacccccgggcggtatcgcacagctatttgcggactgtaccctgcccagatcaaggctagacagatgatttccccggtgatgagcgttatcggcttcctggccctcgcgaaagattggtctgaccggatcgagcagtggctgtccgaaccctgtaaacttctgcctgataccgccgctgtgagcctccacgggggacccgccacgaaccgcgactatctgagacaacggcaggtcgctcttggcaatatggagacaaaggagtctaaggccattagacagcatgccgaatccgctgggtgcagcatggtggaggatatcgaatctccttccagcatttgggtgtttgcgggagcccccgaccgctgtccgcctacctgcctgttcatcgctggcattgccgagctcggcgcctttttctccatctctcaagatatgcggaacacaatcatggctagcaaaaccgtcgggacctccgaagagaagctgagaaagaaaagctctttttaccagtcctacctgcgccggacacagagcatgggcattcagctcgaccaaagaatcattgttctgttcatggtggcctggggaaaggaggcggtggataattttcaccttggggacgatatggaccccgaactgcgcacgctcgctcagtctctgatcgacgtcaaagtgaaggagattagcaaccaggaacctcttaaactgtga

SEQ ID NO: 7098 - RNA, 1290 nt, synthetic construct
  misc_feature 1..1290: note = derived and/or modified CDS sequence (opt5) from HTNV(CGHu3612)__EF990909.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggaggggctggccgccagcatccaggctaagattgacgaactcaaacgccaactggccgatagagttgctacgggaaagaaccttggcaaggagcaggaccctaccggggtggaaccgggagatcatctgaaagagcggtccatgctctcttatggcaatgtgctggacctgaaccacctcgatatcgacgagcccacagggcagaccgccgattggctgagcattgtcatctaccttacatccttcgtggttcctatcctgctcaaggcgctgtatatgcttaccacacgcggaagacagaccacgaaagacaataagggcacccggattcgctttaaagatgactctagcttcgaagacgtgaacggcatcagaaagcccaagcatctgtacgtctccctccctaatgcccaatctagcatgaaagctgaggaaattacacccgggcggtatcgcaccgccatctgcggactgtaccctgctcagattaaggccagacagatgatctccccggtgatgagcgttattggctttctggcgctcgccaaagattggtctgaccggatcgagcagtggctgtccgaaccctgtaaacttctgcctgatacagctgccgtgagcctccacgggggacccgctaccaaccgcgactatctgagacaacggcaggtcgcccttggcaatatggagacgaaggagtctaaggccatcagacagcatgctgaatccgcggggtgcagcatggtggaggatattgaatctccttccagcatctgggtgttcgccggagctcccgaccgctgtccgcctacatgcctgtttattgccggcatcgccgagctcggcgctttcttttccattctgcaagatatgcggaacaccatcatggcctctaaaacagtcgggaccagcgaagagaagctgagaaagaaatccagcttctaccagtcttacctccgccggacccagtccatgggaatccagctggaccaaagaattatcgttctttttatggtggcgtggggcaaggaggctgtggataatttccacctgggggacgatatggaccccgaactccgcacactggcccagagccttattgacgtcaaagtgcgggagatctctaaccaggaacctctgaagctctga

SEQ ID NO: 7099 - RNA, 1290 nt, synthetic construct
  misc_feature 1..1290: note = derived and/or modified CDS sequence (opt5) from HTNV(CGRn15)__EU363810.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaaccacctggatattgacgagcccaccgggcagacagctgattggctcagcatcgtcatctacctgacctccttcgtggttcctattcttctgaaggccctctatatgctgacaacccgcggaagacagacgaccaaagacaataagggcacacggatccgctttaaagatgactctagcttcgaagacgtgaacggcattagaaagcccaagcatctttacgtcaccctgcctaatgcgcaatcctctatgaaagccgaggaaatcacacccgggcggtatcgcaccgctatttgcggactctaccctgcccagatcaaggctagacagatgattagcccggtgatgtccgttatcggctttctggccctggcgaaagattggagcgaccggatcgagcagtggctctctgaaccctgtaagctgcttcctgatacggccgctgtgtccctgcacgggggacccgccacaaaccgcgactatctcagacaacggcaggtcgctctgggcaatatggagaccaaagagagcaaggccattagacagcatgccgaatctgctgggtgctccatggtggaggatatcgaaagcccttcttccatttgggtgttcgcgggagcccccgaccgctgtccgcctacatgcctttttatcgctggcattgccgagctgggcgccttctttagcatcctccaagatatgcggaacaccatcatggcttccaaaaccgtcgggacatctgaagagaagctgagaaagaaaagctccttctaccagagctacctgcgccggacgcagtctatgggcattcagctcgaccaaagaatcattgttctgtttatggtggcctggggaaaggaggcggtggataatttccaccttggggacgatatggaccccgaactgcgcaccctcgctcagtccctgatcgacgtcaaagtgaaggagattagcaaccaggaacctcttaaactgtga

SEQ ID NO: 7100 - RNA, 1290 nt, synthetic construct
  misc_feature 1..1290: note = derived and/or modified CDS sequence (opt5) from HTNV(CGRn2616)__EU363811.1__N
  source 1..1290: mol_type = other RNA
atggccaccatggaggaactgcagagagagatcaacgctcacgaaggccaactcgtgattgcccggcagaaggtccgcgacgcggggaaacagtacgagaaggatcccgacgaactgaataaaagaacacttacggatcgggagggagttgctgccagcatccaggccaagattgacgagctgaaacgccaactcgctgatagaatcgccaccggcaagaacctggggaaggaacaggaccctacaggagtggagccgggcgatcatcttaaagaacggtccatgctgtcttatgggaatgtgctcgacctgaaccacctggatattgacgagcccaccggacagacagctgattggctcagcatcgtcatctacctgacctccttcgtggttcctattcttctgaaggccctctatatgctgacaacccgcggcagacagacgaccaaagacaataagggcacacggatccgctttaaagatgactctagcttcgaggacgtgaacgggattagaaagcccaagcatctttacgtctccctgcctaatgcgcaatctagcatgaaagccgaagagatcacccccggacggtatcgcacagctatttgcggcctctaccctgcccagatcaaggctagacagatgatttccccggtgatgagcgttatcgggtttctggccctggcgaaagattggtctgaccggatcgaacagtggctctccgagccctgtaagctgcttcctgataccgccgctgtgagcctgcacggaggccccgccacgaaccgcgactatctcagacaacggcaggtcgctctggggaatatggaaacaaaagagtctaaggccattagacagcatgccgagtccgctggatgcagcatggtggaagatatcggctctccttccagcatttgggtgttcgcgggcgcccccgaccgctgtccgcctacctgcctttttatcgctgggattgccgagctgggagccttcttttccatcctccaagatatgcggaacacaatcatggcttctaaaaccgtcggcaccagcgaagagaagctgagaaagaaatccagcttctaccagtcttacctgcgccggacacagtccatggggattcagctcgaccaaagaatcattgttctgtttatggtggcctggggaaaggaagcggtggataatttccaccttggcgacgatatggaccccgagctgcgcacgctcgctcagagcctgatcgacgtcgaggtgaaagaaatttctaaccaggagcctcttaagctgtga

SEQ ID NO: 7101 - RNA, 1290 nt, synthetic construct
  misc_feature 1..1290: note = derived and/or modified CDS sequence (opt5) from HTNV(CGRn53)__EF990907.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatccaggctaagattgacgaactgaaacgccaactcgccgatagaatcgctacgggaaagaacctgggcaaggagcaggaccctaccggggtggaaccgggagatcatcttaaagagcggtccatgctgtcttatggcaatgtgctcgacctgaaccacctggatattgacgagcccacagggcagaccgccgattggctcagcatcgtcatctacctgacatccttcgtggttcctattcttctgaaggcgctctatatgctgaccacacgcggaagacagaccacgaaagacaataagggcacccggatccgctttaaagatgactctagcttcgaagacgtgaacggcattagaaagcccaagcatctttacgtctccctgcctaatgcccaatctagcatgaaagctgaggaaatcacacccgggcggtatcgcaccgccatttgcggactctaccctgctcagatcaaggccagacagatgatttccccggtgatgagcgttatcggctttctggcgctggccaaagattggtctgaccggatcgagcagtggctctccgaaccctgtaagctgcttcctgatacagctgccgtgagcctgcacgggggacccgctaccaaccgcgactatctcagacaacggcaggtcgccctgggcaatatggagacgaaagagtctaaggccattagacagcatgctgaagcggccgggtgctccatgatcgaggatattgaaagcccttcttccatctgggtgttcgctggagcccccgaccgctgtccgcctacatgcctttttattgccggcatcgctgagctgggcgccttctttagcatcctccaagatatgcggaacaccattatggcgtccaaaacagtggggacctctgaagagaagctgagaaagaaaagctccttctaccagagctacctgcgccggacccagtctatgggaatccagctcgaccaaagaattatcgtcctgtttatggttgcttggggcaaggaggccgtggataatttccaccttggggacgatatggaccccgaactgcgcacactcgcccagtccctgattgacgtgaaagtcaaggagatcagcaaccaggaacctcttaaactgtga

SEQ ID NO: 7102 - RNA, 1290 nt, synthetic construct
  misc_feature 1..1290: note = derived and/or modified CDS sequence (opt5) from HTNV(CGRn5310)__EF990906.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagcctaataaaagagctctgacagatcgggagggggttgccgccagcatccaggctaagattgacgaacttaaacgccaactggccgatagaatcgctacgggaaagaacctcggcaaggagcaggacccgaccggggtggaacccggagatcatctgaaagagcggtccatgctttcttatggcaatgtgctggacctcaaccacctggatattgacgagcctacagggcagaccgccgattggctgagcatcgtcatctacctcacatccttcgtggttcccattctgcttaaggcgctgtatatgctcaccacacgcggaagacagaccacgaaagacaataagggcacccggatccgctttaaagatgactctagcttcgaagacgtgaacggcattagaaagcctaagcatctgtacgtctcccttcccaatgcccaatctagcatgaaagctgaggaaatcacacctgggcggtatcgcaccgccatttgcggactgtacccggctcagatcaaggccagacagatgatttcccccgtgatgagcgttatcggctttctcgcgctggccaaagattggtctgaccggatcgagcagtggctgtccgaaccttgtaagctcctgcccgatacagctgccgtgagccttcacgggggacctgctaccaaccgcgactatctgagacaacggcaggtcgccctcggcaatatggagacgaaagagtctaaggccattagacagcatgctgaagcggccgggtgctccatgatcgaggatattgaaagcccctcttccatctgggtgttcgctggagccccggaccgctgtcctcccacatgcctgtttattgccggcatcgctgagcttggcgccttctttagcatcctgcaagatatgcggaacaccattatggcgtccaaaacagtggggacctctgaagagaagctcagaaagaaaagctccttctaccagagctacctgcgccggacccagtctatgggaatccagctggaccaaagaattatcgtcctctttatggttgcttggggcaaggaggccgtggataatttccacctgggggacgatatggaccctgaacttcgcacactggcccagtccctcattgacgtgaaagtcaaggagatcagcaaccaggaacccctgaaactttga

SEQ ID NO: 7103 - RNA, 1290 nt, synthetic construct
  misc_feature 1..1290: note = derived and/or modified CDS sequence (opt5) from HTNV(CGRn93MP8)__EF990905.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgcccctatccaggctaagattgacgaactgaaacgccaactcgccgatagaatcgctacgggaaagaacctgggcaaggagcaggacccgaccggggtggaacccggagatcatcttaaagagcggagcatgctgtcctatggcaatgtgctcgacctgaaccacctggatattgacgagcctacagggcagaccgccgattggctctctatcgtcatctacctgaccagcttcgtggttcccattcttctgaaggcgctctatatgctgacaacacgcggaagacagaccacgaaagacaataagggctcccggatccgctttaaagatgactctagcttcgaagacgtgaacggcattagaaagcctaagcatctttacgtctccctgcccaatgcccaatctagcatgaaagctgaggaaatcacccctgggcggtatcgcacagccatttgcggactctacccggctcagatcaaggccagacagatgatttcccccgtgatgagcgttatcggctttctggcgctggccaaagattggtctgaccggatcgagcagtggctctccgaaccttgtaagctgcttcccgataccgctgccgtgagcctgcacgggggacctgctacaaaccgcgactatctcagacaacggcaggtcgccctgggcaatatggagaccaaagagtctaaggccattagacagcatgctgaagcggccgggtgctccatgatcgaggatattgaaagcccctcttccatctgggtgttcgctggagccccggaccgctgtcctcccacgtgcctttttattgccggcatcgctgagctgggcgccttctttagcatcctccaagatatgcggaacacaattatggcgtccaaaaccgtggggacatctgaagagaagctgagaaagaaaagctccttctaccagagctacctgcgccggacccagtctatgggaatccagctcgaccaaagaattatcgtcctgtttatggttgcttggggcaaggaggccgtggataatttccaccttggggacgatatggaccctgaactgcgcaccctcgcccagtccctgattgacgtgaaagtcaaggagatcagcaaccaggaaccccttaaactgtga

SEQ ID NO: 7104 - RNA, 1290 nt, synthetic construct
  misc_feature 1..1290: note = derived and/or modified CDS sequence (opt5) from HTNV(CGRn93P8)__EF990904.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatccaggctaagattgacgaactgaaacgccaactcgccgatagaatcgctacgggaaagaacctgggcaaggagcaggaccctaccggggtggaaccgggagatcatcttaaagagcggtccatgctgtcttatggcaatgtgctcgacctgaaccacctggatattgacgagcccacagggcagaccgccgattggctcagcatcgtcatctacctgacatccttcgtggttcctattcttctgaaggcgctctatatgctgaccacacgcggaagacagaccacgaaagacaataagggcacccggatccgctttaaagatgactctagcttcgaagacgtgaacggcattagaaagcccaagcatctttacgtctccctgcctaatgcccaatctagcatgaaagctgaggaaatcacacccgggcggtatcgcaccgccatttgcggactctaccctgctcagatcaaggccagacagatgatttccccggtgatgagcgttatcggctttctggcgctggccaaagattggtctgaccggatcgagcagtggctctccgaaccctgtaagctgcttcctgatacagctgccgtgagcctgcacgggggacccgctaccaaccgcgactatctcagacaacggcaggtcgccctgggcaatatggagacgaaagagtctaaggccattagacagcatgctgaagcggccgggtgctccatgatcgaggatattgaaagcccttcttccatctgggtgttcgctggagcccccgaccgctgtccgcctacatgcctttttattgccggcatcgctgagctgggcgccttcatcagcattctccaagatatgcggaacaccatcatggcgtccaaaacagtggggacctctgaagagaagctgagaaataagagctccttttaccagagctacctgcgccggacccagtctatgggcattcagctcgaccaaagaatcattgtcctgttcatggttgcttggggaaaagaggccgtggataactttcaccttggggacgatatggaccccgaactgcgcacactcgcccagtccctgatcgacgtgaaggtcaaagagatcagcaatcaggaacctcttaagctgtga

SEQ ID NO: 7105 - RNA, 1290 nt, synthetic construct
  misc_feature 1..1290: note = derived and/or modified CDS sequence (opt5) from HTNV(CGRni1)__EU363812.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggccgggagcaggaccctacaggggtggaaccgggagatcatcttaaggagcgctccatgctgtcttatggcaatgtgctcgacctgaaccacctggatattgacgagcccaccgggcagacagctgattggctcagcatcgtcatctacctgacctccttcgtggttcctattcttctgaaagccctctatatgctgacaaccagaggacggcagacgaccaaggacaataaaggcacacgcatcagatttaaggatgactctagcttcgaagacattaacggcatccggaaacccaagcatctttacgtgtccctgcctaatgcgcaatctagcatgaaggccgaggaaattacccccgggcgctatagaacagctatctgcggactctaccctgcccagattaaagctcggcagatgatctccccggtcatgagcgtgatcggctttctggccctggcgaaggattggtctgaccgcattgagcagtggctctccgaaccctgtaaactgcttcctgataccgccgctgttagcctgcacgggggacccgccacgaacagagactatctccggcaaagacaggtggctctgggcaatatggagacaaaggagtctaaagccatccgccagcatgccgaatccgctgggtgcagcatggtcgaggatattgaatctccttccagcatctgggtgttcgcgggagcccccgaccggtgtccgcctacctgcctttttattgctggcatcgccgagctgggcgccttcttttccatcctccaagatatgagaaacacaattatggcttctaagaccgtggggaccagcgaagagaaactgcgcaagaagtccagcttctaccagtcttacctgcggagaacacagtccatgggaatccagctcgaccaacgcattatcgtcctgcttatggttgcctggggcaaagaggcggtggataattttcacctgggggacgatatggaccccgaactccggacgctggctcagagccttattgacgtgaaggtcaaagagatctctaaccaggaacctctgaagctctga

SEQ ID NO: 7106 - RNA, 1290 nt, synthetic construct
  misc_feature 1..1290: note = derived and/or modified CDS sequence (opt5) from HTNV(CJAp93)__EF208929.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgtgagcatccaggccaagattgacgaactgaaacgccaactcgccgatagaatcgctaccggaaagaacctgggcaaggagcaggaccctacaggggtggaaccgggagatcatcttaaagagcggtccatgctgtcttatggcaatgtcctcgacctgaaccacctggatattgacgagcccaccgggcagacagccgattggctcagcatcgtggtttacctgacctccttcgtggtccctatccttctgaaggctctctatatgctgacaacccgcggaagacagacgaccaaagacaataagggcacacggattcgctttaaagatgactctagcttcgaagacgtgaacggcatcagaaagcccaagcatctttacgtttccctgcctaatgcccaatctagcatgaaagcggaggaaattacccccgggcggtatcgcacagccatctgcggactctaccctgctcagattaaggccagacagatgatctccccggtgatgagcgtcattggctttctggctctggccaaagattggtctgaccggatcgagcagtggctctccgaaccctgtaagctgcttcctgataccgcggccgtggggctgctcggaggccccgctacgaaccgcgactatctgagacaaagacaggtggcccttgggaatatggagacaaaagagagcaaggctatccggcagcacgccgaagccgctggatgctctatgattgaggatatcgaatcccctagctctatttgggtcttcgcgggcgcccccgaccgctgtccgcctacctgcctgtttatcgctggcattgccgagctcggggccttcttttccatcctgcaagatatgcggaacacaatcatggctagcaaaaccgttggaacctccgaagagaagctgagaaagaaatctagcttctaccagtcctacctccgccggacacagagcatgggcattcagctggaccaaagaatcattgtgctttttatggtggcctgggggaaggaggcggtcaataacttccatctgggagatgacatggatcccgaactccgcacgctggctcagtctcttatcgacgtgaaagttaaggagatttccaatcaggaacctctgaaactctga

SEQ ID NO: 7107 - RNA, 1290 nt, synthetic construct
  misc_feature 1..1290: note = derived and/or modified CDS sequence (opt5) from HTNV(Aa14_207)__KX687234.1__N
  source 1..1290: mol_type = other RNA
atggccaccatggaggaactgcagagagagatcaacgctcacgaaggccaactcgtgattgcccggcagaaggtccgcgacgcggagaaacagtacgggaaggatcccgacgaactgaataaaagagctcttacagatcgggagggagttgccgtgagcatccaggccaagattgacgagctgaaacgccaactcgctgatagaatcgccacgggcaagaacctggggaaggaacaggaccctaccggagtggagccgggcgatcatcttaaagaacggtccatgctgtcttatgggaatgtcctcgacctgaaccacctggatattgacgagcccacaggacagaccgctgattggctcagcatcgtggtttacctgacatccttcgtggtccctatccttctgaaggccctctatatgctgaccacacgcggcagacagaccacgaaagacaataagggcacccggattcgctttaaagatgactctagcttcgaggacgtgaacgggatcagaaagcccaagcatctttacgtttccctgcctaatgcgcaatctagcatgaaagccgaagagattacacccggacggtatcgcaccgctgtgtgcggcctctaccctgcccagatcaaggctagacagatgatttccccggtcatgagcgtgatcgggtttctggccctggcgaaagattggtctgaccggattgaacagtggctctccgagccctgtaagctgcttcctgatacagccgctgtgagcctgctcggaggccccgccaccaaccgcgactatctgagacaacggcaggtcgctcttgggaatatggaaacgaaagagtctaaggccatcagacagcacgccgaggctgcgggatgctccatgatcgaagatattgagagcccttcttccatctgggttttcgccggcgctcccgaccgctgtccgcctacatgcctgtttgtggccggcattgccgaactcggggctttctttagcatcctgcaagatatgcggaacaccattatggcctccaaaacagtgggaacctctgaggaaaagctgagaaagaaaagctccttctaccagagctacctccgccggacccagtctatgggcatccagctggaccaaagaatcattgtcctttttatggtggcgtgggggaaggaggctgttgataatttccatctgggagacgatatggaccccgagctccgcacactggcccagtcccttatcgacgtgaaagtcaaggaaattagcaaccaggagcctctgaaactctga

SEQ ID NO: 7108 - RNA, 1290 nt, synthetic construct
  misc_feature 1..1290: note = derived and/or modified CDS sequence (opt5) from HTNV(Aa14_234)__KX687235.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgtgagcatccaggccaagattgacgaactgaaacgccaactcgctgatagaatcgccacgggaaagaacctgggcaaggagcaggaccctaccggggtggaaccgggagatcatcttaaagagcggtccatgctgtcttatggcaatgtcctcgacctgaaccacctggatattgacgagcccacagggcagaccgctgattggctcagcatcgtggtttacctgacatccttcgtggtccctatccttctgaaggccctctatatgctgaccacacgcggaagacagaccacgaaagacaataagggcacccggattcgctttaaagatgactctagcttcgaagacgtgaacggcatcagaaagcccaagcatctttacgtttccctgcctaatgcgcaatctagcatgaaagccgaggaaattacacccgggcggtatcgcaccgctgtgtgcggactctaccctgcccagatcaaggctagacagatgatttccccggtcatgagcgtgatcggctttctggccctggcgaaagattggtctgaccggattgagcagtggctcggggaaccctgtaagctgcttcctgatacagccgctgtgtccctgctcggaggccccgccaccaaccgcgactatctgagacaacggcaggtcgctcttgggaatatggagacgaaagagagcaaggccatcagacagcacgccgaagctgcgggatgctctatgatcgaggatattgaatcccctagctctatctgggttttcgccggcgctcccgaccgctgtccgcctacatgcctgtttattgccggcatcgccgagctcggggctttcttttccattctgcaagatatgcggaacaccatcatggccagcaaaacagtgggaacctccgaagagaagctgagaaagaaatctagcttctaccagtcctacctccgccggacccagagcatgggcatccagctggaccaaagaattatcgtgctttttatggtcgcgtgggggaaggaggctgtggataatttccatctgggagacgatatggaccccgaactccgcacactggcccagtctcttattgacgttaaagtgaaggagatctccaaccaggaacctctgaaactctga

SEQ ID NO: 7109 - RNA, 1290 nt, synthetic construct
  misc_feature 1..1290: note = derived and/or modified CDS sequence (opt5) from HTNV(Aa14_239)__KX687236.1__N
  source 1..1290: mol_type = other RNA
atggccaccatggaggaactgcagagagagatcaacgctcacgaaggccaactcgtgattgcccggcagaaggtccgcgacgcggagaaacaggatgggaaggaccccgatgaactgaataaaagagctcttacagaccgggagggagttgccgtgagcatccaggccaagattgatgagctgaaacgccaactcgctgacagaatcgccacgggcaagaacctggggaaggaacaggatcctaccggagtggagccgggcgaccatcttaaagaacggtccatgctgtcttacgggaatgtcctcgatctgaaccacctggacattgatgagcccacaggacagaccgctgactggctcagcatcgtggtttatctgacatccttcgtggtccctatccttctgaaggccctctacatgctgaccacacgcggcagacagaccacgaaagataataagggcacccggattcgctttaaagacgactctagcttcgaggatgtgaacgggatcagaaagcccaagcatctttatgtttccctgcctaatgcgcaatctagcatgaaagccgaagagattacacccggacggtaccgcaccgctgtgtgcggcctctatcctgcccagatcaaggctagacagatgatttccccggtcatgagcgtgatcgggtttctggccctggcgaaagactggtctgatcggattgaacagtggctcggagagccctgtaagctgcttcctgacacagccgctgtgtccctgctcggcgggcccgccaccaaccgcgattacctgagacaacggcaggtcgctcttggaaatatggaaacgaaagagagcaaggccatcagacagcacgccgaggctgcgggctgctctatgatcgaagacattgagtcccctagctctatctgggttttcgccggcgctcccgatcgctgtccgcctacatgcctgtttattgccgggatcgccgaactcggagctttcttttccattctgcaagacatgcggaacaccatcatggccagcaaaacagtgggcacctccgaggaaaagctgagaaagaaatctagcttctatcagtcctacctccgccggacccagagcatggggatccagctggatcaaagaattatcgtgctttttatggtcgcgtggggaaaggaggctgtggacaatttccatctgggcgatgacatggaccccgagctccgcacactggcccagtctcttattgatgttaaagtgaaggaaatctccaaccaggagcctctgaaactctga

SEQ ID NO: 7110 - RNA, 1290 nt, synthetic construct
  misc_feature 1..1290: note = derived and/or modified CDS sequence (opt5) from HTNV(AY133/2011)__KY807166.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatccaggctaagattgacgaactgaaacgccaactcgccgatagaatcgctacgggaaagaacattggcaaggagcaggaccctaccggggtggaaccgggagatcatctgaaagagcggtccatgctttcttatggcaatgtgctggacctcaaccacctggatatcgacgagcccacagggcagaccgccgattggctgagcatcgtcatttacctcacatccttcgtggttcctatcctgcttaaggcgctgtatatgctcaccacacgcggaagacagaccacgaaagacaataagggcacccggattcgctttaaagatgactctagcttcgaagacgtgtccggcatcagaaagcccaagcatctgtacctttctctgcctaacgcccaaagctccatgaaagctgaggaaattacacccgggcggtatcgcaccgccatctgcggactctaccctgctcagattaaggccagacagatgatcagcccggtcatgtctgtgatcggctttctggcgctggccaaagattggtccgaccggattgagcagtggctcagcgaaccctgtaagctgcttcctgatacagctgccgtttctctgcacgggggacccgctaccaatcgcgactatctcagacaaagacaggtggccctgggcaacatggagacgaaagagtccaaggccatccggcagcatgctgaaacagcggggtgcagcatgattgatgacatcgagtctccttccagcatttgggtcttcgccggagctcccgatcgctgtccgcctacctgcctttttatcgccggcatcgccgaactgggcgctttcttttccattctccaagacatgcggaatacaatcatggcctctaaaaccgtggggaccagcgaggaaaagctgagaaagaaatccagcttctaccagtcttacctgcgccggacacagtccatgggcattcagctcgatcaaagaatcattgtgctgtttatggtcgcgtggggaaaggaggctgttgacaacttccaccttggggatgacatggaccccgagctgcgcacgctcgcccagagcctgatcgatgtgaaagtgaaggaaatctctaatcaggagcctcttaaactgtga

SEQ ID NO: 7111 - RNA, 1290 nt, synthetic construct
  misc_feature 1..1290: note = derived and/or modified CDS sequence (opt5) from HTNV(GAN13/2011)__KY807168.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatccaggctaagattgacgaactgaaacgccaactcgccgatagaatcgctacgggaaagaacctgggcaaggagcaggaccctaccggggtggaaccgggagatcatcttaaagagcggtccatgctgtcttatggcaatgtgctcgacctgaaccacctggatattgacgagcccacagggcagaccgccgattggctcagcatcgtcatctacctgacatccttcgtggttcctattcttctgaaggcgctctatatgctgaccacacgcggaagacagaccacgaaagacaataagggcacccggatccgctttaaagatgactctagcttcgaagacgtgaacggcattagaaagcccaagcatctttacctgtccctccctaatgcccaatctagcatgaaagctgaggaaatcacacccgggcggtatcgcaccgccatttgcggactgtaccctgctcagatcaaggccagacagatgatttccccggtcatgagcgtgatcggctttctggcgctcgccaaagattggtctgaccggatcgagcagtggctgtccgaaccctgtaaacttctgcctgatacagctgccgttagcctccacgggggacccgctaccaaccgcgactatctgagacaaagacaggtggcccttggcaatatggagacgaaggagtctaaggccattcggcagcatgctgaaacagcggggtgctccatgatcgatgacattgagagcccttcttccatctgggtcttcgccggagctcccgatcgctgtccgcctacctgcctgtttattgccggcatcgccgaactcggcgctttctttagcatcctgcaagacatgcggaacacaattatggcctccaaaaccgtggggacctctgaggaaaagctgagaaagaaaagctccttctaccagagctacctccgccggacacagtctatgggaatccagctggatcaaagaattatcgtgctttttatggtcgcgtggggcaaggaggctgttgacaatttccacctgggggatgacatggaccccgagctccgcacgctggcccagtcccttattgatgtgaaagtgaaggaaatcagcaaccaggagcctctgaaactctga

SEQ ID NO: 7112 - RNA, 1290 nt, synthetic construct
  misc_feature 1..1290: note = derived and/or modified CDS sequence (opt5) from HTNV(GAN19/2011)__KY807172.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacagatcgggagggggttgccgccagcatccaggctaagattgacgaactgaaacgccaactcgccgatagaatcgctacgggaaagaacctgggcaaggagcaggaccctaccggggtggaaccgggagatcatcttaaagagcggtccatgctgtcttatggcaatgtgctcgacctgaaccacctggatattgacgagcccacagggcagaccgccgattggctcagcatcgtcatctacctgacatccttcgtggttcctattcttctgaaggcgctctatatgctgaccacacgcggaagacagaccacgaaagacaataagggcacccggatccgctttaaagatgactctagcttcgaagacgtgaacggcattagaaagcccaagcatctttacctgtccctccctaatgcccaatctagcatgaaagctgaggaaatcacacccgggcggtatcgcaccgccatttgcggactgtaccctgctcagatcaaggccagacagatgacatccccggtcatgagcgtgattggctttctggcgctcgccaaagattggtctgaccggatcgagcagtggctgtccgaaccctgtaaacttctgcctgataccgctgccgttagcctccacgggggacccgctacgtctcgcgactatctgagacaaagacaggtggcccttggcaacatggagacaaaggagtccaaggccatccggcagcatgctgaaaccgcggggtgcagcatgattgatgacatcgagtctccttccagcatttgggtcttcgccggagctcccgatcgctgtccgcctacatgcctgtttatcgccggcattgccgaactcggcgctttcttttccatcctgcaagacatgcggaataccatcatggcctctaaaaccgtggggacaagcgaggaaaagctgagaaagaaatccagcctctaccagtcttacctgcgccggacgcagtccatgggcattcagcttgatcaaagaatcattgtgctgttcatggtcgcgtggggaaaggaggctgttgacaactttcacctcggggatgacatggaccccgagctgcgcacccttgcccagagcctgatcgatgtgaaagtgaaggaaatttctaatcaggagcctctcaaactgtga

SEQ ID NO: 7113 - RNA, 1290 nt, synthetic construct
  misc_feature 1..1290: note = derived and/or modified CDS sequence (opt5) from HTNV(LR1)__AF288294.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagagctcttacaaaccgggagggggttgccgtgagcatccaggccaagattgatgaactgaaaatgcaactcgctgaccgcatcgccacgggaaagaatctgggcaaggagcaggatcctaccggggtggaaccgggagaccatcttaaagagagatccatgctgtcttatggcaacgtcctcgatctgaatcacctggacattgatgagcccacagggcagaccgctgactggctcagcatcatcgtgtacctgacatccttcgttgtgcctattcttctgaaggccctctatatgctgaccacacggggacgccagaccacgaaagataacaagggcaccagaatccggtttaaagacgattctagcttcgaagacgtcaatggcattcgcaagcccaagcatctttacgtgtccctgcctgacgcgcaatctagcatgaaagccgaggaaatcacacccgggagatatcggaccgctgtttgcggactctaccctgcccagattaaggctcgccagatgatctccccggtgatgagcgtcattggctttctggccctggcgaaagattggtctgacagaatcgagcagtggctcatcgaaccctgtaagctgcttcctgatacagccgctgtgtccctgctcgggggacccgccaccaaccgggactatctgcgccaaagacaggtggctcttggcaatatggagacgaaagagagcaaggccattcggcagcacgccgaagctgcggggtgctctatgatcgaggatattgaatcccctagctctatctgggtcttcgccggagctcccgacagatgtccgcctacatgcctgtttattgccggcatcgccgagctcggcgctttcttttccatcctgcaagatatgcgcaacaccattatggccagcaaaacagttgggacctccgaagagaagctgcggaagaaatctagcttctaccagtcctacctcagacgcacccagagcatgggaatccagctggaccaacggattatcgtgctttttatggtggcgtggggcaaggaggctgtcgataatttccatctgggggacgatatggaccccgaactcagaacactggcccagtctcttattgacgtgaaagttaaggagatctccaaccaggaacctctgaaactctga

SEQ ID NO: 7114 - RNA, 1290 nt, synthetic construct
  misc_feature 1..1290: note = derived and/or modified CDS sequence (opt5) from HTNV(RG9)__AF288296.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaaccacctggatattgacgagcccaccgggcagacagctgattggctcagcatcgtcatctacctgacctccttcgtggttcctattcttctgaaggccctctatatgctgacaacccgcggaagacagacgaccaaagacaataagggcacacggatccgctttaaagatgactctagcttcgaagacgtgaacggcattagaaagcccaagcatctttacgtctccctgcctaatgcgcaatctagcatgaaagccgaggaaatcacccccgggcggtatcgcacagctatttgcggactctaccctgcccagatcaaggctagacagatgatttccccggtgatgagcgttatcggctttctggccctggcgaaagattggtctgaccggatcgagcagtggctctccgaaccctgtaagctgcttcctgataccgccgctgtgagcctgcacgggggacccgccacgaaccgcgactatctcagacaacggcaggtcgctctgggcaatatggagacaaaagagtctaaggccattagacagcatgccgaatccgctgggtgcagcatgatcgaggatattgaatctccttccagcatctgggtgttcgcgggagcccccgaccgctgtccgcctacctgcctttttattgctggcatcgccgagctgggcgccttcttttccatcctccaagatatgcggaacacaattaccgcttctaaaaccgtggggacaagcgaagagaagctgagaaagaaatccagcttctaccagtcttacctgcgccggacgcagtccatgggaatccagctcgaccaaagaattatcgtcctgtttatggttgcctggggcaaggaggcggtggataatttccaccttggggacgatatggaccccgaactgcgcaccctcgctcagagcctgattgacgtgaaagtcaaggagatctctaaccaggaacctcttaaactgtga

SEQ ID NO: 7115 - RNA, 1290 nt, synthetic construct
  misc_feature 1..1290: note = derived and/or modified CDS sequence (opt5) from HTNV(S85-46)__AF288659.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagcgctcttacaaacagagagggggttgccgtgtccatccaggccaagattgatgaactgaaaatgcaactcgctgaccggatcgccacgggaaagaatctgggcaaggagcaggatcctaccggggtggaaccgggagaccatcttaaagagcgctctatgctgagctatggcaacgtcctcgatctgaatcacctggacattgatgagcccacagggcagaccgctgactggctctccatcatcgtgtacctgacatctttcgttgtgcctattcttctgaaggccctctatatgctgaccacaagaggacggcagaccacgaaagataacaagggcacccgcatcagatttaaagacgatagctccttcgaagacgtcaatggcattcggaagcccaagcatctttacgtgtctctgcctaacgcgcaaagctccatgaaagccgaggaaatcacacccgggcgctatagaaccgctgtttgcggactctaccctgcccagattaaggctcggcagatgatcagcccggtgatgtctgtcattggctttctggccctggcgaaagactggtccgatcgcatcgagcagtggctcatcgaaccctgtaagctgcttcctgacacagccgctgtgagcctgctcgggggacccgccaccaatagagattatctgcggcaacgccaggtggctcttggcaacatggagacgaaagagtctaaggccattagacagcacgccgaagctgcggggtgctccatgatcgaggacattgaaagcccttcttccatctgggtcttcgccggagctcccggccggtgtccgcctacatgcctgtttattgccggcatcgccgagctcggggctttctttagcatcctgcaagatatgagaaataccattatggcctccaaaacagttggaacctctgaagagaagctgcgcaagaaaagctccttctaccagagctacctccggagaacccagtctatgggcatccagctggaccaacgcattatcgtgctttttatggtggcgtgggggaaggaggctgtcgataacttccatctgggagacgatatggaccccgaactccggacactggcccagtcccttattgatgtgaaagttaaggagatcagcaatcaggaacctctgaaactctga

SEQ ID NO: 7116 - RNA, 1290 nt, synthetic construct
  misc_feature 1..1290: note = derived and/or modified CDS sequence (opt5) from HTNV(SN7)__AF288657.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaaccacctggatattgacgagcccaccgggcagacagctgattggctcagcatcgtcatctacctgacctccttcgtggttcctattcttctgaaggccctctatatgctgacaacccgcggaagacagacgaccaaagacaataagggcacacggatccgctttaaagatgactctagcttcgaagacgtgaacggcattagaaagcccaagcatctttacgtctccctgcctaatgcgcaatctagcatgaaaaccgaggaaatcacacccgggcggtatcgcaccgccatttgcggactctaccctgctcagatcaaggccagacagatgatttccccggtgatgagcgttatcggctttctggctctggccaaagattggtctgaccggatcgagcagtggctctccgaaccctgtaagctgcttcctgatacggcggccgtgagcctgcacgggggacccgctacaaaccgcgactatctcagacaacggcaggtcgccctgggcaatatggagaccaaagagtctaaggctattagacagcatgccgaatccgccgggtgcagcatgatcgaggatattgaatctccttccagcatctgggtgttcgctggagcgcccgaccgctgtccgcctacatgcctttttattgccggcatcgctgagctgggcgccttcttttccatcctccaagatatgcggaacaccattatggcctctaaaaccgtggggacaagcgaagagaagctgagaaagaaatccagcttctaccagtcttacctgcgccggacgcagtccatgggaatccagctcgaccaaagaattatcgtcctgtttatggttgcttggggcaaggaggccgtggataatttccaccttggggacgatatggaccccgaactgcgcaccctcgcgcagagcctgattgacgtgaaagtcaaggagatctctaaccaggaacctcttaaactgtga

SEQ ID NO: 7117 - RNA, 1290 nt, synthetic construct
  misc_feature 1..1290: note = derived and/or modified CDS sequence (opt5) from HTNV(84FLi)__AF366568.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgccagcatccaggccaagattgacgaactgaaacgccaactcgctgatagaatcgccaccggaaagaacctgggcaaggagcaggaccctacaggggtggaaccgggagatcatcttaaagagcggtccatgctgtcttatggcaatgtgctcgacctgaaccacctggatattgacgagcccaccgggcagacagctgattggctcagcatcgtcatctacctgacctccttcgtggttcctattcttctgaaggccctctatatgctgacaacccgcggaagacagacgaccaaagacaataagggcacacggatccgctttaaagatgactctagcttcgaagacgtgaacggcattagaaagcccaagcatctttacgtctccctgcctaatgcgcaatctagcatgaaagccgaggaaatcacccccgggcggtatcgcacagctatttgcggactctaccctgcccagatcaaggctagacagatgatttccccggtgatgagcgttatcggctttctggccctggcgaaagattggtctgaccggatcgagcagtggctctccgaaccctgtaagctgcttcctgataccgccgctgtgagcctgcacgggggacccgccacgaaccgcgactatctcagacaacggcaggtcgctctgggcaatatggagacaaaagagtctaaggccattagacagcatgccgaatccgctgggtgcagcatgatcgaggatattgaatctccttccagcatctgggtgttcgcgggagcccccaaccgctgtccgcctacctgcctttttattgctggcatcgccgagctgggcgccttcttttccatcctccaagacatgcggaatacaattatggcttctaaaaccgtggggaccagcgaagagaagctgagaaagaaatccagcttctaccagtcttacctgcgccggacacagtccatgggaatccagctcgatcaaagaattatcgtcctgtttatggttgcctggggcaaggaggcggtggacaacttccaccttggggatgacatggatcccgaactgcgcacgctcgctcagagcctgattgacgtgaaagtcaaggagatctctaatcaggaacctcttaaactgtga

SEQ ID NO: 7118 - RNA, 1290 nt, synthetic construct
  misc_feature 1..1290: note = derived and/or modified CDS sequence (opt5) from HTNV(KHF,clone:4)__LC209206.1__N
  source 1..1290: mol_type = other RNA
atggccaccatggaggaactgcagagagagatcaacgctcacgaaggccaactcgtgattgcccggcagaaggtccgcgacgcggagaaacagtacgaaaaggatcccgacgagctgaataaaagaacacttacggatcgggagggggttgctgtgagcatccaggccaagattgacgaactgaaacgccaactcgccgatagaatcgctaccggaaagaacctgggcaaggagcaggaccctacaggggtggaaccgggagatcatcttaaagagcggtccatgctgtcttatggcaatgtcctcgacctgaaccacctggatattgacgagcccaccgggcagacagccgattggctcagcatcgtggtttacctgacctccttcgtggtccctatccttctgaaggctctctatatgctgacaacccgcggaagacagacgaccaaagacaataagggcacacggattcgctttaaagatgactctagcttcgaagacgtgaacggcatcagaaagcccaagcatctttacgtttccctgcctaatgcccaatctagcatgaaagcggaggaaattacccccgggcggtatcgcacagccgtgtgcggactctaccctgctcagatcaaggccagacagatgatttccccggtcatgagcgtgatcggctttctggctctggccaaagattggtctgaccggattgagcagtggctctccgaaccctgtaagctgcttcctgataccgcggccgtgagcctgctcgggggacccgctacgaaccgcgactatctgagacaacggcaggtcgcccttggcaatatggagacaaaagagtctaaggctatcagacagcacgccgaagccgctgggtgctccatgatcgaggatattgaaagcccttcttccatctgggttttcgcgggagcccccgaccgctgtccgcctacctgcctgtttattgctggcatcgccgagctcggcgccttctttagcattctgcaagatatgcggaacacaatcatggcttccaaaaccgtggggacctctgaagagaagctgagaaagaaaagctccttctaccagagctacctccgccggacacagtctatgggaatccagctggaccaaagaattatcgtgctttttatggtcgcctggggcaaggaggcggtggataatttccatctgggggacgatatggaccccgaactccgcacgctggctcagtcccttattgacgttaaagtgaaggagatcagcaaccaggaacctctgaaactctga

SEQ ID NO: 7119 - RNA, 1287 nt, synthetic construct
  misc_feature 1..1287: note = derived and/or modified CDS sequence (opt5) from LANV(510B)__AF005727.1__N
  source 1..1287: mol_type = other RNA
atgagcaacctgcaggaggtgcaagaaggcatcaccctccacgagcagcagctggtcgccgctagacagaaacttaaggacgccgaaaaggcggttgaggtggatcccgacgatgtgaataagtccacactgcaatctcggcgcgctgccgtcagcgccctcgaaaacaagctggctgagcttaaaagacagctggccgacctcgtggctgcccagaagctggcggccaagcctgttgatccgacggggctggagcccgacgatcatctcaaagaaaagtccgctctgcggtacggaaatgtgcttgacgtcaacgccattgatctggaggaaccttctggccagaccgctgactggaaagccatcggggcgtatattctcggattcgtgatccccattatcctgaaggccctttacatgctgagcacacgcggcagacaaaccgttaaagagaataaggggacacggatccgctttaaggatgactcctctttcgaggaagtgaacggaattagaaaacctaagcacctctatgtcagcatgcccaccgctcagtccacaatgaaagccgatgagatcacccctggccggtttcgcacgattgcttgcggcctgttcccggcccagatcaaggccagaaatattatcagccccgtgatgggggtgattggatttggccatttcgtcaaagactggatggaacggatcgacaactttctgggggaggattgtcctttcctccccaaggctcgcgttcagtctgaagcgtttatgtccaccaatagagcctacttcctgaaccggcaacgccaggtggacgagagcagaatccaggatattgtggaccttatccaagctgccgaggcctcttccgctacactgtttaatgatattgccacccctcacagcgcgtgggtcttcgcttgcgcccccgaccggtgtccgcctacagccctctatgtggctggagttcccgaactgggcgcctttttcgctatccttcaggatatgagaaacaccattatggcctctaaatccgtggggacggcggaggaaaagctgaagaaaaagagcgccttctaccagtcctatctccgccggacacagtctatgggaatccaactggaccagaaaatcattatcctgtacatgctcagctggggcaaggaggctgtcaatcattttcacctgggcgatgacatggatcctgaacttagacagctggcccagaccctcattgacgctaaagtgaaggagatctccaaccaagagcccctgaaactttga

SEQ ID NO: 7120 - RNA, 1287 nt, synthetic construct
  misc_feature 1..1287: note = derived and/or modified CDS sequence (opt5) from LANV(12234)__ALD61435.1__N
  source 1..1287: mol_type = other RNA
atgagcaccctgcaggaggtgcaagaaggcatcacactccacgagcagcagctggtcgccgctagacagaaacttaaggacgccgaaaaggcggttgaggtggatcccgacgatgtgaacaaatccacgctgcaatctcggcgcgctgccgtcagcgccctcgaaaataagctggctgagcttaaaagacagctggccgacctcgtggctgcccagaagctggcggccaagcctgttgatccgaccgggctggagcccgacgatcatctcaaagaaaagtccgctctgcggtacggaaacgtgcttgacgtcaatgccattgatctggaggaaccttctggccagacagctgactggaaagccatcggggcgtatattctcggattcgtgatccccattatcctgaaggccctttacatgctgagcacccgcggcagacaaacagttaaagagaacaaggggacccggatccgctttaaggatgactcctctttcgaggaagtgaatggaattagaaaacctaagcagctctatgtcagcatgcccacagctcagtccaccatgaaagccgatgagatcacgcctggccggtttcgcaccattgcttgcggcctgttcccggcccagatcaaggccagaaacattatcagccccgtgatgggggtgattggattttctcacttcgtcaaagactggatggaacggatcgacgattttctggctgcggactgtcctttcctccccaagcctcgcgttcaatccgaggcctttatggctacaaatagagcctacttcatcaaccggcagcgccagattgatgaaagcagaatgcccgacatcatggatctgattcaagccgctgaggccggctctgcgaccctttttaatgacatcgctacaccgcattccgcctgggtgttcgcctgcgctcctgatcggtgtccccctaccgccctgtatgtggctggggtccccgagctcggagcctttttcgcgattctgcaggacatgagaaacacgatcatggccagcaaatctgtgggcacagctgaagagaaacttaagaagaagtccgccttctaccagagctatctgcgccggacccagtccatggggatccaactcgatcagaaaattatcattctgtacatgctgtcttggggaaaggaagctgttaatcactttcatctcggcgacgatatggaccccgagctgagacagcttgcccagacactgatcgacaccaaagtgaaggaaattagcaaccaagagcctctcaagctgtga

SEQ ID NO: 7121 - RNA, 1272 nt, synthetic construct
  misc_feature 1..1272: note = derived and/or modified CDS sequence (opt5) from LQUV(Longquan-Rs-32)__JX465422.1__N
  source 1..1272: mol_type = other RNA
atggccaccggcagagacctgcaggatgagctcgaacaaatcgagcaggaaattacacaggctaaggccaaatacgagaagcagaaagcggctatcggggaggaacccgacacgattgagctgaaggtgcttcaacagcgggaagagaccatccacatgctggaagagaaacgcaaggagctcctgcagagaattgcccagcaaatgaaaagccctcggcagccggtcaagggacgcgatcttgacgaagatgagcatctgtccgaaagatctacactccggtatggcaacgttatcgacctggaggaactggatatcgacgagcccgccgggggaagcgctgattggctcgccattggcatctacattttctcctttcctgtgcagctgcttctgaagaccctctatatcctgacaacccgcgggagacagacaattaaagagaataagggaaaccggcttcgcttcaaagactctagctccaccatggatgtgaatggcgtcaagacgcccagacacctgtacatctctctccctaccgctcaaagctccatgaagacagaagagattacccccggccggtatcgcacagtggcctgcgggatcctgagcggagaaatgagagcgcggaaactggtttctcctgtgatgggcgtcatcgggtttaactacctcgccgagaagtggggagaatatattgacgctttcctgatgaaacagtccccgcatcttcccgtgagcaccggctctcctgagtccgccacgaattttgcttacctgatccagcgccaagatgttctcaacaagagcaaaacagtggagtacctggaactttgggagcaggccgaaaaggcggggagacacctggtcgaccggattgagtctcccctcaccccttggctgttcgccggatcccccgacagatgtccgcctacaagcctgtatgtggctggcatcgccgaactcggcgcctttttctccattctgcaggatatccgcaatgctatcatggcctctaaacttgtggggaccgctgaggagaagctgaagcggaaaagctccttttaccagagctatctcagacgcacccaatctatgggagtccagctggaccagcggattatcattctttacatgatggaatggggcaagatgatggttgatcatttccacctgggggacgatatggactccgagctcagaaaagcgtgccagagcctgatcgatgaaaaggtggcccaagtgtctaaccaggaggctctgaaactctga

SEQ ID NO: 7122 - RNA, 1272 nt, synthetic construct
  misc_feature 1..1272: note = derived and/or modified CDS sequence (opt5) from LQUV(Longquan-Ra-14)__JX465414.1__N
  source 1..1272: mol_type = other RNA
atggccaccggcagagacctgcaggatgagctcgaacaaatcgagcaggaaattacacaggctaaggccaaatacgagaagcagaaagcggctatcggggaggaacacgacacgattgagctgaaggtgcttcaacagcgggaagagaccatccatatgctggaagagaaacgcaaggagctcctgcagagaattgcccagcaaatgaaaagcccccggcagcctgtcaagggacgcgatcttgacgaagatgagcacctgtccgaaagatctacactccggtatggcaacgttatcgacctggaggaactggatatcgacgagccggccgggggaagcgctgattggctcgccattggcatctacattttctcctttcccgtgcagctgcttctgaagaccctctatatcctgacaacccgcgggagacagacaattaaagagaataagggaaaccggcttcgcttcaaagactctagctccaccatggatgtgaatggcgtcaagacgcctagacatctgtacatctctctccccaccgctcaaagctccatgaagacagaagagattacccctggccggtatcgcacagtggcctgcgggatcctgagcggagaaatgagagcgcggaaactggtttctcccgtgatgggcgtcatcgggtttaactacctcgccgagaagtggggagaatatattgacgctttcctgatgaaacagtcccctcaccttccggtgagcaccggctctcccgagtccgccacgaattttgcttacctgatccagcgccaagatgttctcaacaagagcaaaacagtggagtacctggaactttgggagcaggccgaaaaggcggggagacatctggtcgaccggattgagtctcctctcaccccctggctgttcgccggatcccctgacagatgtcccccgacaagcctgtatgtggctggcatcgccgaactcggcgcctttttctccattctgcaggatatccgcaatgctatcatggcctctaaacttgtggggaccgctgaggagaagctgaagcggaaaagctccttttaccagagctatctcagacgcacccaatctatgggagtccagctggaccagcggattatcattctttacatgatggaatggggcaagatgatggttgatcacttccacctgggggacgatatggactccgagctcagaaaagcgtgccagagcctgatcgatgaaaaggtggcccaagtgtctaaccaggaggctctgaaactctga

SEQ ID NO: 7123 - RNA, 1272 nt, synthetic construct
  misc_feature 1..1272: note = derived and/or modified CDS sequence (opt5) from LQUV(Longquan-Ra-25)__JX465415.1__N
  source 1..1272: mol_type = other RNA
atggccaccggcagagacctgcaggatgagctcgaacaaatcgagcaggaaattacacaggctaaggccaaatacgagaagcagaaagcggctatcggggaggaacccgacacgattgagctgaaggtgcttcaacagcgggaagagaccatccacatgctggaagagaaacgcaaggagctcctgcagagaattgcccagcaaatgaaaagccctaagcagccggtcaagggacgggatcttgacgaagatgagcatctgtccgaacgctctacactcagatatggcaacgttatcgacctggaggaactggatatcgacgagcccgccgggggaagcgctgattggctcgccattggcatctacattttctcctttcctgtgcagctgcttctgaaaaccctctatatcctgacaacccgggggcgccagacaattaaggagaataaaggaaacagacttcggttcaaggactctagctccaccatggatgtgaatggcgtcaagacgccccgccacctgtacatctctctccctaccgctcaaagctccatgaaaacagaagagattacccccggcagatatcggacagtggcctgcgggatcctgagcggagaaatgcgcgcgagaaagctggtttctcctgtgatgggcgtcatcgggtttaactacctcgccgagaaatggggagaatatattgacgctttcctgatgaagcagtccccgcatcttcccgtgagcaccggctctcctgagtccgccacgaattttgcttacctgatccagcggcaagatgttctcaacaaaagcaagacagtggagtacctggaactttgggagcaggccgaaaaagcggggcgccacctggtcgacagaattgagtctcccctcaccccttggctgttcgccggatcccccgaccggtgtccgcctacaagcctgtatgtggctggcatcgccgaactcggcgcctttttctccattctgcaggatatcagaaatgctatcatggcctctaaacttgtggggaccgctgaggagaagctgaagcgcaagagctccttttaccagagctatctccggagaacccaatctatgggcattcagctggaccagcgcatcattatcctttacatgatggaatggggaaaaatgatggtcgatcatttccacctgggggacgatatggactccgagctccggaaggcgtgccagagcctgattgatgaaaaagttgcccaagtgtctaaccaggaggctctgaagctctga

SEQ ID NO: 7124 - RNA, 1287 nt, synthetic construct
  misc_feature 1..1287: note = derived and/or modified CDS sequence (opt5) from NYV(RI-1)__U09488.1__N
  source 1..1287: mol_type = other RNA
atgagcaccctgaaggaggtgcaggacaacatcacactccacgaacaacagctggtcacggccagacagaaacttaaggatgctgagaaagccgttgaagtggaccccgatgacgtgaataagtccaccctgcagggccggcgcgcggctgtctctgccctcgagacaaaactgggggaacttaagagacaactggccgatctcattgctgcccagaagctggctagcaaacctatcgacccgaccggaattgagcccgatgaccatctgaaggagaaatcctctctccggtacggcaacgtgctggatgttaatagcatcgaccttgaagaaccttccgggcagacagccgattggaaggcgattggaatgtatatcctgtctttcgccatccccattatcctcaaagctctgtacatgcttagcacccgcggcagacagacagtgaaggaaaacaaggggacccggattcgctttaaagacgattccagctatgaggaggtcaatggaatcagaaagcctcggcacctgtacgtgtctatgcccacggcccaatccaccatgaaagctgacgaaattacacctggccgcttcagaaccatcgcctgcggcctctttccggcgcaggttaaggcccggaacattatcagccccgtgatgggggtcatcggattcaactttttcgtgaaagactggatggatcgcattgacgattttctggctgagagatgtcctttcctgcccgaacctcgggaccccaaggatgccgctctcggcacaaatcgcgcctattttatcaccagacaggcccaggtggacgagtctaaagtcgttgatattgaggagctgatcgtggacgctcgggcggagtccgccacgcttttcgctgatattgccacaccgcatagcgtgtgggtctttgcctgcgctcctgacagatgtccccctaccgccctgtacgtggcggggatgcccgaactcggagctttctttgccatcctgcaagatatgcgcaatacaatcatggcctctaagtccgttggcaccgctgaggaaaaacttaagaagaaaagcgccttctatcagtcctacctgcggagaacccagtctatggggattcaactcgaccagaagatcattatcctgtacatgattcactggggaaaagaggctgtgaaccatttccacctgggcgacgatatggaccccgaactccgcgagctggcccaggcgcttgtcgatgccaaggtgaaggagatcagcaatcaggaacctctgaaactctga

SEQ ID NO: 7125 - RNA, 1302 nt, synthetic construct
  misc_feature 1..1302: note = derived and/or modified CDS sequence (opt5) from PUUV(K27)__L08804.1__N
  source 1..1302: mol_type = other RNA
atgagcgacctgaccgatatccaggaggaaattacaagacacgagcaacagctcgtggtcgcccggcagaagctgaaagacgctgaacgcgccgttgaggtgtaccccgatgacgtgatcaagaacacgcttcaggcgagacaacagaccgtctccgctctggaagataaactcgccgactataagcggcgcatggccgatgctgtgtctcggaaaaagatggacacaaagcctaccgatccgacaggcattgagcccgacgatcatctgaaagagagaagctcccttcgctacgggaatgttctggacgtgaacgccatcgatattgaagaaccttctggacagaccgctgactggtatacaatcggcgtctacgtgatcgggttcaccattcccatcattctcaaggccctgtatatgctgagcacgagaggacggcagaccgttaaagaaaataagggcacacgcatcagatttaaagacgatacctccttcgaggacattaacgggatccggcgccctaagcacctctacgtgtctatgcccacagcgcaaagcaccatgaaggccgaggaactgacgcctggaagatttcggacaattgtctgcggccttttcccgacccagatccaggtgcgcaatatcatgtcccccgtgatgggcgtcattgggtttagcttctttgttaaagattggcctgagaagatcagagagttcatggagaaagaatgtccctttattaagcctgaggtgaaacccggaacaccggctcaggaggtggagttcctgaagcggaacagagtctattttatgacccgccaagacgtgctcgataaaaatcatgttgccgacatcgataagctgattgactacgctgcctctggcgatcctacctcccccgacgatatcaagagccctaacgcgccctgggtgttcgcctgcgctcccgaccggtctcctccgacatgtatctacgtcgccgggatggctgaacttggagcctttttctccattctgcaggacatgagaaatacgatcatggccagcaaaaccgtgggcacagctgaagagaagctcaaacgcaagtcttccttctatcagagctacctgcggagaacccaatccatggggattcagctggatcagcgcatcattctcctgtatatgcttgaatggggaaaagagatggttgaccactttcatctgggcgatgacatggatcccgagctccggggcctggcgcagtctcttatcgaccaaaaggtgaaggaaatcagcaaccaggagcctctgaaaatttga

SEQ ID NO: 7126 - RNA, 1302 nt, synthetic construct
  misc_feature 1..1302: note = derived and/or modified CDS sequence (opt5) from PUUV(KS13/855)__KX815394.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatcgggtttaccctccccatcattctgaaagccctgtatatgctcagcacgcgcggaagacagaccgtgaaggagaacaaaggcacacggatccgcttcaaggacgatacctcctttgaagacattaatgggatcagacggcctaagcacctgtacgtttctatgcccacagcgcaaagcaccatgaaagccgaggagcttacgcctggacgcttcagaacaattgtgtgcggcctgtttccgacccagatccaggtccggaacattatgtcccccgtgatgggcgtgatcgggttcagctttttcgtcaaggattgggctgaacgcatcagagagtttatggaaaaagagtgtcctttcattaagcccgaagttaaacctggaacacccgcccaggaggtggagtttctcaagaaaaataaggtgtatttcatgcaacggcaggacgtcctggataagaaccatgtggctgacatcgataaacttattgactacgccgcgtctggcgatccgacctcccctgacaatatcgaaagccccaacgccccttgggtttttgcttgcgcccccgacagatgtccccctacctgcatttatgtggctgggatggccgagctgggagccttcttctctatcctccaggatatgcgcaatacaatcatggcttccaagacggtcggcaccgcggaagagaaactgaagaaaaagagctctttttaccaatcctacctgcggagaacacagagcatggggattcagctcgaccagcgcatcattctgctttatatgctggaatggggaaaggagatggtggatcacttccatctcggcgacgatatggacccggagctgcggggccttgcccaagctctgatcgatcagaaagttaaggaaatttccaaccaggagcccctcaaaatctga

SEQ ID NO: 7127 - RNA, 1302 nt, synthetic construct
  misc_feature 1..1302: note = derived and/or modified CDS sequence (opt5) from PUUV(KS14/118)__KX815395.1__N
  source 1..1302: mol_type = other RNA
atgagcgacctgaccgatatccaggaggacattacaagacacgaacaacagctcgtggtcgcccggcagaagctgaaagatgctgagcgcgccgttgaagtggaccccgatgacgtgaacaagaatacgcttcaggcgagacaacagaccgtctccgctctggaggataaactcgccgacttcaagcggcgcatggccgatgctgtgtctcggaaaaagatggacacaaagcctaccgatccgacaggcatcgaacccgacgatcatctgaaagagagaagctcccttcgctacgggaacgttctggacgtgaatgccattgacatcgaggaaccttctggacagaccgctgattggtatacaattggcgtctacgtgatcgggtttaccatccccattatcctcaaggccctgtatatgctgagcacgagaggacggcagaccgttaaagagaacaagggcacacgcattagattcaaagacgatacctcctttgaagacatcaatgggattcggcgccctaagcacctctacgtgtctatgcccacagcgcaaagcaccatgaaggccgaggagctgacgcctggaagattccggacaatcgtctgcggcctttttccgacccagattcaggtgcgcaacatcatgtcccccgtgatgggcgtcatcgggttcagctttttcgttaaaaattggcctgaaagaattaaggagtttatggaaaaagagtgtcccttcatcaagcctgaagtgaaacccggaacaccggctcaggaggtggagtttctgaagcggaacaaagtctatttcatgaatagacaagatgtgctcgacaagaaccatgttgccgatattgacaagctgatcgattacgctgcctctggcgaccctacctcccccgatgacattgaaagccctaatgcgccctgggtgtttgcctgcgctcccgaccgctgtcctccgacctgcatctatgtcgccgggatggctgagcttggagccttcttctctatcctgcaggatatgcggaacacaattatggcctccaaaacggtgggcaccgctgaagagaagctcaaaaagaaaagctctttttaccagtcctacctgagacgcacacaaagcatggggatccagctggaccagcggattatcctcctgtatatgcttgaatggggaaaggagatggttgatcacttccatctgggcgacgatatggaccccgagctcagaggcctggcgcaggcccttattgatcaaaaggtgaaagaaatctccaatcaggagcctctgaagatctga

SEQ ID NO: 7128 - RNA, 1302 nt, synthetic construct
  misc_feature 1..1302: note = derived and/or modified CDS sequence (opt5) from PUUV(LT15/201)__KX757841.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctatcgatccgaccggcattgaacccgacgatcatctgaaggagagaagctcccttcggtacgggaacgtgctggacgttaatgccatcgacattgaggaaccttctggacagacagctgattggtataccatcggcgtgtacgtcatcgggtttacactccccattatcctgaaagccctgtatatgctcagcacccgcggaagacagacggtgaaggagaacaaaggcacccggattcgcttcaaggacgatacatcctttgaagacatcaatgggattagacggcctaagcacctgtacgtttctatgcccaccgcgcaaagcacaatgaaagccgaggagcttacccctggacgcttcagaacgatcgtgtgcggcctgtttccgacacagattcaggtccggaacatcatgtcccccgtgatgggcgtgatcgggttcagctttttcgtcaaggattgggctgaacgcattagagagtttatggaaaaagagtgtcctttcatcaagcccgaagttaaacctggaacccccgcccaggaggtggagtttctcaagaaaaataaggtgtatttcatgcaacggcaggacgtcctggataagaaccatgtggctgacattgataaacttatcgactacgccgcgtctggcgatccgacatcccctgacaatattgaaagccccaacgccccttgggtttttgcttgcgcccccgacagatgtccccctacctgcatctatgtggctgggatggccgagctgggagccttcttctctatcctccaggatatgcgcaataccattatggcttccaagacagtcggcacggcggaagagaaactgaagaaaaagagctctttttaccaatcctacctgcggagaacccagagcatggggatccagctcgaccagcgcattatcctgctttatatgctggaatggggaaaggagatggtggatcacttccatctcggcgacgatatggacccggagctgcggggccttgcccaagctctgattgatcagaaagttaaggaaatctccaaccaggagcccctcaaaatctga

SEQ ID NO: 7129 - RNA, 1302 nt, synthetic construct
  misc_feature 1..1302: note = derived and/or modified CDS sequence (opt5) from PUUV(PUU/Ernstbrunn/Cg641/1995)__AJ888752.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatcgggtttaccctccccatcattctgaaagccctgtatatgctcagcacgcgcggaagacagaccgtgaaggagaacaaaggcacacggatccgcttcaaggacgatacctcctttgaagacattaatgggatcaagagacctaaacacctgtacgtttctatgcccacagcgcaaagcaccatgaaggccgagaaacttacgcctggacggttccgcacaattgtgtgcggcctgtttccgacccagatccaggtcagaaacattatgtcccccgtgatgggcgtgatcgggttcagctttttcgtcaaggattggtctgagcgggttcgcgactttatggaaaaagagtgtcctttcatcaagcccgaaattaaacctggaacacccccgcaggaggctgaatttctcaagagaaataaggtgtatttcatgcaacggcaggatgtgctggacaaaaaccatgtcgccgatatcgacaaacttattgattacgctgcctccggcgaccctaccagccccgacaatctggagtctcctaacgcgccctgggtgtttgcctgcgctcccgatagatgtcctccgacctgcatctatgttgccgggatggctgagctcggagccttcttctccattctgcaggacatgcgcaatacaatcatggccagcaagacggtgggcaccgctgaagagaagctgaaaaagaagtcttccttttaccaaagctacctccggagaacacagtccatggggatccagctggatcagcgcattatccttctgtatatgctcgaatggggaaaagagatggtcgaccacttccatctgggcgatgacatggatcccgaacttcggggcctggcgcaagccctcattgaccagaaggtgaaagagatctctaaccaggagcctctgaagatttga

SEQ ID NO: 7130 - RNA, 1302 nt, synthetic construct
  misc_feature 1..1302: note = derived and/or modified CDS sequence (opt5) from PUUV(PUU/Klippitztoerl/Cg9/1995)__AJ888751.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaacctggaggccagaccgctgattggtatacaattggggtgtacgtcatcggatttaccctccccatcattctgaaagccctgtatatgttctctacgcgcggcagacagaccgtgaaggagaacaaagggacacggatccgctttaaggacgataccagcttcgaagacattaatggaatcagacggcctaagcacctctacgtttccatgcccacagcgcaatctaccatgaaagccgaggagctgacgcctggccgctttagaacaattgtgtgcggccttttcccgacccagatccaggtccggaacattatgagccccgtgatgggggtgatcggattttccttctttgtcaaggattggagcgaacgcgttagagacttcatggagaaagaatgtccttttatcaagcccgagattaaacctggcacacccccgcaggaagctgagttcctgaagcggaataaagtgtattttatgcaaagacaggatgtgctcgacaagaaccatgtcgccgatatcgacaagctgattgattacgctgcctctggggaccctacctcccccgacaatcttgagagccctaacgcgccctgggtgttcgcctgcgctcccgatcgctgtcctccgacctgcatctatgttgccggaatggctgaactgggcgccttcttttctattctccaggacatgcggaatacaatcatggcctccaaaacggtggggaccgctgaggaaaagctgaaaaagaaaagctctttctaccaatcctacctgagacgcacacagagcatgggaatccagctcgatcagcggattatcctgctttatatgctggagtggggcaaggaaatggtcgaccactttcatctcggcgatgacatggatcccgagctgagagggcttgcgcaagccctgattgaccagaaggtgaaagagatctccaaccaggaacctctcaagatttga

SEQ ID NO: 7131 - RNA, 1302 nt, synthetic construct
  misc_feature 1..1302: note = derived and/or modified CDS sequence (opt5) from PUUV(Balkan-1)__AJ314600.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatcgggtttaccctccccatcattctgaaagccctgtatatgctcagcacgcgcggaagacagaccgtgaaggagaacaaaggcacacggatccgcttcaaggacgatacctcctttgaagacattaatgggatcagacggcctaagcacctgtacgtttctatgcccacagcgcaaagcaccatgaaagccgaggagcttacgcctggacgcttcagaacaattgtgtgcggcctgtttccgacccagatccaggtccggaacattatgtcccccgtgatgggcgtgatcgggttcagctttttcgtcaaggattggtctgaacgcgttagagagtttatggaaaaagagtgtcctttcatcaagcccgaaattaaacctggaacacccccgcaggaggctgagtttctcaagcggaataaagtgtatttcatgcaaagacaggacgtgctggataagaaccatgtcgccgacatcgataaacttctggactacgctgcctccggcgatcctaccagccacgacaatattgaatctcccaacgcgccttgggtgtttgcctgcgctcccgaccgctgtccccctacctgcatctatgttgccgggatggctgagctcggagccttcttctccattctgcaggatatgcggaatacaatcatggccagcaagacggtgggcaccgctgaagagaagctgaaaaagaaatcttccttttaccaaagctacctcagacgcacacagtccatggggatccagctggaccagcggattatccttctgtatatgctcgaatggggaaaggagatggtcgatcatttccacctgggcgacgatatggacccggagcttagaggcctggcgcaagccctcattgatcagaaggtgaaagaaatctctaaccaggagcccctgaagatttga

SEQ ID NO: 7132 - RNA, 1302 nt, synthetic construct
  misc_feature 1..1302: note = derived and/or modified CDS sequence (opt5) from PUUV(Balkan-2)__AJ314601.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatcgggtttaccctccccatcattctgaaagccctgtatatgctcagcacgcgcggaagacagaccgtgaaggagaacaaaggcacacggatccgcttcaaggacgatacctcctttgaagacattaatgggatcagacggcctaagcacctgtacgtttctatgcccacagcgcaaagcaccatgaaagccgaggagcttacgcctggacgcttcagaacaattgtgtttggcctgttcccgacccagatccaggtccggaacattatgtcccccgtgatgggcgtgatcgggtttagcttctttgtcaaggattggtctgaacgcgttagagagttcatggaaaaagagtgcccttttatcaagcccgaaattaaacctggagctcccccgcaggaggccgagttcctcaagcggaataaagtgtattttatgcaaagacaggacgtgctggataagaaccatgtcgctgacatcgataaacttattgactacgccgcgtccggcgatcctacaagccccgacaatatcgaatctcctaacgccccctgggtgttcgcttgtgcccccgaccgctgccctccgacctgtatttatgttgctgggatggccgagctgggagccttcttttccatcctccaggatatgcggaataccatcatggctagcaagacagtgggcacggcggaagagaagctgaaaaagaaatcttccttctaccaaagctacctgagacgcacccagtccatggggattcagctcgaccagcggatcattctgctttatatgctggaatggggaaaggagatggtcgatcactttcatctcggcgacgatatggaccccgagctgagaggccttgcccaagctctgatcgatcagaaggtgaaagaaatttctaaccaggagcctctcaagatctga

SEQ ID NO: 7133 - RNA, 1302 nt, synthetic construct
  misc_feature 1..1302: note = derived and/or modified CDS sequence (opt5) from PUUV(Baltic/205Cg/00)__AJ314599.1__N
  source 1..1302: mol_type = other RNA
atgagcgacctggccgatatccaggaggacattaccagacacgaacaacagctcgtggtcgctcggcagaagctgaaagatgccgagcgcgcggttgaagtggaccccgatgacgtgaacaagaatacacttcaggctagacaacagacggtctccgccctggaggataaactcgccgactacaagcggcgcatggctgatgccgtgtctagaaagaagatggacaccaagcctacagatccgaccggcatcgaacccgacgatcatctgaaagagcggagctcccttcgctatgggaacgttctggacgtgaatgctattgacatcgaggaaccttctggacagacagccgattggtacaccattggcgtctatgtgatcgggttcacactccccatcattctgaaggcgctgtacatgctcagcaccagaggacggcagacggttaaagagaacaagggcacccgcatcagatttaaagacgatacatccttcgaagacattaatgggatccggcgccctaagcacctgtatgtgtctatgcccaccgcccaaagcacaatgaaggctgaggagcttacccctggaagatttcggacgattgtctgcggcctgttcccgacacagatccaggtgcgcaacattatgtcccccgtgatgggcgtcatcgggtttagcttctttgttaaagattggcctgaaagaatcaaggagttcatggaaaaagagtgtccctttattaagcctgaagtgaaacccggaaccccgacacaggaggtggagttcctcaagcggaataaagtctactttatgaacagacaagacgtgctggataagaatcatgttgccgacatcgataaacttattgactatgctgcctctggcgatcctacctcccccgacgacatcgaaagccctaacgcgccctgggtgttcgcctgcgctcccgatcgctgtcctccgacctgcatttacgtcgccgggatggctgagctgggagcctttttctctatcctccaggacatgcggtccacaatcatggccagcaaaacggtgggcaccgctgaagagaagctgaaaaagaaatcttccttctaccagagctatctgagacgcacacaatccatggggattcagctcgatcagcggatcattctgctttacatgctggaatggggaaaggagatggttgaccactttcatctcggcgatgacatggatcccgagctgagaggccttgcgcaggccctgatcgaccaaaaggtgaaagaaatttctaatcaggagcctctcaagatctga

SEQ ID NO: 7134 - RNA, 1302 nt, synthetic construct
  misc_feature 1..1302: note = derived and/or modified CDS sequence (opt5) from PUUV(Baltic/49Cg/00)__AJ314598.1__N
  source 1..1302: mol_type = other RNA
atgagcgacctggccgatatccaggaggacattaccagacacgaacaacagctcgtggtcgctcggcagaagctgaaagatgccgagcgcgcggttgaagtggaccccgatgacgtgaacaagaatacacttcaggctagacaacagacggtctccgccctggaggataaactcgccgactacaagcggcgcatggctgatgccgtgtctagaaagaagatggacaccaagcctacagatccgaccggcatcgaacccgacgatcatctgaaagagcggagctcccttcgctatgggaacgttctggacgtgaatgctattgacatcgaggaaccttctggacagacagccgattggtacaccattggcgtctatgtgatcgggttcacactccccatcattctgaaggcgctgtacatgctcagcaccagaggacggcagacggttaaagagaacaagggcacccgcatcagatttaaagacgatacatccttcgaagacattaatgggatccggcgccctaagcacctgtatgtgtctatgcccaccgcccaaagcacaatgaaggctgaggagcttacccctggaagatttcggacgattgtctgcggcctgttcccgacacagatccaggtgcgcaacattatgtcccccgtgatgggcgtcatcgggtttagcttctttgttaaagattggcctgaaagaatcaaggagttcatggaaaaagagtgtccctttattaagcctgaagtgaaacccggaaccccggcccaggaggtggagttcctcaagcggaataaagtctactttatgaacagacaagacgtgctggataagaatcatgttgctgacatcgataaacttattgactatgccgcgtctggcgatcctacatcccccgacgacatcgaaagccctaacgccccctgggtgttcgcttgcgcccccgatcgctgtcctccgacctgcatttacgtcgctgggatggccgagctgggagcctttttctctatcctccaggacatgcggaataccatcatggcttccaaaacagtgggcacggcggaagagaagctgaaaaagaaaagctctttctaccagtcctatctgagacgcacccaaagcatggggattcagctcgatcagcggatcattctgctttacatgctggaatggggaaaggagatggttgaccactttcatctcggcgatgacatggatcccgagctgagaggccttgcccaggctctgatcgaccaaaaggtgaaagaaatttccaaccaggagcctctcaagatctga

SEQ ID NO: 7135 - RNA, 1302 nt, synthetic construct
  misc_feature 1..1302: note = derived and/or modified CDS sequence (opt5) from PUUV(Pallasjarvi/63Cg/98)__AJ314597.1__N
  source 1..1302: mol_type = other RNA
atgagcgacctgaccgatatccaggaggacattacaagacacgaacaacagctcgtggtcgcccggcagaagctgaaagatgctgagcgcgccgttgaagtggaccccgatgacgtgaacaagaatacgcttcaggcgagacaacagaccgtctccgctctggaggataaactcgccgactacaagcggcgcatggccgatgctgtgtctagaaagaagatggacacaaagcctaccgatccgacaggcatcgaacccgacgatcatctgaaagagcggagctcccttcgctatgggaacgttctggacgtgaatgccattgacatcgaggaaccttctggacagaccgctgattggtacacaattggcgtctatgtgatcgggttcaccctccccatcattctgaaggccctgtacatgctcagcacgagaggacggcagaccgttaaagagaacaagggcacacgcatcagatttaaagacgatacctccttcgaagacattaatgggatccggcgccctaagcacctgtatgtgtctatgcccacagcgcaaagcaccatgaaggccgaggagcttacgcctggaagatttcggacaattgtctgcggcctgttcccgacccagatccaggtgcgcaacattatgtcccccgtgatgggcgtcatcgggtttagcttctttgttaaagattggtctgaaagaatccgggagttcatggaaaaggagtgtccttttattaaacccgaagtgaagcctggaacacccgctcaggaggtggagatgctcaaaagaaataagatctacttcatgcaacgccaggacgtcctggataaaaaccatgtggccgacattgataaacttatcgactatgctgcctccggcgatccgaccagccctgacaatattgactctcccaacgcgccttgggtttttgcctgcgctcccgatcggtgtccccctacctgcatctacgtggccgggatggctgaactgggagccttcttttccatcctccaggacatgagaaatacaattatggccagcaagacggtcggcaccgctgaggaaaaactgaagaaaaagtcttccttctaccaaagctatctgcgccggacacagtccatggggatccagctcgatcagagaattatcctgcttttcatgctggagtggggaaaagaaatggtggaccactttcatctcggcgatgacatggatccggagctgcgcggccttgcgcaagccctgattgaccagaaggttaaggagatctctaaccaggaacccctcaaaatctga

SEQ ID NO: 7136 - RNA, 1302 nt, synthetic construct
  misc_feature 1..1302: note = derived and/or modified CDS sequence (opt5) from PUUV(Sotkamo 2009)__HE801633.1__N
  source 1..1302: mol_type = other RNA
atgagcgacctgaccgatatccaggaggacattacaagacacgaacaacagctcatcgtggcccggcagaagctgaaagatgctgagcgcgccgtcgaagttgaccccgatgacgtgaacaagaatacgcttcaggcgagacaacagaccgtgtccgctctggaggataaactcgccgactacaagcggcgcatggccgatgctgtctctagaaagaagatggacacaaagcctaccgatccgacaggcattgaacccgacgatcatctgaaagagcggagctcccttcgctatgggaacgtgctggacgttaatgccatcgacattgaggaaccttctggacagaccgctgattggtacacaatcggcgtgtatgtcatcgggttcaccctccccattatcctgaaggccctgtacatgctcagcacgagaggacggcagaccgtgaaagagaacaagggcacacgcattagatttaaagacgatacctccttcgaagacatcaatgggattcggcgccctaagcacctgtatgtttctatgcccacagcgcaaagcaccatgaaggccgaggagcttacgcctggaagatttcggacaatcgtgtgcggcctgttcccgacccagattcaggtccgcaacatcatgtcccccgtgatgggcgtgatcgggtttagcttctttgtcaaagattggtctgaacggattagagagttcatggaaaaggagtgtccttttatcaaacccgaagttaagcctggaacacccgctcaggagattgagatgctcaaaagaaataagatctacttcatgcaacgccaggacgtgctggataaaaaccatgtggccgacattgataaacttatcgactatgctgcctccggcgatccgaccagccctgacaatatcgactctcccaacgcgccttgggtctttgcctgcgctcccgatcggtgtccccctacctgcatttacgtggccgggatggctgaactgggagccttcttttccatcctccaggacatgagaaatacaattatggccagcaagacggttggcaccgctgaggaaaaactgaagaaaaagtcttccttctaccaaagctatctgcgccggacacagtccatggggatccagctcgatcagagaattatcctgcttttcatgctggagtggggaaaagaaatggtggaccactttcatctcggcgatgacatggatccggagctgcgcggccttgcgcaagccctgatcgaccagaaggtcaaggagatttctaaccaggaacccctcaaaatctga

SEQ ID NO: 7137 - RNA, 1302 nt, synthetic construct
  misc_feature 1..1302: note = derived and/or modified CDS sequence (opt5) from PUUV(CG 13891)__U22423.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacagatggccgatgctgtctctcggaagaagatggacacaaaacctaccgatccgacaggcatcgaacccgacgatcatctgaaggagcgcagctcccttagatacgggaacgtgctggacgttaatgccattgacatcgaggaaccttctggacagaccgctgattggtatacaattggcgtgtacgtcatcgggtttaccctccccatcattctgaaagccctgtatatgctcagcacgcggggacgccaaaccgtgaaggagaacaaaggcacaagaatccggttcaaggacgatacctcctttgaagacattaatgggatccgcagacctaagcacctgtacgtttctatgcccacagcgcagagcaccatgaaagccgaggagcttacgcctggacggttccgcacaattgtgtgcggcctgtttccgacccagatccaggtcagaaacattatgtcccccgtgatgggcgtgatcgggttcagctttttcgtcaaggattgggctgaccggatccgcgaatctatggagaaagaatgtccttttctcaagcccgatgttaaacctggaacacccgcccaagagaccgagttcctgaagagaaataaaatttattttatgcagcggcaggaagtgcttgacaagaaccatgtggctgagatcgataagctgattgactacgccgcgtccggcgatccgaccagccctgacaatatcgaatctcccaacgccccttgggtcttcgcttgcgcccccgacagatgtccccctacatgcatttatgtggctgggatggccgagctcggagcctttttctccatcctgcaagatatgcgcaatacgatcatggctagcaaaaccgttggcacagcggaagagaagctgaaaaagaaatcttccttctaccagagctacctccggagaacccagtccatggggattcagctggaccaacgcatcattcttctgtatatgctcgaatggggaaaggagatggtggatcactttcatctgggcgacgatatggacccggagcttcggggcctggcccaggctctcatcgatcagaaggtcaaagaaatttctaaccaggagcccctgaagatctga

SEQ ID NO: 7138 - RNA, 1302 nt, synthetic construct
  misc_feature 1..1302: note = derived and/or modified CDS sequence (opt5) from PUUV(CG1820)__M32750.1__N
  source 1..1302: mol_type = other RNA
atgagcgacctgaccgatatccaggaggaaattacaagacacgagcaacagctcgtggtcgcccggcagaagctgaaagacgctgaacgcgccgttgaggtggatcccgacgatgtgaacaagtccacgcttcaggcgagacaacagaccgtctctgctctggaagacaaactcgccgattacaagcggcgcatggccgacgctgtgagccggaaaaagatggatacaaagcctaccgacccgacaggcatcgagcccgatgaccatctgaaagagagatcctctcttcgctatgggaatgttctggatgtgaacgccattgacatcgaagaacctagcggacagaccgctgactggtacacaattggcgtctatgtgatcgggttcaccatccccattatcctcaaggccctgtacatgctgtccacgagaggacggcagaccgttaaagaaaataagggcacacgcattagatttaaagatgacacctctttcgaggatatcaacgggattcggcgccctaagcacctctatgtgagcatgcccacagcgcaatccaccatgaaggccgaggaactgacgcctggaagatttcggacaatcgtctgcggccttttcccgacccagattcaggtgcgcaatatcatgagccccgtgatgggcgtcatcgggttttctttctttgttaaagactggcctgagaagattagagagttcatggagaaagaatgtccctttatcaagcctgaggtgaaacccggaacaccggctcaggaggtggagttcctgaagcggaacagagtctactttatgacccgccaagatgtgctcgacaaaaatcatgttgccgatattgacaagctgatcgattatgctgcctccggcgaccctaccagccccgatgacattgaatctcctaacgcgccctgggtgttcgcctgcgctcccgaccggtgtcctccgacatgcatctacgtcgccgggatggctgaacttggagcctttttctccatcctgcaggatatgagaaatacgattatggccagcaagaccgtgggcacagctgaggaaaaactcaagaaaaagtcttccttctaccagagctatctgcgccggacccaatccatggggatccagctggaccagagaattatcctcctgtacatgcttgagtggggacgcgagatggttgatcactttcatctgggcgacgatatggaccccgaactccggggcctggcgcagtctcttattgatcaaaaagtgaaggagatcagcaaccaggaacctctgaagatctga

SEQ ID NO: 7139 - RNA, 1302 nt, synthetic construct
  misc_feature 1..1302: note = derived and/or modified CDS sequence (opt5) from PUUV(Bussjo_95-1)__AM746297.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatcgggtttaccctccccatcattctgaaagccctgtatatgctcagcacgcgcggaagacagaccgtgaaggagaacaaaggcacacggatccgcttcaaggacgatacctcctttgaagacattaatgggatcagacggcctaagcacctgtacgtttctatgcccacagcgcaaagcaccatgaaagccgaggagcttacgcctggacgcttcagaacaattgtgtgcggcctgtttccgacccagatccaggtccggaacattatgtcccccgtgatgggcgtgatcgggttcagctttttcgtcaaggattggcctgaccgcatcagagaatttatggagaaagaatgtcccttcattaagcctgaggttaaacccggaacaccgacccaggaaatcgagtttctcaagaaaaataaggtgtatttcatggatcggcaaaacgtgctggacaagaatcatgtcgctgatattgacaaacttatcgattacgccgcttctggcgaccctacctcccccgacaacattgagagccctaatgccccctgggtgtttgcgtgcgcccccgatagatgtcctccgacatgcatctatgttgctgggatggccgaactgggagctttcttctctatcctccaggacatgcgcaacacgattatggcctccaagaccgtgggcacagccgaggaaaaactgaagaaaaagagctctttttaccagtcctacctgcggagaacccaaagcatggggatccagctcgatcagcgcattatcctgctttatatgctggagtggggaaaggaaatggtcgaccacttccatctcggcgatgacatggatcccgagctgcggggccttgctcaggcgctgattgaccaaaaagtgaaggagatctccaatcaggatcctctcaaaatctga

SEQ ID NO: 7140 - RNA, 1302 nt, synthetic construct
  misc_feature 1..1302: note = derived and/or modified CDS sequence (opt5) from PUUV(CG144)__AF367064.1__N
  source 1..1302: mol_type = other RNA
atgagcgacctgaccgatatccaggaggacattacaagacacgaacaacagctcgtggccgctcggcagaagctgaaagatgccgagcgcgcggtcgaaatggaccccgatgacgttaacaagaatacgcttcaggctagacaacagaccgtgtccgccctggaggataaactcgccgactacaagcggcgcatggctgatgccgtgtctagaaagaagatggacacaaagcctgctgatccgaccggcatcgaacccgacgatcatctgaaagagcggagctcccttcgctatgggaacgtcctggacgtgaatgccattgacatcgaggaaccttctggacagacagcggattggtacaccattggcatctatgttatcgggttcacactccccattatcctgaaggccctgtacatgctcagcaccagaggacggcagacggtgaaagagaacaagggcacccgcattagatttaaagacgatacatccttcgaagacatcaatgggattcggcgccctaagcacctgtatgtctctatgcccaccgctcaaagcacaatgaaggccgaggagcttacccctggaagatttcggacgatcgtgtgcggcctgttcccgacacagattcaggttcgcaacatcatgtcccccgtgatgggcgtcatcgggtttagcttctttgtgaaagattggcctgaacggattagagagttcatggaaaaggagtgtccctttatcaaacctgaagtgaagcccggaaccccggctcaggagattgagatgctcaaaaagaataaaatctacttcatgcatagacaagacgtcctggataagaaccacgttgccgacattgataaacttatcgactatgcggcctctggcgatcctacatcccccgacaatatcgacagccctaacgctccctgggtgtttgcctgcgctcccgatcgctgtcctccgacctgcatttacgtggccgggatggccgaactgggagctttcttttctatcctccaggacatgcggaataccattatggcgtccaaaacagtcggcacggccgaggaaaagctgaaaaagaaaagctctttctaccagtcctatctgagacgcacccaaagcatggggatccagctcgatcagcggattatcctgctttacatgctggagtggggaaaggaaatggtggaccatttccacctcggcgatgacatggatcccgagctgagaggccttgctcaggccctgatcgaccaaaaggttaaagagatttccaaccaggaacctctcaagatctga

SEQ ID NO: 7141 - RNA, 1302 nt, synthetic construct
  misc_feature 1..1302: note = derived and/or modified CDS sequence (opt5) from PUUV(CG168)__AF367065.1__N
  source 1..1302: mol_type = other RNA
atgagcgacctgaccgatatccaggaggacattacaagacacgaacaacagctcgtggccgctcggcagaagctgaaagatgccgagcgcgcggtcgaaatggaccccgatgacgttaacaagaatacgcttcaggctagacaacagaccgtgtccgccctggaggataaactcgccgactacaagcggcgcatggctgatgccgtgtctagaaagaagatggacacaaagcctgctgatccgaccggcatcgaacccgacgatcatctgaaagagcggagctcccttcgctatgggaacgtcctggacgtgaatgccattgacatcgaggaaccttctggacagacagcggattggtacaccattggcgtttatgtgatcgggttcacactccccatcattctgaaggccctgtacatgctcagcaccagaggacggcagacggtcaaagagaacaagggcacccgcatcagatttaaagacgatacatccttcgaagacattaatgggatccggcgccctaagcacctgtatgtgtctatgcccaccgctcaaagcacaatgaaggccgaggagcttacccctggaagatttcggacgattgtttgcggcctgttcccgacacagatccaggtgcgcaacattatgtcccccgtcatgggcgtgatcgggtttagcttctttgtgaaagattggcctgaaagaatccgggagttcatggaaaaggagtgtccctttattaaacctgaagtcaagcccggaatcccggctcaggagattgagatgctcaaaaagaataaaatctacttcatgcatagacaagacgttctggataagaaccacgtggccgacattgataaacttatcgactatgcggcctctggcgatcctacctcccccgacaatatcgacagccctaacgctccctgggtgtttgcctgcgctcccgatcgctgtcctccgacatgcatttacgtcgccgggatggccgaactgggagctttcttttctatcctccaggacatgcggaataccattatggcgtccaaaaccgtgggcacagccgaggaaaagctgaaaaagaaaagctctttctaccagtcctatctgagacgcacgcaaagcatggggatccagctcgatcagcggattatcctgctttacatgctggagtggggaaaggaaatggttgaccatttccacctcggcgatgacatggatcccgagctgagaggccttgctcaggccctgatcgaccaaaaggtgaaagagatttccaaccaggaacctctcaagatctga

SEQ ID NO: 7142 - RNA, 1302 nt, synthetic construct
  misc_feature 1..1302: note = derived and/or modified CDS sequence (opt5) from PUUV(CG17/Baskiria-2001)__AF442613.1__N
  source 1..1302: mol_type = other RNA
atgagcgacctggccgatatccaggaggaaattaccagacacgagcaacagctcgtggctgcccggcagaagctgaaagacgcggaacgcgctgtcgaggttgatcccgacgatgtgaacaagaatacacttcaggccagacaacagacggtgtccgccctggaagacaaactcgctgattacaagcggcgcatggccgacgctgtctctcggaaaaagatggataccaagcctacagacccgaccggcatcgagcccgatgaccatctgaaagagagaagctcccttcgctatgggaacgtgctggatgttaatgccattgacatcgaagaaccttctggacagacagcggactggtacaccattggcgtgtatgtcatcgggttcacaatccccattatcctcaaggccctgtacatgctgagcaccagaggacggcagacggtgaaagaaaacaagggcacccgcattagatttaaagatgacacatccttcgaggatatcaatgggattcggcgccctaagcacctctatgtttctatgcccaccgctcaaagcacaatgaaggccgaggaactgacccctggaagatttcggacgatcgtgtgcggccttttcccgacacagattcaggtccgcaacatcatgtcccccgtgatgggcgtgatcgggtttagcttctttgtcaaagactggcctgagaagattagagaatttatggagaaagaatgtccctttatcaagcctgaggttaaacccggaaccccggctcaggaggtggagttcctgaagcggaatagagtgtactttatgacacgccaagatgtcctcgacaaaaaccatgtggccgatattgacaagctgatcgattatgcggcctctggcgaccctacctcccccgatgacattgagagccctaatgctccctgggttttcgcctgcgctcccgaccggtgtcctccgacctgcatctacgtggccgggatggccgaacttggagctttcttctctatcctgcaggatatgagaaacacaattatggcgtccaagacggtcggcaccgccgaggaaaaactcaagaaaaagagctctttctaccagtcctatctgcgccggacacaaagcatggggatccagctggaccagagaattatcctcctgtacatgcttgagtggggaaaagagatggtggatcactttcatctgggcgacgatatggaccccgaactccgcggcctggctcagtcccttattgatcaaaaggttaaggagatctctaatcaggaacctctgaaaatctga

SEQ ID NO: 7143 - RNA, 1302 nt, synthetic construct
  misc_feature 1..1302: note = derived and/or modified CDS sequence (opt5) from PUUV(CG215)__AF367066.1__N
  source 1..1302: mol_type = other RNA
atgagcgacctgaccgatatccaggaggacattacaagacacgaacaacagctcgtggccgctcggcagaagctgaaagatgccgagcgcgcggtcgaaatggaccccgatgacgttaacaagaatacgcttcaggctagacaacagaccgtgtccgccctggaggataaactcgccgactacaagcggcgcatggctgatgccgtgtctagaaagaagatggacacaaagcctgctgatccgaccggcatcgaacccgacgatcatctgaaagagcggagctcccttcgctatgggaacgtcctggacgtgaatgccattgacatcgaggaaccttctggacagacagcggattggtacaccattggcgtttatgtgatcgggttcacactccccatcattctgaaggccctgtacatgctcagcaccagaggacggcagacggtcaaagagaacaagggcacccgcatcagatttaaagacgatacatccttcgaagacattaatgggatccggcgccctaagcacctgtatgtgtctatgcccaccgctcaaagcacaatgaaggccgaggagcttacccctggaagatttcggacgattgtttgcggcctgttcccgacacagatccaggtgcgcaacattatgtcccccgtcatgggcgtgatcgggtttagcttctttgtgaaagattggcctgaaagaatccgggagttcatggaaaaggagtgtccctttattaaacctgaagtcaagcccggaaccccggctcaggagatcgagatgctcaaaaagaataaaatttacttcatgcatagacaagacgttctggataagaaccacgtggccgacatcgataaacttattgactatgcggcctctggcgatcctacatcccccgacaatatcgacagccctaacgctccctgggtgtttgcctgcgctcccgatcgctgtcctccgacctgcatctacgtcgccgggatggccgaactgggagctttcttttctattctccaggacatgcggaataccatcatggcgtccaaaacagtgggcacggccgaggaaaagctgaaaaagaaaagctctttctaccagtcctatctgagacgcacccaaagcatggggattcagctcgatcagcggatcattctgctttacatgctggagtggggaaaggaaatggttgaccatttccacctcggcgatgacatggatcccgagctgagaggccttgctcagacactgatcgaccaaaaggtgaaagagatctccaaccaggaacctctcaagatttga

SEQ ID NO: 7144 - RNA, 1302 nt, synthetic construct
  misc_feature 1..1302: note = derived and/or modified CDS sequence (opt5) from PUUV(CG315)__AF367068.1__N
  source 1..1302: mol_type = other RNA
atgagcgacctgaccgatatccaggaggacattacaagacacgaacaacagctcgtggccgctcggcagaagctgaaagatgccgagcgcgcggtcgaaatggaccccgatgacgttaacaagaatacgcttcaggctagacaacagaccgtgtccgccctggaggataaactcgccgactacaagcggcgcatggctgatgccgtgtctagaaagaagatggacacaaagcctgctgatccgaccggcatcgaacccgacgatcatctgaaagagcggagctcccttcgctatgggaacgtcctggacgtgaatgccattgacatcgaggaaccttctggacagacagcggattggtacaccattggcgtttatgtgatcgggttcacactccccatcattctgaaggccctgtacatgctcagcaccagaggacggcagacggtcaaagagaacaagggcacccgcatcagatttaaagacgatacatccttcgaagacattaatgggatccggcgccctaagcacctgtatgtgtctatgcccaccgctcaaagcacaatgaaggccgaggagcttacccctggaagatttcggacgattgtttgcggcctgttcccgacacagatccaggtgcgcaacattatgtcccccgtcatgggcgtgatcgggtttagcttctttgtgaaagattggcctgaaagaatccgggagttcatggaaaaggagtgtccctttatgaaacctgaagtcaagcccggaaccccggctcaggagattgagatgctcaaaaagaataaaatctacttcatgcatagacaagacgttctggataagaaccacgtggccgacattgataaacttatcgactatgcggcctctggcgatcctacatcccccgacaatattgacagccctaacgctccctgggtgtttgcctgcgctcccgatcgctgtcctccgacctgcatctacgtcgccgggatggccgaactgggagctttcttttctatcctccaggacatgcggaataccattatggcgtccaaaacagtgggcacggccgaggaaaagctgaaaaagaaaagctctttctaccagtcctatctgagacgcacccaaagcatggggatccagctcgatcagcggattatcctgctttacatgctggagtggggaaaggaaatggttgaccatttccacctcggcgatgacatggatcccgagctgagaggccttgctcaggccctgattgaccaaaaggtgaaagagatctccaaccaggaacctctcaagatctga

SEQ ID NO: 7145 - RNA, 1302 nt, synthetic construct
  misc_feature 1..1302: note = derived and/or modified CDS sequence (opt5) from PUUV(CRF161)__AF367069.1__N
  source 1..1302: mol_type = other RNA
atgagcgacctgaccgatatccaggaggacattacaagacacgaacaacagctcgtggccgctcggcagaagctgaaagatgccgagcgcgcggtcgaaatggaccccgatgacgttaacaagaatacgcttcaggctagacaacagaccgtgtccgccctggaggataaactcgccgactacaagcggcgcatggctgatgccgtgtctagaaagaagatggacacaaagcctgctgatccgaccggcatcgaacccgacgatcatctgaaagagcggagctcccttcgctatgggaacgtcctggacgtgaatgccattgacatcgaggaaccttctggacagacagcggattggtacaccattggcgtttatgtgatcgggttcacactccccatcattctgaaggccctgtacatgctcagcaccagaggacggcagacggtcaaagagaacaagggcacccgcatcagatttaaagacgatacatccttcgaagacattaatgggatccggcgccctaagcacctgtatgtgtctatgcccaccgctcaaagcacaatgaaggccgaggagcttacccctggaagatttcggacgattgtttgcggcctgttcccgacacagatccaggtgcgcaacattatgtcccccgtcatgggcgtgatcgggtttagcttctttgtgaaagattggcctgaaagaatccgggagttcatggaaaaggagtgtccctttattaaacctgaagtcaagcccggaaccccggctcaggagatcgagatgctcaaaaagaataaaatttacttcatgcatagacaagacgttctggataagaaccacgtggccgacatcgataaacttattgactatgcggcctctggcgatcctacatcccccgacaatatcgacagccctaacgctccctgggtgtttgcctgcgctcccgatcgctgtcctccgacctgcatctacgtcgccgggatggccgaactgggagctttcttttctattctccaggacatgcggaataccatcatggcgtccaaaacagtgggcacggccgaggaaaagctgaaaaagaaaagctctttctaccagtcctatctgagacgcacccaaagcatggggattcagctcgatcagcggatcattctgctttacatgctggagtggggaaaggaaatggttgaccatttccacctcggcgatgacatggatcccgagctgagaggccttgctcaggccctgatcgaccaaaaggtgaaagagatctccaaccaggaacctctcaagatttga

SEQ ID NO: 7146 - RNA, 1302 nt, synthetic construct
  misc_feature 1..1302: note = derived and/or modified CDS sequence (opt5) from PUUV(CRF308)__AF367070.1__N
  source 1..1302: mol_type = other RNA
atgagcgacctgaccgatatccaggaggacattacaagacacgaacaacagctcgtggccgctcggcagaagctgaaagatgccgagcgcgcggtcgaaatggaccccgatgacgttaacaagaatacgcttcaggctagacaacagaccgtgtccgccctggaggataaactcgccgactacaagcggcgcatggctgatgccgtgtctagaaagaagatggacacaaagcctgctgatccgaccggcatcgaacccgacgatcatctgaaagagcggagctcccttcgctatgggaacgtcctggacgtgaatgccattgacatcgaggaaccttctggacagacagcggattggtacaccattggcgtttatgtgatcgggttcacactccccatcattctgaaggccctgtacatgctcagcaccagaggacggcagacggtcaaagagaacaagggcacccgcatcagatttaaagacgatacatccttcgaagacattaatgggatccggcgccctaagcacctgtatgtgtctatgcccaccgctcaaagcacaatgaaggccgaggagcttacccctggaagatttcggacgattgtttgcggcctgttcccgacacagatccaggtgcgcaacattatgtcccccgtcatgggcgtgatcgggtttagcttctttgtgaaagattggcctgaaagaatccgggagttcatggaaaaggagtgtccctttattaaacctgaagtcaagcccggaaccccggctcaggagatcgagatgctcaaaaagaataaaatttacttcatgcatagacaagacgttctggataagaaccacgtggccgacatggataaacttatcgactatgcggcctctggcgatcctacatcccccgacaatattgacagccctaacgctccctgggtgtttgcctgcgctcccgatcgctgtcctccgacctgcatctacgtcgccgggatggccgaactgggagctttcttttctatcctccaggacatgcggaataccattatggcgtccaaaacagtgggcacggccgaggaaaagctgaaaaagaaaagctctttctaccagtcctatctgagacgcacccaaagcatggggatccagctcgatcagcggattatcctgctttacatgctggagtggggaaaggaaatggttgaccatttccacctcggcgatgacatggatcccgagctgagaggccttgctcaggccctgattgaccaaaaggtgaaagagatctccaaccaggaacctctcaagatctga

SEQ ID NO: 7147 - RNA, 1302 nt, synthetic construct
  misc_feature 1..1302: note = derived and/or modified CDS sequence (opt5) from PUUV(CRF366)__AF367071.1__N
  source 1..1302: mol_type = other RNA
atgaccgacctgacagatatccaggaggacattacgagacacgaacaacagctcgtggccgctcggcagaagctgaaagatgccgagcgcgcggtcgaaatggaccccgatgacgttaacaagaatacccttcaggctagacaacagacagtgagcgccctggaggataaactcgccgactacaagcggcgcatggctgatgccgtgtccagaaagaagatggacaccaagcctgctgatccgacaggcatcgaacccgacgatcatctgaaagagcggtctagccttcgctatgggaacgtcctggacgtgaatgccattgacatcgaggaaccttccggacagaccgcggattggtacacaattggcatctatgttatcgggttcaccctccccattatcctgaaggccctgtacatgctctctacgagaggacggcagaccgtgaaagagaacaagggcacacgcattagatttaaagacgataccagcttcgaagacatcaatgggattcggcgccctaagcacctgtatgtctccatgcccacagctcaatctaccatgaaggccgaggagcttacgcctggaagatttcggacaatcgtgtgcggcctgttcccgacccagattcaggttcgcaacatcatgagccccgtgatgggcgtcatcgggttttccttctttgtgaaagattggcctgaacggattagagagttcatggaaaaggagtgtccctttatcaaacctgaagtgaagcccggaacaccggctcaggagattgagatgctcaaaaagaataaaatctacttcatgcatagacaagacgtcctggataagaaccacgttgccgacattgataaacttatcgactatgcggccagcggcgatcctacctctcccgacaatatcgactcccctaacaccccctgggtgtttgcttgcgcccccgatcgctgtcctccgacatgcatttacgtggctgggatggccgaactgggagccttctttagcatcctccaggacatgcggaatacgattatggcttctaaaaccgtcggcacagcggaggaaaagctgaaaaagaaatccagcttctaccagtcttatctgagacgcacccaatccatggggatccagctcgatcagcggattatcctgctttacatgctggagtggggaaaggaaatggtggaccatttccacctcggcgatgacatggatcccgagctgagaggccttgcccaggctctgatcgaccaaaaggttaaagagattagcaaccaggaacctctcaagatctga

SEQ ID NO: 7148 - RNA, 1302 nt, synthetic construct
  misc_feature 1..1302: note = derived and/or modified CDS sequence (opt5) from PUUV(Djaknebole_98-1)__AM746310.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatcgggtttaccctccccatcattctgaaagccctgtatatgctcagcacgcgcggaagacagaccgtgaaggagaacaaaggcacacggatccgcttcaaggacgatacctcctttgaagacattaatgggatcagacggcctaagcacctgtacgtttctatgcccacagcgcaaagcaccatgaaagccgaggagcttacgcctggacgcttcagaacaattgtgtgcggcctgtttccgacccagatccaggtccggaacattatgtcccccgtgatgggcgtgatcgggttcagctttttcgtcaaggattgggctgaccgcatcagagaatttatggagaaagaatgtcctttcattaagcccgaggttaaacctggaacacccacccaggaaatcgagtttctcaagaaaaataaggtgtatttcatggatcggcaaaacgtgctggacaagaatcatgtcgccgatattgacaaacttatcgattacgctgcctctggcgacccgacctcccctgacaacattgagagccccaatgcgccttgggtgtttgcctgcgctcccgatagatgtccccctacatgcatctatgttgccgggatggctgaactgggagccttcttctctatcctccaggacatgcgcaacacgattatggcctccaagaccgtgggcacagctgaggaaaaactgaagaaaaagagctctttttaccagtcctacctgcggagaacccaaagcatggggatccagctcgatcagcgcattatcctgctttatatgctggagtggggaaaggaaatggtcgaccacttccatctcggcgatgacatggatccggagctgcggggccttgcgcaggccctgattgaccaaaaagtgaaggagatctccaatcaggatcccctcaaaatctga

SEQ ID NO: 7149 - RNA, 1302 nt, synthetic construct
  misc_feature 1..1302: note = derived and/or modified CDS sequence (opt5) from PUUV(Fusong 114-05)__EF488804.1__N
  source 1..1302: mol_type = other RNA
atgagcgacctgaaggatatccaggaggacattgccagacacgaacaacagctcgtggtcgctcggcagaaactgcgcgatgccgagaaggcggttgaaatggaccccgatgacgtgaacaaaaatacccttcaggctagacaacagacagtgtccgccctggaggataagatcgccgacttcaaacggcgcatggctgatattgtctctagaaagaagatggacacgaaacctgccgatccgaccggcatcgaacccgacgatcatctcaaggagcggagctccctgcgctacgggaacgtgcttgacgttaatgctattgacatcgaggaaccttctggacagacagccgattggtataccatcggcgtgtacattatcgagtttacactgcccattatcctcaaagcgctgtatatgctgagcaccagagggcggcagacagccaaggaaaacaaaggaacccgcattagattcaaggacgatacgtcctttgaggacgtcaatggcatccggcgccctaagcacctctacgtgtctatgcccaccgctcaaagcacaatgaaagccgaggaactgacccctgggagattccggacaattgtttgcggactttttccgacccagatccaggtgcgcaacatcatgtcccccgtcatgggcgtgattggcttcagctttttcgctaaggattggcctgacagaatcaaagagtttatggaaaaggagtgtcccttcattaaacctgaagtgaagcccgggacgccggccaaagaggtcgagatcctgaagcggaataagatttattttatgcagagacaaggagttctcgataaaaaccatgtgcctgacatcgataagctgatcgactacgcggcctctggcgatcccacatcccctcgcaatattgacagccccaacgctccctgggtgttcgcctgcgctcctgaccggtgtccgcctacctgcatctatgtcgccgggatggccgaacttggagcgtttttctctattctgcaggatatgagaaatacaatcatggcttccaaaaccgtgggcaccgccgaggaaaagctcaaaaagaaaagctctttctaccagtcctacctgcgccggacacaaagcatggggattcagctggaccagagaatcatcctcctgtatatgcttgagtggggaaaggaaatggttgatcactttcatctgggcgacgatatggaccccgagctccgctccctggctcaggcccttattgatcaaaaggtgaaagagatctctaaccaggaacccctgaagatttga

SEQ ID NO: 7150 - RNA, 1302 nt, synthetic construct
  misc_feature 1..1302: note = derived and/or modified CDS sequence (opt5) from PUUV(Fusong 199-05)__EF488803.1__N
  source 1..1302: mol_type = other RNA
atgagcgacctgaaggatatccaggaggacattgccagacacgaacaacagctcgtggctgcccggcagaaactgcgcgatgcggagaaggctgtcgaaatggaccccgatgacgttaacaaaaatacccttcaggccagacaacagacagtgtccgccctggaggataagatcgctgacttcaaacggcgcatggccgatattgtgtctagaaagaagatggacacgaaacctgctgatccgaccggcatcgaacccgacgatcatctcaaggagcggagctccctgcgctacgggaacgtccttgacgtgaatgccattgacatcgaggaaccttctggacagacagcggattggtataccatcggcgtttacattatcgggtttacactgcccattatcctcaaagccctgtatatgctgagcaccagaggacggcagacagtgaaggagaacaaaggcacccgcattagattcaaggacgatacgtcctttgaagacgtcaatgggatccggcgccctaagcacctctacgtgtctatgcccaccgctcaaagcacaatgaaagccgaggagctgacccctggaagattccggacaattgtttgcggcctttttccgacccagatccaggtgcgcaacatcatgtcccccgtcatgggcgtgattgggttcagctttttcgctaaggattggcctgacagaatcaaagaatttatggagaaggaatgtcccttcattaaacctgaggtgaagcccggaacgccggccaaagaagtcgagatcctgaagcggaataagatttattttatgcagagacaagatgttctcgacaaaaaccatgtgcctgatatcgacaagctgatcgattacgcggcctctggcgaccccacatcccctgagaatattgacagccccaacgctccctgggtgttcgcctgcgctcctgatcgctgtccgcctacctgcatctatgtcgccgggatggccgaacttggagcgtttttctctattctgcaggacatgcggaatacaatcatggcttccaaaaccgtgggcaccgccgaggaaaagctcaaaaagaaaagctctttctaccagtcctacctgagacgcacacaaagcatggggattcagctggatcagcggatcatcctcctgtatatgcttgagtggggaaaggaaatggttgaccactttcatctgggcgatgacatggatcccgagctcagatccctggctcaggcccttattgaccaaaaggtgaaagagatctctaaccaggaacccctgaagatttga

SEQ ID NO: 7151 - RNA, 1302 nt, synthetic construct
  misc_feature 1..1302: note = derived and/or modified CDS sequence (opt5) from PUUV(Fusong 200-05)__EF211820.1__N
  source 1..1302: mol_type = other RNA
atgagcgacctgaaggatatccaggaggacattgccagacacgaacaacagctcgtggtcgctcggcagaaactgcgcgatgccgagaaggcggttgaaatggaccccgatgacgtgaacaaaaatacccttcaggctagacaacagacagtgtccgccctggaggataagatcgccgacttcaaacggcgcatggctgatattgtctctagaaagaagatggacacgaaacctgccgatccgaccggcatcgaacccgacgatcatctcaaggagcggagctccctgcgctacgggaacgtgcttgacgttaatgctattgacatcgaggaaccttctggacagacagccgattggtataccatcggcgtgtacattatcgggtttacactgcccattatcctcaaagcgctgtatatgctgagcaccagaggacggcagacagtcaaggagaacaaaggcacccgcattagattcaaggacgatacgtcctttgaagacgtgaatgggatccggcgccctaagcacctctacgtttctatgcccaccgcccaaagcacaatgaaagctgaggagctgacccctggaagattccggacaattgtgtgcggcctttttccgacccagatccaggtccgcaacatcatgtcccccgtgatgggcgtgattgggttcagctttttcgccaaggattggcctgacagaatcaaagaatttatggagaaggaatgtcccttcattaaacctgaggtcaagcccggaacgccggctaaagaagttgagatcctgaagcggaataagatttattttatgcagagacaagatgtgctcgacaaaaaccatgtgcctgatatcgacaagctgatcgattacgccgcgtctggcgaccccacatcccctgagaatattgacagccccaacgccccctgggtcttcgcttgcgcccctgatcgctgtccgcctacctgcatctatgtggctgggatggccgaacttggagcctttttctctattctgcaggacatgcggaatacaatcatggcttccaaaaccgttggcaccgcggaggaaaagctcaaaaagaaaagctctttctaccagtcctacctgagacgcacacaaagcatggggattcagctggatcagcggatcatcctcctgtatatgcttgagtggggaaaggaaatggtggaccactttcatctgggcgatgacatggatcccgagctcagatccctggcccaggctcttattgaccaaaaggtcaaagagatctctaaccaggaacccctgaagatttga

SEQ ID NO: 7152 - RNA, 1302 nt, synthetic construct
  misc_feature 1..1302: note = derived and/or modified CDS sequence (opt5) from PUUV(Fusong 900-06)__EF488806.1__N
  source 1..1302: mol_type = other RNA
atgagcgacctgaaggatatccaggaggacattgccagacacgaacaacagctcgtggtcgctcggcagaaactgcgcgatgccgagaaggcggttgaaatggaccccgatgacgtgaacaaaaatacccttcaggctagacaacagacagtgtccgccctggaggataagatcgccgacttcaaacggcgcatggctgatattgtctctagaaagaagatggacacgaaacctgccgatccgaccggcatcgaacccgacgatcatctcaaggagcggagctccctgcgctacgggaacgtgcttgacgttaatgctattgacatcgaggaaccttctggacagacagccgattggtataccatcggcgtgtacattatcgggtttacactgcccattatcctcaaagcgctgtatatgctgagcaccagaggacggcagacagtcaaggagaacaaaggcacccgcattagattcaaggacgatacgtcctttgaagacgtgaatgggatccggcgccctaagcacctctacgtttctatgcccaccgcccaaagcacaatgaaagctgaggagctgacccctggaagattccggacaattgtgtgcggcctttttccgacccagatccaggtccgcaacatcatgtcccccgtgatgggcgtgattgggttcagctttttcgccaaggattggcctgacagaatcaaagaatttatggagaaggaatgtcccttcattaaacctgaggtcaagcccggaacgccggctaaagaagttgagatcctgaagcggaataagatttattttatgcagagacgcgatgtgctcgacaaaaaccatgtgcctgatatcgacaagctgatcgattacgccgcgtctggcgaccccacatcccctgagaatattgacagccccaacgccccctgggtcttcgcttgcgcccctgatcggtgtccgcctacctgcatctatgtggctgggatggccgaacttggagcctttttctctattctgcaagacatgagaaatacaatcatggcttccaaaaccgttggcaccgcggaggaaaagctcaaaaagaaaagctctttctacaagtcctacctgcgccggacacagagcatggggattcagctggatcaaagaatcatcctcctgtatatgcttgagtggggaaaggaaatggtggaccactttcatctgggcgatgacatggatcccgagctccgctccctggcccaggctcttattgaccagaaagtcaaggagatctctaaccaggaacccctgaaaatttga

SEQ ID NO: 7153 - RNA, 1302 nt, synthetic construct
  misc_feature 1..1302: note = derived and/or modified CDS sequence (opt5) from PUUV(Gumboda_98-2)__AM746316.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatcgggtttaccctccccatcattctgaaagccctgtatatgctcagcacgcgcggaagacagaccgtgaaggagaacaaaggcacacggatccgcttcaaggacgatacctcctttgaagacattaatgggatcagacggcctaagcacctgtacgtttctatgcccacagcgcaaagcaccatgaaagccgaggagcttacgcctggacgcttcagaacaattgtgtgcggcctgtttccgacccagatccaggtccggaacattatgtcccccgtgatgggcgtgatcgggttcagctttttcgtcaaggattgggctgaccgcatcagagaatttatggagaaagaatgtcctttcattaagcccgaggttaaacctggaacacccacccaggaaatcgagtttctcaagaaaaataaggtgtatttcatggatcggcaaaacgtgctggagaagaatcatgtcgccgacattgataaacttatcgactacgctgcctctggcgatccgacctcccctgacaacattgaaagccccaatgcgccttgggtgttttcttgcgcccccgacagatgtccccctacatgcatctatgttgctgggatggccgagctgggagctttcttctccatcctccaggatatgcgcaacacgattatggccagcaagaccgtgggcacagccgaagagaaactgaagaaaaagtcttccttttaccagagctacctgcggagaacccaatccatggggatccagctcgaccagcgcattatcctgctttatatgctggaatggggaaaggagatggtcgatcacttccatctcggcgacgatatggacccggagctgcggggccttgctcaggcgctgattgatcaaaaagtgaaggaaatctctaatcaggaccccctcaaaatctga

SEQ ID NO: 7154 - RNA, 1302 nt, synthetic construct
  misc_feature 1..1302: note = derived and/or modified CDS sequence (opt5) from PUUV(Gumboda_98-4)__AM746318.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatcgggtttaccctccccatcattctgaaagccctgtatatgctcagcacgcgcggaagacagaccgtgaaggagaacaaaggcacacggatccgcttcaaggacgatacctcctttgaagacattaatgggatcagacggcctaagcacctgtacgtttctatgcccacagcgcaaagcaccatgaaagccgaggagcttacgcctggacgcttcagaacaattgtgtgcggcctgtttccgacccagatccaggtccggaacattatgtcccccgtgatgggcgtgatcgggttcagctttttcgtcaaggattgggctgaccgcatcagagaatttatggagaaagaatgtcctttcattaagcccgaggttaaacctggaacacccacccaggaaatcgagtttctcaagaaaaataaggtgtatttcatggatcggcaaaacgtgctggacaagaatcatgtcgccgatattgacaaacttatcgattacgctgcctctggcgacccgacctcccctgacaacattgagagccccaatgcgccttgggtgttttcttgcgcccccgatagatgtccccctacatgcatctatgttgctgggatggccgaactgggagctttcttctccatcctccaggacatgcgcaacacgattatggccagcaagaccgtgggcacagccgaggaaaaactgaagaaaaagtcttccttttaccagagctacctgcggagaacccaatccatggggatccagctcgatcagcgcattatcctgctttatatgctggagtggggaaaggaaatggtcgaccacttccatctcggcgatgacatggatccggagctgcggggccttgctcaggcgctgattgaccaaaaagtgaaggagatctctaatcaggatcccctcaaaatctga

SEQ ID NO: 7155 - RNA, 1302 nt, synthetic construct
  misc_feature 1..1302: note = derived and/or modified CDS sequence (opt5) from PUUV(Kamiiso-8Cr-95)__AB010730.1__N
  source 1..1302: mol_type = other RNA
atgagcgacctgaaggatatccaggaggacattaccagacacgaacaacagctcgtggtcgcccggcagaaactgcgcgatgctgagaaggccgttgaaatggaccccgatgacgtgaacaaaaatacacttcaggcgagacaacagacggtgtccgctctggaggataagctcgccgacttcaaacggcgcatggccgatgtcgtgtctagaaagaagatggacaccaaacctgctgatccgacaggcatcgaacccgacgatcatctgaaggagcggagctcccttcgctacgggaacgttctggacgtgaatgccattgacatcgaggaaccttctggacagaccgctgattggtatacaattggcgtctacatcatcgggtttaccctccccattatcctgaaagccctgtatatgctcagcacaagaggacggcagaccgtgaaggagaacaaaggcacgcgcattagattcaaggacgatacctcctttgaagacatcaatgggattcggcgccctaagcacctgtacgtttctatgcccacagcgcaaagcaccatgaaagccgaggagatcacacctggaagattccggaccattgtgtgcggcctttttccgacgcagatccaggtccgcaacatcatgtcccccgtgatgggcgtgattgggttcagctttttcgtcaaggattggcctgaaagaatcaaagagtttatggaaaaggagtgtcccttcattaaacctgaagttaagcccggaacaccggctaaagaggtggagatcctgaagcggaataaggtgtattttatgcagagacaagacgtcctcgataaaaaccatgtgcctgacattgataagctgatcgactacgccgcttctggcgatcccacctcccctgacaatatcgacagccccaacgccccctgggttttcgcgtgcgcccctgatcgctgtccgcccacatgcatttatgtggctgggatggccgaacttggagcctttttctctatcctgcaggacatgcggaataccattatggcttccaaaaccgtcggcacagccgaggaaaagctcaaaaagaaaagctctttctaccagtcctacctgagacgcacgcaaagcatggggatccagctggatcagcggattatcctcctgtatatgcttgagtggggaaaggaaatggtggaccactttcatctgggcgatgacatggatcctgagctcagaggcctggctcaggcgcttatcgaccaaaaggttaaagagatttccaaccaggaacccctgaagatctga

SEQ ID NO: 7156 - RNA, 1302 nt, synthetic construct
  misc_feature 1..1302: note = derived and/or modified CDS sequence (opt5) from PUUV(Mu/07/1219)__KJ994776.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgactacaaaagacggatggccgatgctgtctctcgcaagaagatggacacaaaacctaccgatccgacaggcatcgaacccgacgatcatctgaaggagagaagctcccttcggtatgggaacgtgctggacgttaatgccattgacatcgaggaaccttctggacagaccgctgattggtacacaattggcgtgtatgtcatcgggttcaccctccccatcattctgaaagccctgtacatgctcagcacgcgcggaagacagaccgtgaaggagaacaaaggcacacggatccgctttaaggacgatacctccttcgaagacattaatgggatcagacggcctaagcacctgtatgtttctatgcccacagcgcaaagcaccatgaaagccgaggagcttacgcctggacgctttagaacaattgtgtgcggcctgttcccgacccagatccaggtccggaacattatgtcccccgtgatgggcgtgatcgggtttagcttctttgtcaaggattgggctgaacgcatcagagagttcatggaaaaagagtgtccttttattaagcccgaagttaaacctggaacacccgcccaggaggctgagttcctcaagcggaataaagtgtactttatgcaaagacaggacgtgctggataagaaccatgtcgccgacatcgataaacttattgactatgcggcctctggcgatccgacctcccctgacaatatcgaaagccccaacgctccttgggtgttcgcctgcgctcccgaccgctgtccccctacctgcatttacgttgccgggatggccgagctgggagcgtttttctctatcctccaggatatgcggaatacaatcatggcttccaagacggtgggcaccgccgaagagaagctgaaaaagaaaagctctttctaccaatcctatctgagacgcacacagagcatggggattcagctcgaccagcggatcattctgctttacatgctggaatggggaaaggagatggtcgatcactttcatctcggcgacgatatggacccggagctgagaggccttgctcaagccctgatcgatcagaaggtgaaagaaatttccaaccaggagcccctcaagatctga

SEQ ID NO: 7157 - RNA, 1302 nt, synthetic construct
  misc_feature 1..1302: note = derived and/or modified CDS sequence (opt5) from PUUV(Opina916)__AF294652.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctgtggatccgaccggcatcgaacccgacgatcatctgaaggagagaagctcccttcggtacgggaacgttctggacgtgaatgccattgacatcgaggaaccttctggacagacagctgattggtataccattggcgtctacgtgatcgggtttacactccccatcattctgaaagccctgtatatgctcagcacccgcggaagacagacggttaaggagaacaaaggcacccggatccgcttcaaggacgatacatcctttgaagacattaatgggatcagacggcctaagcacctgtacgtgtctatgcccaccgcgcaaagcacaatgaaagccgaggagcttacccctggacgcttcagaacgattgtctgcggcctgtttccgacacagatccaggtgcggaacattatgtcccccgtgatgggcgtcatcgggttcagctttttcgttaaggattgggctgaacgcatcagagagtttatggaaaaagagtgtcctttcattaagcccgaagtgaaacctggaacccccgcccaggaggctgagtttctcaagaaaaatcggatctatttcatgcaaagacaggaagtgctggacaagaaccatgtcgccgatattgacaaacttatcgattacgcggcctctggcgacccgacatcccctgataatattgagagccccaacgctccttgggtgtttgcctgcgctcccgaccgctgtccccctacctgcatctatgttgccgggatggccgaactgggagctttcttctctatcctccaggacatgcggaataccattatggcgtccaagacagtgggcacggccgaggaaaagctgaaaaagaaaagctctttttaccaatcctacctgagacgcacccagagcatggggatccagctcgatcagcggattatcctgctttatatgctggagtggggaaaggagatggtcgaccacttccatctcggcgatgacatggatccggaactgagaggccttgctcaagccctgattgaccagaaggtgaaagagatctccaaccaggaacccctcaagatctga

SEQ ID NO: 7158 - RNA, 1302 nt, synthetic construct
  misc_feature 1..1302: note = derived and/or modified CDS sequence (opt5) from PUUV(Palbole_98-1)__AM746327.1__N
  source 1..1302: mol_type = other RNA
atgagcgacctgaccgatatccaggaggacattacatgccacgaacaacagctcgtggtcgccagacagaagctgaaagatgctgagaaggccgttgaaatggaccccgatgacgtgaacaaaaatacgcttcaggcgcggcaacagaccgtgtccgctctggaggataagctcgccgacttcaaacgcagaatggccgatgctgtctctcggaagaagatggacacaaaacctaccgatccgacaggcatcgaacccgacgatcatctgaaggagcgcagctcccttagatacgggaacgtgctggacgttaatgccattgacatcgaggaaccttctggacagaccgctgattggtatacaattggcgtgtacgtcatcgggtttaccctccccatcattctgaaagccctgtatatgctcagcacgcggggacgccagaccgtgaaggagaacaaaggcacaagaatccggttcaaggacgatacctcctttgaagacattaatgggatccgcagacctaagcacctgtacgtttctatgcccacagcgcaaagcaccatgaaagccgaggagcttacgcctggacggttccgcacaattgtgtgtggcctgtttccgacccagatccaggtcagaaacattatgtcccccgtgatgggcgtgatcgggttcagctttttcgtcaaggattgggctgaccggatccgcgaatttatggagaaagaatgccctttcattaagcccgaggttaaacctggaacacccacccaggaaatcgagtttctcaagaaaaataaggtgtatttcatggatagacaaaacgtgctggacaagaatcatgtcgccgatattgacaaacttatcgattacgctgcctctggcgacccgacctcccctgacaacattgagagccccaatgcgccttgggtgtttgcctgtgctcccgatcggtgtccccctacatgcatctatgttgccgggatggctgaactgggagccttcttctctatcctccaggacatgagaaacacgattatggcctccaagaccgtgggcacagctgaggaaaaactgaagaaaaagagctctttttaccagtcctacctgcgccggacccaaagcatggggatccagctcgatcagagaattatcctgctttatatgctggagtggggaaaggaaatggtcgaccacttccatctcggcgatgacatggatccggagctgcgcggccttgcgcaggccctgattgaccaaaaagtgaaggagatctccaatcaggatcccctcaaaatctga

SEQ ID NO: 7159 - RNA, 1302 nt, synthetic construct
  misc_feature 1..1302: note = derived and/or modified CDS sequence (opt5) from PUUV(Palbole_98-2)__AM746328.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatcgggtttaccctccccatcattctgaaagccctgtatatgctcagcacgcgcggaagacagaccgtgaaggagaacaaaggcacacggatccgcttcaaggacgatacctcctttgaagacattaatgggatcagacggcctaagcacctgtacgtttctatgcccacagcgcaaagcaccatgaaagccgaggagcttacgcctggacgcttcagaacaattgtgtgcggcctgtttccgacccagatccaggtccggaacattatgtcccccgtgatgggcgtgatcgggttcagctttttcgtcaaggattgggctgaccgcatcagagaatttatggagaaagaatgtcctttcattaagcccgaggttaaacctggaacacccacccaggaaatcgagtttctcaagaaaaataaggtgtatttcatggatcggcaaaacgtgctggacaagaatcatgtcgccgatattgacaaacttatcgattacgctgcctctggcgacccgacctcccctgacaacattgagagccccaatgcgccttgggtgtttgcctgcgctcccgatagatgtccccctacatgcatctatgttgccgggatggctgaactgggagccttcttctctatcctccaggacatgcgcaacacgattatggcctccaagaccgtgggcacagctgaggaaaaactgaagaaaaagagctctttttaccagtcctacctgcggagaacccaaagcatggggatccagctcgatcagcgcattatcctgctttatatgctggagtggggaaaggaaatggtcgaccacttccatctcggcgatgacatggatccggagctgcggggctttgcgcaggcccttattgaccaaaaagtgaaggagatctccaatcaggatcccctgaaaatctga

SEQ ID NO: 7160 - RNA, 1302 nt, synthetic construct
  misc_feature 1..1302: note = derived and/or modified CDS sequence (opt5) from PUUV(Palbole_98-3)__AM746329.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatcgggtttaccctccccatcattctgaaagccctgtatatgctcagcacgcgcggaagacagaccgtgaaggagaacaaaggcacacggatccgcttcaaggacgatacctcctttgaagacattaatgggatcagacggcctaagcacctgtacgtttctatgcccacagcgcaaagcaccatgaaagccgaggagcttacgcctggacgcttcagaacaattgtgtgcggcctgtttccgacccagatccaggtccggaacattatgtcccccgtgatgggcgtgatcgggttcagctttttcgtcaaggattgggctgaccgcatcagagaatttatggagaaagaatgtcctttcattaagcccgaggttaaacctggaacacccacccaggaaatcgagtttctcaagaaaaataaggtgtatttcatggatcggcaaaacgtgctggacaagaatcatgtcgccgatattgacaaacttatcgattacgctgcctctggcgacccgacctcccctgacagcattgagtctcccaacgcgccttgggtgtttgcctgcgctcccgatagatgtccccctacatgcatctatgttgccgggatggctgaactgggagccttcttctccatcctccaggacatgcgcaatacgattatggccagcaagaccgtgggcacagctgaggaaaaactgaagaaaaagtcttccttttaccagagctacctgcggagaacccaatccatggggatccagctcgatcagcgcattatcctgctttatatgctggagtggggaaaggaaatggtcgaccacttccatctcggcgatgacatggatccggagctgcggggccttgcgcaggccctgattgaccaaaaagtgaaggagatctctaaccaggatcccctcaaaatctga

SEQ ID NO: 7161 - RNA, 1302 nt, synthetic construct
  misc_feature 1..1302: note = derived and/or modified CDS sequence (opt5) from PUUV(PUUV/Ardennes/Mg156/2011)__KT247592.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacagatggccgatgctgtctctcggaagaagatggacacaaaacctaccgatccgacaggcatcgaacccgacgatcatctgaaggagcgcagctcccttagatacgggaacgtgctggacgttaatgccattgacatcgaggaaccttctggacagaccgctgattggtatacaattggcgtgtacgtcatcgggtttaccctccccatcattctgaaagccctgtatatgctcagcacgcggggacgccaaaccgtgaaggagaacaaaggcacaagaatccggttcaaggacgatacctcctttgaagacattaatgggatccgcagacctaagcacctgtacgtttctatgcccacagcgcagagcaccatgaaagccgaggagcttacgcctggacggttccgcacaattgtgtgcggcctgtttccgacccagatccaggtcagaaacattatgtcccccgtgatgggcgtgatcgggttcagctttttcgtcaaggattgggctgaccggatccgcgaatttatggagaaagaatgtcctttcattaagcccgaggttaaacctggaacacccgcccaagaagtggagtttctcaagagaaataaaatctatttcatgcagcggcaggatgtgctggacaagaaccatgtcgctgatattgacaaacttatcgattacgccgcgtctggcgacccgacctcccctgacaatattgaggcccccaacgctccttgggtgtttgcctgcgctcccgatagatgtccccctacctgcatctatgttgccgggatggccgaactgggagctttcttcagcatcctccaagacatgcgcaatacaattatggcgtctaagacggtgggcaccgccgaggaaaagctgaaaaagaaatccagcttttaccagtcttacctgcggagaacacagtccatggggatccagctcgatcaacgcattatcctgctttatatgctggagtggggaaaggaaatggtcgaccacttccatctcggcgatgacatggatccggagctgcggggccttgctcaggccctgattgaccagaaggtgaaagagatcagcaaccaggaacccctcaagatctga

SEQ ID NO: 7162 - RNA, 1302 nt, synthetic construct
  misc_feature 1..1302: note = derived and/or modified CDS sequence (opt5) from PUUV(PUUV/Jelgava/Mg136/2008)__JN657230.1__N
  source 1..1302: mol_type = other RNA
atgagcgacctggccgatatccaggaggacattaccagacacgaacaacagctcgtggtcgctcggcagaagctgaaagatgccgagcgcgcggttgaagtggaccccgatgacgtgaacaagaatacacttcaggctagacaacagacggtctccgccctggaggataaactcgccgactacaagcggcgcatggctgatgccgtgtctagaaagaagatggacaccaagcctgctgatccgacaggcatcgaacccgacgatcatctgaaagagcggagctcccttcgctatgggaacgttctggacgtgaatgccattgacatcgaggaaccttctggacagaccgcggattggtacacaattggcgtctatgtgatcgggttcaccctccccatcattctgaaggccctgtacatgctcagcacaagaggacggcagaccgttaaagagaacaagggcacgcgcatcagatttaaagacgatacctccttcgaagacattaatgggatccggcgccctaagcacctgtatgtgtctatgcccacagctcaaagcaccatgaaggccgaggagcttacacctggaagatttcggaccgtcgtgtgcggcctgttcccgacgcagattcaggtgcgcaacatcatgtcccccgtcatgggcgttattgggtttagcttctttgtgaaagattggcctgacagaatcaaggaatttatggagaaagaatctccctttatcaagcctgatgtgaaacccggaacaccggctcaggaggtcgagttcctcaagcggaataaagtgtactttatgaacagacaagacgttctggataagaatcatgtggccgacattgataaacttatcgactatgcggcctccggcgaccctaccagccccgatgacattgaatctcctaacgctccctgggtcttcgcctgtgctcccgatcgctgccctccgacatgtatctacgtggccgggatggccgagctgggagctttcttctccattctccaggacatgcggaataccatcatggcgagcaaaaccgttggcacagccgaagagaagctgaaaaagaaatcttccttctaccagagctatctgagacgcacgcaatccatggggatccagctcgatcagcggattatcctgctttacatgctggaatggggaaaggagatggtggaccactttcatctcggcgatgacatggatcccgaactgagaggccttgctcaggccctgattgaccaaaaggtcaaagagatctctaaccaggagcctctcaagatttga

SEQ ID NO: 7163 - RNA, 1302 nt, synthetic construct
  misc_feature 1..1302: note = derived and/or modified CDS sequence (opt5) from PUUV(PUUV/Jelgava/Mg140/2008)__JN657231.1__N
  source 1..1302: mol_type = other RNA
atgagcgacctggccgatatccaggaggacattaccagacacgaacaacagctcgtggtcgctcggcagaagctgaaagatgccgagcgcgcggttgaagtggaccccgatgacgtgaacaagaatacacttcaggctagacaacagacggtctccgccctggaggataaactcgccgactacaagcggcgcatggctgatgccgtgtctagaaagaagatggacaccaagcctgctgatccgacaggcatcgaacccgacgatcatctgaaagagcggagctcccttcgctatgggaacgttctggacgtgaatgccattgacatcgaggaaccttctggacagaccgcggattggtacacaattggcgtctatgtgatcgggttcaccctccccatcattctgaaggccctgtacatgctcagcacaagaggacggcagaccgttaaagagaacaagggcacgcgcatcagatttaaagacgatacctccttcgaagacattaatgggatccggcgccctaagcacctgtatgtgtctatgcccacagctcaaagcaccatgaaggccgaggagcttacacctggaagatttcggaccgtcgtgtgcggcctgttccatacgcagattcaggtgcgcaacatcatgtccccggtcatgggcgttattgggtttagcttctttgtgaaagattggcccgacagaatcaaggaatttatggagaaagaatgtccttttatcaagcccgatgtgaaacctggaacacccgctcaggaggtcgagttcctcaagcggaataaagtgtactttatgaacagacaagacgttctggataagaatcacgtggccgacattgataaacttatcgactatgcggcctctggcgacccgacctcccctgatgacattgaaagccccaacgctccttgggtcttcgcctgcgctcccgatcgctgtccccctacatgcatctacgtggccgggatggccgagctgggagctttcttctctattctccaggacatgcggaataccatcatggcgtccaaaaccgttggcacagccgaagagaagctgaaaaagaaaagctctttctaccagtcctatctgagacgcacgcaaagcatggggatccagctcgatcagcggattatcctgctttacatgctggaatggggaaaggagatggtggaccattttcacctcggcgatgacatggatccggaactgagaggccttgctcaggccctgattgaccaaaaggtcaaagagatctccaaccaggagcccctcaagatttga

SEQ ID NO: 7164 - RNA, 1302 nt, synthetic construct
  misc_feature 1..1302: note = derived and/or modified CDS sequence (opt5) from PUUV(PUUV/Jura/Mg2/2010)__KT247596.2__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatcgggtttaccctccccatcattctgaaagccctgtatatgctcagcacgcgcggaagacagaccgtgaaggagaacaaaggcacacggatccgcttcaaggacgatacctcctttgaagacattaatgggatcagacggcctaagcacctgtacgtttctatgcccacagcgcaaagcaccatgaaagccgaggagcttacgcctggacgcttcagaacaattgtgtgcggcctgtttccgacccagatccaggtccggaacattatgtcccccgtgatgggcgtgatcgggttcagctttttcgtcaaggattgggctgaccgcatcagagaatttatggagaaagaatgtcctttcattaagcccgagatcaaacctggaacacccgcccaggaagctgagtttctcaagcggaataaaatttatttcatgcaaagacaggatgttctggacaagaaccatgtggccgatatcgacaaacttattgattacgcggcctctggcgacccgacctcccctgacaatatcgagagccccaacgctccttgggtgtttgcctgcgctcccgatcgctgtccccctacctgcatctatgtcgccgggatggccgaactgggagctttcttctctattctccaggacatgcggaatacaatcatggcgtccaagacggtgggcaccgccgaggaaaagctgaaaaagaaaagctctttttaccaatcctacctgagacgcacacagagcatggggattcagctcgatcagcggatcattctgctttatatgctggagtggggaaaggaaatggttgaccacttccatctcggcgatgacatggatccggagctgagaggccttgctcaagccctgatcgaccagaaggtgaaagagatctccaaccaggaacccctcaagatttga

SEQ ID NO: 7165 - RNA, 1302 nt, synthetic construct
  misc_feature 1..1302: note = derived and/or modified CDS sequence (opt5) from PUUV(PUUV/Madona/Mg233/2008)__JN657232.1__N
  source 1..1302: mol_type = other RNA
atgagcgacctggccgatatccaggaggacattaccagacacgaacaacagctcgtggtcgctcggcagaagctgaaagatgccgagcgcgcggttgaagtggaccccgatgacgtgaacaagaatacacttcaggctagacaacagacggtctccgccctggaggataaactcgccgactacaagcggcgcatggctgatgccgtgtctagaaagaagatggacaccaagcctacagatccgaccggcatcgaacccgacgatcatctgaaagagcggagctcccttcgctatgggaacgttctggacgtgaatgctattgacatcgaggaaccttctggacagacagccgattggtacaccattggcgtctatgtgatcagcttcacactccccatcattctgaaggcgctgtacatgctctccaccagagggcggcagacggttaaagagaacaagggaacccgcatcagatttaaagacgatacatctttcgaagacattaatggcatccggcgccctaagcacctgtatgtgagcatgcccaccgcccaatccacaatgaaggctgaggagcttacccctgggagatttcggacgattgtctgcggactgttcccgacacagatccaggtgcgcaacattatgagccccgtgatgggcgtcatcggcttttctttctttgttaaagattggcctgacagaatcaaggagttcatggaaaaagaatgtccctttattaagcctgatgtgaaacccgggaccccggcccaggagatcgagttcctcaagcggaataaagtgtactttatgaacagacaagacgtcctggataagaatcatgtggctgacattgataaacttatcgactatgccgcgtccggagaccctacaagccccgatgacattgaatctcctaacgccccctgggttttcgcttgcgcccccgatcgctgtcctccgacctgcatctacgtggctggcatggccgagctgggggcctttttctccatcctccaggacatgcggaataccattatggctagcaaaacagtcggaacggcggaagagaagctgaaaaagaaatcttccttctaccagagctatctgagacgcacccaatccatgggcatccagctcgatcagcggattatcctgctttacatgctggaatgggggaaggagatggtggaccactttcatctcggagatgacatggatcccgaactgagaggccttgcccaggctctgattgaccaaaaggttaaagagatctctaaccaggagcctctcaagatctga

SEQ ID NO: 7166 - RNA, 1302 nt, synthetic construct
  misc_feature 1..1302: note = derived and/or modified CDS sequence (opt5) from PUUV(PUUV/Orleans/Mg23/2010)__KT247594.1__N
  source 1..1302: mol_type = other RNA
atgagcgacctgaccgatatccaggaggtgattacaagacacgaacaacagctcgtcgttgcccggcagaagctgaaagacgctgagaaggccgtggaaatggatcccgacgatgtgaacaaaaatacgcttcaggcgcgccaacagaccgtctccgctctggaggacaagctcgccgatttcaaaagacggatggccgacgctgtgtctcgcaagaagatggatacaaaacctgccgacccgaccggcatcgaacccgatgaccatctgaaggagagaagctcccttcggtacgggaacgttctggatgtgaatgctattgacatcgaggaaccttctggacagacagccgactggtataccattggcgtctacgtgatcgggtttacactccccatcattctgaaagcgctgtatatgctcagcacccgcggaagacagacggttaaggagaacaaaggcacccggatccgcttcaaggatgacacatcctttgaagatattaatgggatcagacggcctaagcacctgtacgtgtctatgcccaccgcccaaagcacaatgaaagctgaggagcttacccctggacgcttcagaacgattgtctgcggcctgtttccgacacagatccaggtgcggaacattatgtcccccgtgatgggcgtcatcgggttcagctttttcgttaaggactgggccgatcgcatcaaagaatttatggagaaggaatgtcctttcattaaacccgaggtgaagcctggaacccccgtgaaagaagctgagtttctcaagaagaatagagtctatttcatgcagcggcaagacgtgctggataaaaaccatgttgccgacatcgataaacttattgactacgcggccgctggcgatccgacatctcctgacaatatcgagtcccccaacgccccttgggtgtttgcttgcgcccccgacagatgtccccctacctgcatttatgtcgccgggatggctgaactgggagcgttcttcagcatcctccaggatatgcgcaataccatcatggcctctaagacagtgggcacggctgaggaaaagctgaaaaagaagtccagcttttaccagtcttacctgcggagaacccaatccatggggattcagctcgaccagcgcatcattctgctttatatgctggagtggggaaaagaaatggttgatcacttccatctcggcgacgatatggacccggagctgcggggccttgcccaggccctgatcgatcaaaaggtgaaagagattagcaaccaggaacccctcaagatctga

SEQ ID NO: 7167 - RNA, 1302 nt, synthetic construct
  misc_feature 1..1302: note = derived and/or modified CDS sequence (opt5) from PUUV(Tobetsu-60Cr-93)__AB010731.1__N
  source 1..1302: mol_type = other RNA
atgagcgacctgaaggatatccaggaggacattaccagacacgaacaacagctcgtggtcgcccggcagaaactgcgcgatgctgagaaggccgttgaaatggaccccgatgacgtgaacaaaaatacacttcaggcgagacaacagacggtgtccgctctggaggataagctcgccgacttcaaacggcgcatggccgatgtcgtgtctagaaagaagatggacaccaaacctgctgatccgacaggcatcgaacccgacgatcatctgaaggaccggagctcccttcgctacgggaacgttctggacgtgaatgccattgatatcgaggagccttctggacagaccgctgactggtatacaattggcgtctacatcatcgggtttaccctccccattatcctgaaagccctgtatatgctcagcacaagaggacggcagaccgtgaaggaaaacaaaggcacgcgcattagattcaaggatgacacctcctttgaggatatcaatgggattcggcgccctaagcacctgtacgtttctatgcccacagcgcaaagcaccatgaaagccgaagagatcacacctggaagattccggaccattgtgtgcggcctttttccgacgcagatccaggtccgcaacatcatgtcccccgtgatgggcgtgattgggttcagctttttcgtcaaggactggcctgagagaatcaaagaatttatggagaaggaatgtcccttcattaaacctgaggttaagcccggaacaccggctaaagaagtggagatcctgaagcggaataaggtgtattttatgcagagacaagatgtcctcgacaaaaaccatgtgcctgatattgacaagctgatcgattacgccgcttctggcgaccccacctcccctgacaatatcgatagccccaacgccccctgggttttcgcgtgcgcccctgaccgctgtccgcccacatgcatttatgtggctgggatggccgagcttggagcctttttctctatcctgcaggatatgcggaataccattatggcttccaaaaccgtcggcacagccgaagagaagctcaaaaagaaaagctctttctaccagtcctacctgagacgcacgcaaagcatggggatccagctggaccagcggattatcctcctgtatatgcttgaatggggaaaggagatggtggatcactttcatctgggcgacgatatggaccctgaactcagaggcctggctcaggcgcttatcgatcaaaaggttaaagagatttccaaccaggagcccctgaagatctga

SEQ ID NO: 7168 - RNA, 1302 nt, synthetic construct
  misc_feature 1..1302: note = derived and/or modified CDS sequence (opt5) from PUUV(Vranica)__U14137.1__N
  source 1..1302: mol_type = other RNA
atgagcgacctgaccgatatccaggaggacattacaagacacgaacaacagctcgtggtcgcccggcagaagctgaaagatgctgagaaggccgttgaaatgtaccccgacgatgtgaacaaaaatacgcttcaggcgcgccaacagaccgtgtccgctctggaggacaagctcgccgatttcaaaagacggatggccgacgctgtctctcgcaagaagatggatacaaaacctaccgacccgacaggcatcgaacccgatgaccatctgaaggagagaagctcccttcggtatgggaacgtgctggatgttaatgccattgacatcgaggaaccttctggacagaccgctgactggtacacaattggcgtgtatgtcatcgggtttaccctccccatcattctgaaagccctgtacatgctcagcacgcgcggaagacagaccgtgaaggagaacaaaggcacacggtatcgcttcaaggatgacacctcctttgaagatatcaatgggattagacggcctaagcacctgtacgtttctatgcccacagcgcaaagcaccatgaaagccgaggagcttacgcctggacgcttcagaacaatcgtgtgcggcctgtttccgacccagattcaggtccggaacatcatgtcccccgtgatgggcgtgattgggttcagctttttcgtcaaggactgggctgatcgcatcagagaatttatggagaaagaatgtcctttcatcaagcccgaggttaaacctggaacacccacccaggaaattgagtttctcaagaaaaataaggtgtatttcatggaccggcaaaacgtgctggataagaatcatgtcgccgacatcgataaacttattgactacgctgcctctggcgatccgacctcccctgacaacatcgagagccccaatgcgccttgggtgtttgcctgcgctcccgacagatgtccccctacatgcatttacgttgccgggatggctgaactgggagccttcttctctatcctccaggatatgcgcaacacgatcatggcctccaagaccgtgggcacagctgaggaaaaactgaagaaaaagagctctttttatcagtcctacctgcggagaacccaaagcatggggattcagctcgaccagcgcatcattctgctttatatgctggagtggggaaaggaaatggtcgatcacttccatctcggcgacgatatggacccggagctgcggggccttgcgcaggccctgatcgatcaaaaagtgaaggagatttccaatcaggaccccctcaaaatctga

SEQ ID NO: 7169 - RNA, 1302 nt, synthetic construct
  misc_feature 1..1302: note = derived and/or modified CDS sequence (opt5) from PUUV(P360)__L11347.1__N
  source 1..1302: mol_type = other RNA
atgagcgacctgaccgatatccaggaggaaattacaagacacgagcaacagctcgtggtcgcccggcagaagctgaaagacgctgaacgcgccgttgaggtgtaccccgatgacgtgaacaagaatacgcttcaggcgagacaacagaccgtctccgctctggaagataaactcgccgactataagcggcgcatggccgatgctgtgtctcggaaaaagatggacacaaagcctaccgatccgacaggcatcgagcccgacgatcatctgaaagagagaagctcccttcgctacgggaacgttctggacgtgaatgccattgatatcgaagaaccttctggacagaccgctgactggtatacaattggcgtctacgtgatcgggttcaccatccccattatcctcaaggccctgtatatgctgagcacgagaggacggcagaccgttaaagaaaacaagggcacacgcattagatttaaagacgatacctccttcgaggacatcaatgggattcggcgccctaagcacctctacgtgtctatgcccacagcgcaaagcaccatgaaggccgaggaactgacgcctggaagatttcggacaatcgtctgcggccttttcccgacccagattcaggtgcgcaacatcatgtcccccgtgatgggcgtcatcgggtttagcttctttgttaaagattggcctgagaagattagagagttcatggagaaagaatgtccctttatcaagcctgaggtgaaacccggaacaccggctcaggaggtggagttcctgaagcggaatagagtctattttatgacccgccaagacgtgctcgataaaaaccatgttgccgacattgataagctgatcgactacgctgcctctggcgatcctacctcccccgacgatattgaaagccctaatgcgccctgggtgttcgcctgcgctcccgaccggtgtcctccgacatgcatctacgtcgccgggatggctgaacttggagcctttttctctatcctgcaggacatgagaaacacgattatggcctccaagaccgtgggcacagctgaggaaaaactcaagaaaaagagctctttctatcagtcctacctgcgccggacccaaagcatggggatccagctggatcagagaattatcctcctgtatatgcttgagtggggaaaagagatggttgaccactttcatctgggcgatgacatggatcccgaactccgcggcctggcgcagtcccttattgaccaaaaggtgaaggagatctctaatcaggaacctctgaaaatctga

SEQ ID NO: 7170 - RNA, 1302 nt, synthetic construct
  misc_feature 1..1302: note = derived and/or modified CDS sequence (opt5) from PUUV(Aijajarvi/Mg7/05)__GQ339476.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacagatggccgatgctgtctctcggaagaagatggacacaaaacctaccgatccgacaggcatcgaacccgacgatcatctgaaggagcgcagctcccttagatacgggaacgtgctggacgttaatgccattgacatcgaggaaccttctggacagaccgctgattggtatacaattggcgtgtacgtcatcgggtttaccctccccatcattctgaaagccctgtatatgctcagcacgcggggacgccaaaccgtgaaggagaacaaaggcacaagaatccggttcaaggacgatacctcctttgaagacattaatgggatccgcagacctaagcacctgtacgtttctatgcccacagcgcagagcaccatgaaagccgaggagcttacgcctggacggttccgcacaattgtgtgcggcctgtttccgacccagatccaggtcagaaacattatgtcccccgtgatgggcgtgatcgggttcagctttttcgtcaagggatgggctgatcggatccgcgaatttatggagaaagaatgtcctttcattaagcccgaggttaaacctggcacacccacccaagaagtggagtttctcaagaaaaataaggtgtatttcctggacagacagaacgtccttgataagaatcatgtggccgacatcgataaactgattgactacgctgcctctggggatccgacctcccctgacaacatcgagagccccaatgcgccttgggtttttgcctgcgctcccgaccggtgtccccctacatgcatttatgtggccggaatggctgaactcggcgccttcttctctatcctgcaggatatgagaaacacgatcatggcctccaagaccgtcgggacagctgaggaaaaactgaagaaaaagagctctttttaccaatcctacctccgccggacccagagcatgggcattcagctggaccagagaatcattcttctgttcatgctcgagtggggaaaggaaatggtggatcactttcatctgggcgacgatatggacccggagcttcgcgggctggcgcaagccctcatcgatcagaaagttaaggagatttccaatcaggaacccctgaaaatctga

SEQ ID NO: 7171 - RNA, 1302 nt, synthetic construct
  misc_feature 1..1302: note = derived and/or modified CDS sequence (opt5) from PUUV(Bavaria 151/05)__EU439968.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgactacaaaagacggatggccgatgctgtctctcgcaagaagatggacacaaaacctaccgatccgacaggcatcgaacccgacgatcatctgaaggagagaagctcccttcggtatgggaacgtgctggacgttaatgccattgacatcgaggaaccttctggacagaccgctgattggtacacaattggcgtgtatgtcatcgggttcaccctccccatcattctgaaagccctgtacatgctcagcacgcgcggaagacagaccgtgaaggagaacaaaggcacacggatccgctttaaggacgatacctccttcgaagacattaatgggatcagacggcctaagcacctgtatgtttctatgcccacagcgcaaagcaccatgaaagccgaggagcttacgcctggacgctttagaacaattgtgtgcggcctgttcccgacccagatccaggtccggaacattatgtcccccgtgatgggcgtgatcgggtttagcttctttgtcaaggattgggctgaacgcatcagagagttcatggaaaaagagtgtccttttctcaagcccgaaattaaacctggaacacccgcccaggaggctgagttcctgaagaaaaataaggtttactttatgcaacggcaggacgtgcttgataagaaccatgtggccgacatcgataaactgattgactatgcggcctctggcgatccgacctcccctgacaatatcgaaagccccaacgctccttgggtcttcgcctgcgctcccgacagatgtccccctacctgcatttacgtggccgggatggccgagctcggagcgtttttctctatcctgcaggatatgcgcaatacaatcatggcttccaagacggttggcaccgccgaagagaaactgaagaaaaagagctctttctaccaatcctatctccggagaacacagagcatggggattcagctggaccagcgcatcattcttctgtacatgctcgaatggggaaaggagatggtggatcactttcatctgggcgacgatatggacccggagcttcggggcctggctcaagccctcatcgatcagaaagtcaaggaaatttccaaccaggagcccctgaaaatctga

SEQ ID NO: 7172 - RNA, 1302 nt, synthetic construct
  misc_feature 1..1302: note = derived and/or modified CDS sequence (opt5) from PUUV(Bavaria 159/05)__EU439972.1__N
  source 1..1302: mol_type = other RNA
atgagcgacctgaccgatatccacgaggacattacaagacatgaacagcaactcgtggtcgcccggcagaagctgaaagatgctgagaaggccgttgaaatggaccccgatgacgtgaacaaaaatacgcttcaggcgcgccagcaaaccgtgtccgctctggaggataagctcgccgactacaaaagacggatggccgatgctgtctctcgcaagaagatggacacaaaacctaccgatccgacaggcatcgaacccgacgatcacctgaaggagagaagctcccttcggtatgggaacgtgctggacgttaatgccattgacatcgaggaaccttctggacagaccgctgattggtacacaattggcgtgtatgtcatcgggttcaccctccccatcattctgaaagccctgtacatgctcagcacgcgcggaagacagaccgtgaaggagaacaaaggcacacggatccgctttaaggacgatacctccttcgaagacattaatgggatcagacggcctaagcatctgtatgtttctatgcccacagcgcagagcaccatgaaagccgaggagcttacgcctggacgctttagaacaattgtgtgcggcctgttcccgacccaaatccaggtccggaacattatgtcccccgtgatgggcgtgatcgggtttagcttctttgtcaaggattgggctgaacgcatcagagagttcatggaaaaagagtgtccttttattaagcccgaaatcaaacctggaacacccgcccaggaggctgagttcctcaagcggaataaagtttactttatgcagagacaagacgtgctggataagaaccacgtggccgacattgataaacttatcgactatgcggcctctggcgatccgacctcccctgacaatattgaaagccccaacgctccttgggtcttcgcctgcgctcccgaccgctgtccccctacctgcatctacgtggccgggatggccgagctgggagcgtttttctctatcctccaggatatgcggaatacaattatggcttccaagacggttggcaccgccgaagagaagctgaaaaagaaaagctctttctaccagtcctatctgagacgcacacaaagcatggggatccagctcgaccagcggattatcctgctttacatgctggaatggggaaaggagatggtggatcattttcacctcggcgacgatatggacccggagctgagaggccttgctcaggccctgattgatcaaaaggtcaaagaaatctccaaccaggagcccctcaagatctga

SEQ ID NO: 7173 - RNA, 1299 nt, synthetic construct
  misc_feature 1..1299: note = derived and/or modified CDS sequence (opt5) from PUUV(Bavaria CG 33/04)__DQ016430.2__N
  source 1..1299: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgactacaaaagacggatggccgatgctgtctctcgcaagaagatggacacaaaacctaccgatccgacaggcatcgaacccgacgatcatctgaaggagagaagctcccttcggtatgggaacgtgctggacgttaatgccattgacatcgaggaaccttctggacagaccgctgattggtacacaattggcgtgtatgtcatcgggttcaccctccccatcattctgaaagccctgtacatgctcagcacgcgcggaagacagaccgtgaaggagaacaaaggcacacggatccgctttaaggacgatacctccttcgaagacattaatgggatcagacggcctaagcacctgtatgtttctatgcccacagcgcaaagcaccatgaaagccgaggagcttacgcctggacgctttagaacaattgtgtgcggcctgttcccgacccagatccaggtccggaacattatgtcccccgtgatgggcgtgatcgggtttagcttctttgtcaaggattgggctgaacgcatcagagagttcatggaaaaagagtgtccttttattaagcccgaaatcaaacctggaacacccgcccaggaggctgagttcctcaagcggaataaagtttactttatgcaaagacaggacgtgctggataagaaccatgtggccgacattgataaacttatcgactatgcggcctctggcgatccgacctcccctgacaatattgaaagccccaacgctccttgggtcttcgcctgcgctcccgaccgctgtccccctacctgcatctacgtggccgggatggccgagctgggagctttttctatcctccaggatatgcggaatacaattatggcgtccaagacggttggcaccgccgaagagaagctgaaaaagaaaagctctttctaccaatcctatctgagacgcacacagagcatggggatccagctcgaccagcggattatcctgctttacatgctggaatggggaaaggagatggtggatcacttccatctcggcgacgatatggacccggagctgagaggccttgctcaagccctgattgatcagaaggtcaaagaaatctccaaccaggagcccctcaagatctga

SEQ ID NO: 7174 - RNA, 1302 nt, synthetic construct
  misc_feature 1..1302: note = derived and/or modified CDS sequence (opt5) from PUUV(Bavaria CG 34/04)__AY954723.2__N
  source 1..1302: mol_type = other RNA
atgagcgacctgaccgatatccaggaggacattacaagacacgaacaacagctcgtggtcgcccggcagaagctgaaagatgctggcaaggccgttgagatggaccccgatgacgtgaacaaaaatacgcttcaggcgcgccaacagaccgtgtccgctctggaagataagctcgccgactacaaaagacggatggccgatgctgtctctcgcaagaagatggacacaaaacctaccgatccgacagggatcgagcccgacgatcatctgaaggaaagaagctcccttcggtatggaaacgtgctggacgttaatgccattgacatcgaggagccttctggccagaccgctgattggtacacaattggggtgtatgtcatcggattcaccctccccatcattctgaaagccctgtacatgctcagcacgcgcggcagacagaccgtgaaggaaaacaaagggacacggatccgctttaaggacgatacctccttcgaggacattaatggaatcagacggcctaagcacctgtatgtttctatgcccacagcgcaaagcaccatgaaagccgaggaacttacgcctggccgctttagaacaattgtgtgcggcctgttcccgacccagatccaggtccggaacattatgtcccccgtgatgggggtgatcggatttagcttctttgtcaaggattgggctgagcgcatcagagaatttatggagaaagaatgtccttttattaagcccgagatgaaacctggcacacccgcccaggaagctgagttcctcaagcggaataaagtttactttatgcaaagacaggacgtgctggataagaaccatgtggccgacatcgataaacttattgactatgcggcctctggggatccgacctcccctgacaatatcgagagccccaacgctccttgggtcttcgcctgcgctcccgaccgctgtccccctacctgcatttacgtggccggaatggccgaactgggcgctttcttctctatcctccaggatatgcggaatacaatcatggcgtccaagacggttgggaccgccgaggaaaagctgaaaaagaaaagctctttctaccaatcctatctgagacgcacacagagcatgggcattcagctcgaccagcggatcattctgctttacatgctggagtggggaaaggaaatggtggatcactttcatctcggcgacgatatggacccggagctgagagggcttgctcaagccctgatcgatcagaaggtcaaagagatttccaaccaggaacccctcaagatctga

SEQ ID NO: 7175 - RNA, 1302 nt, synthetic construct
  misc_feature 1..1302: note = derived and/or modified CDS sequence (opt5) from PUUV(Bavaria CG 41/04)__DQ016432.2__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataacctcgccgactacaagagacggatggccgatgctgtctctcgcaaaaagatggacacaaagcctaccgatccgacaggcatcgaacccgacgatcatctgaaagagagaagctcccttcggtatgggaatgtgctggacgttaacgccattgacatcgaggaaccttctggacagaccgctgattggtacacaattggcgtgtatgtcatcgggttcaccctccccatcattctgaaggccctgtacatgctcagcacgcgcggaagacagaccgtgaaagagaataagggcacacggatccgctttaaagacgatacctccttcgaagacattaacgggatcagacggcctaagcacctgtatgtttctatgcccacagcgcaaagcaccatgaaggccgaggagcttacgcctggacgctttagaacaattgtgtgcggcctgttcccgacccagatccaggtccggaatattatgtcccccgtgatgggcgtgatcgggtttagcttctttgtcaaagattgggctgaacgcatcagagagttcatggaaaaggagtgtccttttattaaacccgaaatgaagcctggaacacccgcccaggaggctgagttcctcaaacggaacaaggtttactttatgcaaagacaggacgtgctggataaaaatcatgtggccgacatcgataaacttattgactatgcggcctctggcgatccgacctcccctgacaacatcgaaagccccaatgctccttgggtcttcgcctgcgctcccgaccgctgtccccctacctgcatttacgtggccgggatggccgagctgggagcgtttttctctatcctccaggatatgcggaacacaatcatggcttccaagacggttggcaccgccgaagagaagctgaagaaaaagagctctttctaccaatcctatctgagacgcacacagagcatggggattcagctcgaccagcggatcattctgctttacatgctggaatggggaaaagagatggtggatcactttcatctcggcgacgatatggacccggagctgagaggccttgctcaagccctgatcgatcagaaggtcaaggaaatttccaatcaggagcccctcaaaatctga

SEQ ID NO: 7176 - RNA, 1302 nt, synthetic construct
  misc_feature 1..1302: note = derived and/or modified CDS sequence (opt5) from PUUV(Bavaria CG 9/04)__AY954722.2__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgactacaaaagacggatggccgatgctgtctctcgcaagaagatggacacaaaacctaccgatccgacaggcatcgaacccgacgatcatctgaaggagagaagctcccttcggtatgggaacgtgctggacgttaatgccattgacatcgaggaaccttctggacagaccgctgattggtacacaattggcgtgtatgtcatcgggttcaccctccccatcattctgaaagccctgtacatgctcagcacgcgcggaagacagaccgtgaaggagaacaaaggcacacggatccgctttaaggacgatacctccttcgaagacattaatgggatcagacggcctaagcacctgtatgtttctatgcccacagcgcaaagcaccatgaaagccgaggagcttacgcctggacgctttagaacaattgtgtgcggcctgttcccgacccagatccaggtccggaacattatgtcccccgtgatgggcgtgatcgggtttagcttctttgtcaaggattgggctgaacgcatcagagagttcatggaaaaagagtgtccttttattaagcccgaaatgaaacctggaatccccgcccaggaggctgagttcctcaagcggaataaagtttactttatgcaaagacaggacgtgctggataagaaccatgtggccgacattgataaacttatcgactatgcggcctctggcgatccgacatcccctgacaatattgaaagccccaacgctccttgggtcttcgcctgcgctcccgaccgctgtccccctacctgcatctacgtggccgggatggccgagctgggagcgtttttctctatcctccaggatatgcggaataccattatggcttccaagacagttggcacggccgaagagaagctgaaaaagaaaagctctttctaccaatcctatctgagacgcacccagagcatggggatccagctcgaccagcggattatcctgctttacatgctggaatggggaaaggagatggtggatcactttcatctcggcgacgatatggacccggagctgagaggccttgctcaagccctgattgatcagaaggtcaaagaaatctccaaccaggagcccctcaagatctga

SEQ ID NO: 7177 - RNA, 1302 nt, synthetic construct
  misc_feature 1..1302: note = derived and/or modified CDS sequence (opt5) from PUUV(Bergsjobo/Mg25/05)__GQ339483.1__N
  source 1..1302: mol_type = other RNA
atgagcgacctggccgatatccaggacgagattaccagacacgaacaacagctcgtggctgcccggcagaagctgaaagatgcggagcgcgctgtcgaagttgaccccgatgacgtgaacaagaatacacttcaggccagacaacagacggtgtccgccctggaggataaactcgctgacttcaagcggcgcatggccgatgctgtctctagaaagaagatggacaccaagcctacagatccgaccggcatcgaacccgacgatcatctgaaagagcggagctcccttcgctacgggaacgtgctggacgttaatgccattgacatcgaggaaccttctggacagacagcggattggtataccattggcgtgtacgtcatcgggtttacactccccatcattctgaaggccctgtatatgctcagcaccagaggacggcagacggtgaaagagaacaagggcacccgcatcagattcaaagacgatacatcctttgaagacattaatgggatccggcgccctaagcacctgtacgtttctatgcccaccgctcaaagcacaatgaaggccgaggagcttacccctggaagattccggacgattgtgtgcggcctgtttccgacacagatccaggtccgcaacattatgtcccccgtgatgggcgtgatcgggttcagctttttcgtcaaagattgggctgaaagaatccgggagtttatggaaaaggagtgtcctttcattaaacccgaagttaagcctggaacccccgcccaggaggtggagtttctcaaaaagaataaaatctatttcatgcaaagacaggacgtgctggataagaaccatgtcgcggacattgataaacttatcgactacgccgcttctggcgatccgacatcccctgacaatattgaaagccccaacgccccttgggtgtttgcttgcgcccccgaccgctgtccccctacctgcatctatgttgccgggatggctgagctgggagcgttcttctctatcctccaggatatgcggaataccattatggcctccaaaacagtgggcacggctgaagagaagctgaaaaagaaaagctctttttaccaatcctacctgagacgcacccagagcatggggatccagctcgaccagcggattatcctgctttatatgctggaatggggaaaggagatggtcgatcacttccatctcggcgacgatatggacccggagctgagaggccttgcccaagccctgattgatcagaaggtgaaagaaatctccaaccaggagcccctcaagatctga

SEQ ID NO: 7178 - RNA, 1302 nt, synthetic construct
  misc_feature 1..1302: note = derived and/or modified CDS sequence (opt5) from PUUV(CG14444)__AJ277075.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacagatggccgatgctgtctctcggaagaagatggacacaaaacctaccgatccgacaggcatcgaacccgacgatcatctgaaggagcgcagctcccttagatacgggaacgtgctggacgttaatgccattgacatcgaggaaccttctggacagaccgctgattggtatacaattggcgtgtacgtcatcgggtttaccctccccatcattctgaaagccctgtatatgctcagcacgcggggacgccaaaccgtgaaggagaacaaaggcacaagaatccggttcaaggacgatacctcctttgaagacattaatgggatccgcagacctaagcacctgtacgtttctatgcccacagcgcagagcaccatgaaagccgaggagcttacgcctggacggttccgcacaattgtgtgcggcctgtttccgacccagatccaggtcagaaacattatgtcccccgtgatgggcgtgatcgggttcagctttttcgtcaaggattgggctgaccggatccgcgaatttatggagaaagaatgtcctttcattaagcccgaggttaaacctggaacacccgcccaagaagctgagtttctcaagagaaataaaatctatttcatgcagcggcaggaggtgctggataagaaccatgtggccgacattgataaacttatcgactacgcggcctctggcgatccgacctcccctgacaatattgaagctcccaacgccccttgggtctttgcttgcgcccccgacagatgtccccctacctgcatctatgtggccgggatggctgagctgggagcgttcttcagcatcctccaagatatgcgcaatacaattatggcctctaagacggttggcaccgctgaagagaagctgaaaaagaaatccagcttttaccagtcttacctgcggagaacacagtccatggggatccagctcgaccaacgcattatcctgctttatatgctggaatggggaaaggagatggtggatcacttccatctcggcgacgatatggacccggagctgcggggccttgcccaggccctgattgatcagaaggtcaaagaaatcagcaaccaggagcccctcaagatctga

SEQ ID NO: 7179 - RNA, 1302 nt, synthetic construct
  misc_feature 1..1302: note = derived and/or modified CDS sequence (opt5) from PUUV(CG14445)__AJ277076.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacagatggccgatgctgtctctcggaagaagatggacacaaaacctaccgatccgacaggcatcgaacccgacgatcatctgaaggagcgcagctcccttagatacgggaacgtgctggacgttaatgccattgacatcgaggaaccttctggacagaccgctgattggtatacaattggcgtgtacgtcatcgggtttaccctccccatcattctgaaagccctgtatatgctcagcacgcggggacgccaaaccgtgaaggagaacaaaggcacaagaatccggttcaaggacgatacctcctttgaagacattaatgggatccgcagacctaagcacctgtacgtttctatgcccacagcgcagagcaccatgaaagccgaggagcttacgcctggacggttccgcacaattgtgtgcggcctgtttccgacccagatccaggtcagaaacattatgtcccccgtgatgggcgtgatcgggttcagctttttcgtcaaggattgggctgaccggatccgcgaatttatggagaaagaatgtcctttcattaagcccgaggttaaacctggaacacccgcccaagaagctgagtttctcaagagaaatatcatttatttcatgcagcggcaggaggtgctggataaaaaccatgtggccgacatcgataaacttattgactacgcggcctctggcgatccgacctcccctgacaatatcgaagctcccaacgccccttgggtctttgcttgcgcccccgacagatgtccccctacctgcatctatgtggccgggatggctgagctgggagcgttcttcagcattctccaagatatgcgcaatacaatcatggcctctaagacggttggcaccgctgaagagaagctgaagaaaaagtccagcttttaccagtcttacctgcggagaacacagtccatggggattcagctcgaccaacgcatcattctgctttatatgctggaatggggaaaagagatggtggatcacttccatctcggcgacgatatggacccggagctgcggggccttgcccaggccctgatcgatcagaaggtcaaggaaatcagcaaccaggagcccctcaaaatttga

SEQ ID NO: 7180 - RNA, 1302 nt, synthetic construct
  misc_feature 1..1302: note = derived and/or modified CDS sequence (opt5) from PUUV(CG1820/POR)__KT885052.1__N
  source 1..1302: mol_type = other RNA
atgagcgacctgaccgatatccaggaggaaattacaagacacgagcaacagctcgtggtcgcccggcagaagctgaaagacgctgaacgcgccgttgaggtggatcccgacgatgtgaacaagtccacgcttcaggcgagacaacagaccgtctctgctctggaagacaaactcgccgattacaagcggcgcatggccgacgctgtgagccggaaaaagatggatacaaagcctaccgacccgacaggcatcgagcccgatgaccatctgaaagagagatcctctcttcgctatgggaatgttctggatgtgaacgccattgacatcgaagaacctagcggacagaccgctgactggtacacaattggcgtctatgtgatcgggttcaccatccccattatcctcaaggccctgtacatgctgtccacgagaggacggcagaccgttaaagaaaataagggcacacgcattagatttaaagatgacacctctttcgaggatatcaacgggattcggcgccctaagcacctctatgtgagcatgcccacagcgcaatccaccatgaaggccgaggaactgacgcctggaagatttcggacaatcgtctgcggccttttcccgacccagattcaggtgcgcaatatcatgagccccgtgatgggcgtcatcgggttttctttctttgttaaagactggcctgagaagattagagagttcatggagaaagaatgtccctttatcaagcctgaggtgaaacccggaacaccggctcaggaggtggagttcctgaagcggaacagagtctactttatgacccgccaagatgtgctcgacaaaaatcatgttgccgatattgacaagctgatcgattatgctgcctccggcgaccctaccagccccgatgacattgaatctcctaacgcgccctgggtgttcgcctgcgctcccgaccggtgtcctccgacatgcatctacgtcgccgggatggctgaacttggagcctttttctccatcctgcaggatatgagaaatacgattatggccagcaagaccgtgggcacagctgaggaaaaactcaagaaaaagtcttccttctaccagagctatctgcgccggacccaatccatggggatccagctggaccagagaattatcctcctgtacatgcttgagtggggaaaagagatggttgatcactttcatctgggcgacgatatggaccccgaactccgcggcctggcgcagtctcttattgatcaaaaggtgaaggagatcagcaaccaggaacctctgaaaatctga

SEQ ID NO: 7181 - RNA, 1302 nt, synthetic construct
  misc_feature 1..1302: note = derived and/or modified CDS sequence (opt5) from PUUV(Couvin/59Cg/97)__AJ277034.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacagatggccgatgctgtctctcggaagaagatggacacaaaacctaccgatccgacaggcatcgaacccgacgatcatctgaaggagcgcagctcccttagatacgggaacgtgctggacgttaatgccattgacatcgaggaaccttctggacagaccgctgattggtatacaattggcgtgtacgtcatcgggtttaccctccccatcattctgaaagccctgtatatgctcagcacgcggggacgccaaaccgtgaaggagaacaaaggcacaagaatccggttcaaggacgatacctcctttgaagacattaatgggatccgcagacctaagcacctgtacgtttctatgcccacagcgcagagcaccatgaaagccgaggagcttacgcctggacggttccgcacaattgtgtgcggcctgtttccgacccagatccaggtcagaaacattatgtcccccgtgatgggcgtgatcgggttcagctttttcgtcaaggattgggctgaccggatccgcgaatttatggagaaagaatgtcctttcattaagcccgaggttaaacctggaacacccgcccaagaagctgagtttctcaagagaaataaaatctatttcatgcagcggcaggatgtgctggacaagaaccatgtggccgatattgacaaacttatcgattacgcggcctctggcgacccgacctcccctgacaatattgaggctcccaacgccccttgggtctttgcttgcgcccccgatagatgtccccctacctgcatctatgtggccgggatggctgaactgggagcgttcttcagcatcctccaagacatgcgcaatacaattatggcctctaagacggttggcaccgctgaggaaaagctgaaaaagaaatccagcttttaccagtcttacctgcggagaacacagtccatggggatccagctcgatcaacgcattatcctgctttatatgctggagtggggaaaggaaatggtggaccacttccatctcggcgatgacatggatccggagctgcggggccttgcccaggccctgattgaccagaaggtcaaagagatcagcaaccaggaacccctcaagatctga

SEQ ID NO: 7182 - RNA, 1302 nt, synthetic construct
  misc_feature 1..1302: note = derived and/or modified CDS sequence (opt5) from PUUV(Evo/12Cg/93)__Z30702.1__N
  source 1..1302: mol_type = other RNA
atgagcgacctgaccgatatccaggaggacattacaagacacgaacaacagctcgtggtcgcccggcagaagctgaaagatgctgagcgcgccgttgaagtggaccccgatgacgtgaacaagaatacgcttcaggcgagacaacagaccgtctccgctctggaggataaactcgccgactacaagcggcgcatggccgatgctgtgtctcggaaaaagatggacacaaagcctaccgatccgacaggcatcgaacccgacgatcatctgaaagagcggagctcccttcgctatgggaacgttctggacgtgaatgccattgacatcgaggaaccttctggacagaccgctgattggtacacaattggcgtctatgtgatcgggttcaccatccccattatcctcaaggccctgtacatgctgagcacgagaggacggcagaccgttaaagagaacaagggcacacgcattagatttaaagacgatacctccttcgaagacatcaatgggattcggcgccctaagcacctctatgtgtctatgcccacagcgcaaagcaccatgaaggccgaggagctgacgcctggaagatttcggacaatcgtctgcggccttttcccgacccagattcaggtgcgcaacatcatgtcccccgtgatgggcgtcatcgggtttagcttctttgttaaagattggcctgaaagaattagagagttcatggaaaaggagtgtccctttatcaaacctgaaattaagcccggaacaccggctcaggagatggagatgctgaaaagaaataagatctacttcatgcaacgccaggacgtgctcgataaaaaccatgtggccgacattgataagctgatcgactatgctgcctctggcgatcctacctcccccgacaatatcgacagccctaacgcgccctgggtctttgcctgcgctcccgatcggtgtcctccgacctgcatttacgtggccgggatggctgaacttggagccttcttttctatcctgcaggacatgagaaatacaattatggcctccaagacggttggcaccgctgaggaaaaactccgcaagaaaagctctttctaccaatcctatctgcggagaacacagagcatggggatccagctggatcagcgcattatcctcctgttcatgcttgagtggggaaaggaaatggtggaccactttcatctgggcgatgacatggatcccgagctccggggcctggcgcaagcccttatcgaccagaaagtcaaggagatttccaaccaggaacctctgaagatctga

SEQ ID NO: 7183 - RNA, 1302 nt, synthetic construct
  misc_feature 1..1302: note = derived and/or modified CDS sequence (opt5) from PUUV(Evo/14Cg/93)__Z30704.1__N
  source 1..1302: mol_type = other RNA
atgagcgacctgaccgatatccaggaggacattacaagacacgaacaacagctcgtggtcgcccggcagaagctgaaagatgctgagcgcgccgttgaagtggaccccgatgacgtgaacaagaatacgcttcaggcgagacaacagaccgtctccgctctggaggataaactcgccaactacaagcggcgcatggccgacgctgtgtctcggaaaaagatggatacaaagcctaccgacccgacaggcatcgaacccgatgaccatctgaaagagcggagctcccttcgctatgggaatgttctggatgtgaacgccattgacatcgaggaaccttctggacagaccgctgactggtacacaattggcgtctatgtgatcgggttcaccatccccattatcctcaaggccctgtacatgctgagcacgagaggacggcagaccgttaaagagaataagggcacacgcattagatttaaagatgacacctccttcgaagatatcaacgggattcggcgccctaagcacctctatgtgtctatgcccacagcgcaaagcaccatgaaggccgaggagctgacgcctggaagatttcggacaatcgtctgcggccttttcccgacccagattcaggtgcgcaatatcatgtcccccgtgatgggcgtcatcgggtttagcttctttgttaaagactggcctgaaagaattagagagttcatggaaaaggagtgtccctttatcaaacctgaaattaagcccggaacaccggctcaggagatggagatgctgaaaagaaacaagatctacttcatgcaacgccaggatgtgctcgacaaaaatcatgtggccgatattgacaagctgatcgattatgctgcctctggcgggcctacctcccccgacaacatcgatagccctaatgcgccctgggtctttgcctgcgctcccgaccggtgtcctccgacctgcatttacgtggccggaatggctgaacttggcgccttcttttctatcctgcaggacatgagaaacacaattatggcctccaagacggttgggaccgctgaggaaaaactcaagaaaaagagctctttctaccaatcctatctgcgccggacacagagcatgggaatccagctggatcagagaattatcctcctgttcatgcttgagtggggcaaagaaatggtggaccactttcatctgggcgatgacatggatcccgagctccgcgggctggcgcaagcccttatcgaccagaaggtcaaggagatttccaatcaggaacctctgaaaatctga

SEQ ID NO: 7184 - RNA, 1302 nt, synthetic construct
  misc_feature 1..1302: note = derived and/or modified CDS sequence (opt5) from PUUV(Evo/15Cg/93)__Z30705.1__N
  source 1..1302: mol_type = other RNA
atgagcgacctgaccgatatccaggaggacattacaagacacgaacaacagctcgtggtcgcccggcagggcctgaaggatgctgagcgcgccgttgaagtggaccccgatgacgtgaacaaaaatgcgcttcaggctagacaacagacggtctccgccctggaggataagctcgccgactacaaacggcgcatggctgatgccgtgtctagaaagaaaatggacaccaagcctacagatccgaccgggatcgaacccgacgatcatctgaaggagcggagctcccttcgctatggaaacgttttcgacgtgaatgctattgacatcgaggaaccttctggccagacagccgattggtacaccattggggtctatgtgatcggatttacaatccccattatcctgaaagcgctctacatgctgagcaccagaggccggcagacggttaaggagaacaaagggacccgcattagattcaaggacgatacatcctttgaagacatcaatggaattagacgccctaaacacctgtatgtgtctatgcccaccgcccaaagcacaatgaaggctgaggagctcacccctggcagattccggacgatcgtctgcggcctgtttccgacacagattcaggtgcgcaacatcatgtcccccgtgatgggggtcatcggattcagctttttcgttaaggattggcctgaacggattcgggagtttatggaaaaagagtgtcccttcatcaagcctgaaattaaacccggcaccccggcccaggagatggagatgcttaagagaaataaaatctactttatgcaacgccaggacgtgctggataagaaccatgtggctgacattgataaactcatcgactatgccgcgtctggggatcctacatcccccgacaatatcgacagccctaacgccccctgggtcttcgcttgcgcccccgatcggtgtcctccgacctgcatttacgtggctggaatggccgaactgggcgcctttttctctatccttcaggacatgagaaataccattatggcttccaagacagttgggacggcggaggaaaagctgaaaaagaaaagctctttctaccaatcctatctccgccggacccagagcatgggaatccagctggatcagagaattatcctgctctttatgctggagtggggcaaggaaatggtggaccacttccatcttggcgatgacatggatcccgagctgcgcgggctcgcccaagctctgatcgaccagaaagtcaaggagatttccaaccaggaacctcttaagatctga

SEQ ID NO: 7185 - RNA, 1302 nt, synthetic construct
  misc_feature 1..1302: note = derived and/or modified CDS sequence (opt5) from PUUV(Faboviken/Mg26/05)__GQ339484.1__N
  source 1..1302: mol_type = other RNA
atgagcgacctggccgatatccaggacgagattaccagacacgaacaacagctcgtggctgcccggcagaagctgaaagatgcggagcgcgctgtcgaaatggaccccgatgacgttaacaagaatacacttcaggccagacaacagacggtgtccgccctggaggataaactcgctgacttcaagcggcgcatggccgatgctgtgtctagaaagaagatggacaccaagcctacagatccgaccggcatcgaacccgacgatcatctgaaagagattagctcccttcggtacgggaacgtcctggacgtgaatgccatcgacattgaggaaccttctggacagacagcggattggtataccatcggcgtttacgtgatcgggtttacactccccattatcctgaaggccctgtatatgctcagcacccgcggaagacagacggtcaaagagaacaagggcacccggattcgcttcaaagacgatacatcctttgaagacatcaatgggattagacggcctaagcacctgtacgtgtctatgcccaccgctcaaagcacaatgaaggccgaggagcttacccctggacgcttcagaacgatcgtttgcggcctgtttccgacacagattcaggtgcggaacatcatgtcccccgtcatgggcgtgatcgggttcagctttttcgtgaaagattgggctgaacgcattagagagtttatggaaaaggagtgtcctttcatcaaacccgaagtcaagcctggaacccccgcccaggaggttgagtttctcaaaaagaataaaatttatttcatgcaacggcaggacgtgctggataagaaccatgtggcggacatcgataaacttattgactacgccgcttctggcgatccgacatcccctgacaatatcgaaagccccaacgccccttgggtctttgcttgcgcccccgacagatgtccccctacctgcatctatgtggccgggatggctgagctgggagcgttcttctctattctccaggatatgcgcaataccatcatggcctccaaaacagttggcacggctgaagagaagctgaaaaagaaaagctctttttaccaatcctacctgcggagaacccagagcatggggattcagctcgaccagcgcatcattctgctttatatgctggaatggggaaaggagatggtggatcacttccatctcggcgacgatatggacccggagctgcggggccttgcccaagccctgatcgatcagaaggtcaaagaaatctccaaccaggagcccctcaagatttga

SEQ ID NO: 7186 - RNA, 1302 nt, synthetic construct
  misc_feature 1..1302: note = derived and/or modified CDS sequence (opt5) from PUUV(Fyn)__AJ238791.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatcgggtttaccctccccatcattctgaaagccctgtatatgctcagcacgcgcggaagacagaccgtgaaggagaacaaaggcacacggatccgcttcaaggacgatacctcctttgaagacattaatgggatcagacggcctaagcacctgtacgtttctatgcccacagcgcaaagcaccatgaaagccgaggagcttacgcctggacgcttcagaacaattgtgtgcggcctgtttccgacccagatccaggtccggaacattatgtcccccgtgatgggcgtgatcgggttcagctttttcgtcaaggattgggctgaacgcatcagagagtttatggaaaaagagtgtcctttcattaagcccgaactcaaacctggaacaaatgcccaggaggctgagtttctgaagaaaaaccgggtttatttccttaatagacaagacgtgctggataagaaccatgtggccgacatcgataagctcattgactacgcggcctctggcgatcccacctccccggacaatatcgaagctcctaacgccccctgggtctttagctgcgctcctgaccgctgtccccctacctgcatttatgtggccgggatggccgagctgggagctttcttctctatcctgcaggatatgcggaatacaatcatggcgtccaaaacggttggcaccgccgaagagaagctcaaaaagaaaagctctttttaccagtcctacctgagacgcacacaaagcatggggattcagcttgaccagcggatcattctgctctatatgctggaatggggaaaggagatggtggatcacttccatcttggcgacgatatggaccccgagctgagaggcctcgctcaggccctgatcgatcaaaaggtcaaagaaatttccaaccaggagccgctgaagatctga

SEQ ID NO: 7187 - RNA, 1302 nt, synthetic construct
  misc_feature 1..1302: note = derived and/or modified CDS sequence (opt5) from PUUV(Fyn131)__AJ278093.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttgaggcgcgccagcaaaccgtgtccgctctggaagataagctcgccgacttcaaaagacggatgacagatgccgtctctcgcaagaagatggacaccaaacctacagatccgaccggcatcgagcccgacgatcatctgaaggagagaagctcccttcggtacgggaacgtgctggacgttaatgctattgacatcgaggaaccttctggacagacagccgattggtataccattggcgtgtacgtcatcgggtttacgctccccatcattctgaaagctctgtatatgctcagcacccgcggaagacagacagtgaaggaaaacaaaggcacccggatccgcttcaaggacgatacatcctttgaggacattaatgggatcagacggcctaagcacctgtacgtttctatgcccaccgcccctagcacgatgaaagcggaggaacttacaccgggacgcttcagaaccattgtgtgcggcctgtttcccacacagatccaagtccggaacattatgtcccctgtgatgggcgtgatcgggagctctttctttgtcaaggattgggccgaccgcatcagagagttcatggaaaaagagtgtccctttgttaagcctgaactcaaacccggaaccaatgctcaggaggccgagttcctgaagaaaaaccgggtgtattttatgaatagacaggatgtgcttgacaagaaccatgtcgctgatattgacaagctgatcgattacgccgcgtccggcgacccgacctgccctgacaatattgaagcccccaacgctccttgggggttcgcctgtgctccccaccgctgtccccctacatgcatctatgtggccggaatggccgagctcggcgcgtttttcagcattctgcaggatatgcggaatacgatcatggcttctaaaaccgttgggacagccgaagagaagctgaaaaagaaatccagcttctaccaatcttacctcagacgcacccagtccatgggaatccagctggaccaacggattatccttctgtatatgctcgaatggggcagagagatggtggatcattttcacctgggcgacgatatggacccggagcttcgcgggctggctcaggccctcattaaccagaaggtcaaggaaatcagcaatcaggagcccctgaaaatttga

SEQ ID NO: 7188 - RNA, 1302 nt, synthetic construct
  misc_feature 1..1302: note = derived and/or modified CDS sequence (opt5) from PUUV(Fyn47)__AJ278092.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatcgggtttaccctccccatcattctgaaagccctgtatatgctcagcacgcgcggaagacagaccgtgaaggagaacaaaggcacacggatccgcttcaaggacgatacctcctttgaagacattaatgggatcagacggcctaagcacctgtacgtttctatgcccacagcgcctagcaccatgaaagccgaggagcttacgccgggacgcttcagaacaattgtgtgcggcctgtttcccacccaaatccaggtccggaagattatgtcccctgtgatgggcgtgatcgggttcagctttttcgtcaaagattgggttgaacgcatcagagagtttatggaaaaggagtgtcccttcgtgaaacctgaactcaagcccggaacaaacgctcaggaggccgagtttctgaaaaagaatcgggtgtatttcatgaacagacaggacgtccttgataagaatcatgtggctgacattgataaactgatcgactacgccgcgtctggcgatccgacctcccctgacaacattgaagcccccaatgctccttgggtttttgcctgcgctccccaccgctgtccccctacctgcatctatgtggccgggatggccgagctcggagctttcttcagcattctgcaagacatgcggaacgcgatcatggcctctaagacagtcggcacggctgaagagaaactgaagaaaaagtccagcttttaccagtcttacctcagacgcacccagtccgtggggatccaactggatcagcggattatccttctgtatatgctcgaatggggaagagagatggttgaccatttccacctgggcgatgacatggatccggagcttcgcggcctggcccaggccctcattgaccagaaggtgaaagaaatcagcaatcaagagcccctgaagatttga

SEQ ID NO: 7189 - RNA, 1302 nt, synthetic construct
  misc_feature 1..1302: note = derived and/or modified CDS sequence (opt5) from PUUV(Gomselga)__AJ238790.1__N
  source 1..1302: mol_type = other RNA
atgagcgacctgaccgatatccaggaggacattacaagacacgaacaacagctcgtggtcgcccggcagaagctgaaagatgctgagcgcgccgttgaagtggaccccgatgacgtgaacaagaatacgcttcaggcgagacaacagaccgtctccgctctggaggataaactcgccgactacaagcggaaaatggccgatgctgtgtctcgcaagaagatggacacaaaacctaccgatccgacaggcatcgaacccgacgatcatctgaaggagagaagctcccttcggtatgggaacgttctggacgtgaatgccattgacatcgaggatccttctggacagaccgctgactggtacacaattggcgtctatgtgatcgggttcaccctccccatcattctgaaagccctgtacatgctcagcacgcgcggaagacagaccgttaaggaaaacaaaggcacacggatccgctttaaggatgacacctccttcgaggaaattaatgggatcagacggcctaagcacctgtatgtgtctatgcccacagcgcaaagcaccatgaaagccgaggagcttacgcctggacgctttagaacaattgtctgcggcctgttcccgacccagatccaggtgcggaacattgtgtcccccgtcatgggcgttatcgggtttagcttctttgtgaaggattggtctcagcgcatcacagagttcatggaaaaagaatgtccttttattaagcccgaggtgaaacctggaacccccgctcaagaaatcgagatgttcaagagaaataaaatttactttatgcagcggcaggacgtcctcgataagaaccatgtggccgacatcgataagtccattgactatgctgccagcgaggatccgacctctcctgacaatatcgactcccccaacgcgccttgggttttcgcctgcgctcccgatagatgtccccctacatgcatctacgtggccggcatggctgaactgggggcctttttcagcattcttcaagacatgcgcaatacgatcatggcctctaaaaccgtcggaacagctgaggaaaagctgaaaaagaaatccagcttctaccagtcctatctccggagaacccagtctatgggcattcagctggatcaacgcatcattctgctctttatgctggagtgggggaaggaaatggtggaccacttccatcttggagatgacatggatccggagctgcggggcctcgcgcaggccctgatcgaccagaaggttaaagagatcagcaaccaggaaccccttaagatttga

SEQ ID NO: 7190 - RNA, 1302 nt, synthetic construct
  misc_feature 1..1302: note = derived and/or modified CDS sequence (opt5) from PUUV(Gyttjea/Mg19/05)__GQ339480.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacagatggccgatgctgtctctcggaagaagatggacacaaaacctaccgatccgacaggcatcgaacccgacgatcatctgaaggagcgcagctcccttagatacgggaacgtgctggacgttaatgccattgacatcgaggaaccttctggacagaccgctgattggtatacaattggcgtgtacgtcatcgggtttaccctccccatcattctgaaagccctgtatatgctcagcacgcggggacgccaaaccgtgaaggagaacaaaggcacaagaatccggttcaaggacgatacctcctttgaagacattaatgggatccgcagacctaagcacctgtacgtttctatgcccacagcgcagagcaccatgaaagccgaggagcttacgcctggacggttccgcacaattgtgtgcggcctgtttccgacccagatccaggtcagaaacattatgtcccccgtgatgggcgtgatcgggttcgcctttttcgtcaagggatgggctgatcggatccgcgaatttatggagaaagaatgtcctttcattaagcccgaggttaaacctggcacacccacccaagaaatcgagtttctcaagaaaaataaggtgtatttcctggacagacagaccgtgcttgataagaaccatgtcgctgacattgataaactgatcgactacgccgcgagcggggatccgacatctcctgacaatattgagtcccccaacgccccttgggtgtttgcttgcgcccccgaccggtgtccccctacgtgcatctatgttgctggaatggccgaactcggcgccttcttcagcatcctgcaggatatgagaaataccattatggcttctaagacagtggggaccgcggaggaaaaactgaagaaaaagtccagcttttaccaatcttacctccgccggacacagtccatgggaatccagctggaccagagaattatccttctgttcatgctcgagtggggcaaggaaatggtcgatcactttcatctgggcgacgatatggacccggagcttcgcgggctggcccaagctctcattgatcagaaagtgaaggagatcagcaaccaggaacccctgaaaatctga

SEQ ID NO: 7191 - RNA, 1302 nt, synthetic construct
  misc_feature 1..1302: note = derived and/or modified CDS sequence (opt5) from PUUV(Karhumaki)__AJ238788.1__N
  source 1..1302: mol_type = other RNA
atgagcgacctgaccgatatccaggaggacattacaagacacgaacaacagctcgtggtcgcccggcagaagctgaaagatgctgagcgcgccgttgaagtggaccccgatgacgtgaacaagaatacgcttcaggcgagacaacagaccgtctccgctctggaggataaactcgccgactacaagcggaaaatggccgatgctgtgtctcgcaagaagatggacacaaaacctaccgatccgacaggcatgaagcccgacgttcatctgaaagaaagaagctcccttgagtatgggaacgtgctggatgtcaatgccatcgacattgaggaaccttctggacagaccgctgactggtacacaatcggcgtgtatgttattgggttcaccctccccatcatcctgaaggccctgtacatgctcagcacgcggggacgccagaccgtgaaagagaacaagggcacacggattagatttaaggatgacacctccttcgaagatatcaatgggattcgcagacctaaacacctgtatgtctctatgcccacagcgcaaagcaccatgaaggccgaggagcttacgcctggacggtttcgcacaatcgtgtgcggcctgttcccgacccagattcaggtgagaaacatcatgtcccccgtcatgggcgttattgggtttagcttctttgtgaaagactggtctgaacggatccgcgagttcatggaaaaggagtgtccttttatcaaacccgaagtgaagcctggaacacccgctcaggagattgagatgctcagacggaataaaatctacttcatgcaaagacaggatgtcctggacaagaaccatgtggccgatattgacaaacttatcgatctggctgcctccggcgacccgaccagccctgataatattgactctcccaacgcgccttgggtttttgcctgcgctcccgtgcgctgtccccctacctgcatctatgtcgccgggatggctgaactcggagccttcttttccatcctgcaggacatgcggaatacaattatggccagcaagacggtgggcaccgctgaggaaaagctgaaaaagaaatcttccttctaccaaagctacctcagacgcacacagtccatggggatccagctggatcagcggattatccttctgttcatgctcgagtggggaaaggaaatggttgaccactttcatctgggcgatgacatggatccggagcttagaggcctggcgcaagccctcattgaccagaaggtgaaagagatctctaaccaggaacccctgaagatctga

SEQ ID NO: 7192 - RNA, 1302 nt, synthetic construct
  misc_feature 1..1302: note = derived and/or modified CDS sequence (opt5) from PUUV(Kolodozero)__AJ238789.1__N
  source 1..1302: mol_type = other RNA
atgagcgacctgaccgatatccaggaggacattacaagacacgaacaacagctcgtggtcgcccggcagaagctgaaagatgctgagcgcgccgttgaagtggaccccgatgacgtgaacaagaatacgcttcaggcgagacaacagaccgtctccgctctggaggataaactcgccgactacaagcggcgcatggccgatgctgtgtctagaaagaagatggacacaaagcctaccgatccgacaggcatcgaacccgacgatcatctgaaagagcggagctcccttcgctatgggaacgttctggacgtgaatgccattgacatcgaggaaccttctggacagaccgctgattggtacacaattggcgtctatgtgatcgggttcaccctccccatcattctgaaggccctgtacatgctcagcacgagaggacggcagaccgttaaagagaacaagggcacacgcatcagatttaaagacgatacctccttcgaagacattaatgggatccggcgccctaagcacctgtatgtgtctatgcccacagcgcaaagcaccatgaaggccgaggagcttacgcctggaagatttcggacaattgtctgcggcctgatcccgacccagattcaggtgcgcaacatcatgtcccccgtgatgggcgtcatcgggttcagctttttcgttaaagattggtctgaacggattagagagtttatggaaaaggagtgtcctttcatcaaacccgaagtgaagcctggaacatccgctcaggagattgagatgctcaaaagaaataagatctactttatgcaacgccaggacgtgctggataaaaaccatgtcgccgacattgataaacttatcgactatgctgccagcggcgatcccacctctccggacaatatcgactcccctaacgcgccctgggtgttcgcctgcgctcctgatcggtgtccccctacctgcatttacgttgccgggatggctgaactgggagcctttttcagcatcctccaggacatgagaaatacaattatggcctctaagacggtgggcaccgctgaggaaaaactgaagaaaaagtccagcttttaccaatcctatctgcgccggacacagtctatggggatccccctcgatcagagaattatcctgcttttcatgctggagtggggacaggaaatggtcgaccacttccatctcggcgatgacatggatccggagctgcgcggccttgcgcaagccctgatcgaccagaaagtgaaggagattagcaaccaggaacccctcaagatctga

SEQ ID NO: 7193 - RNA, 1302 nt, synthetic construct
  misc_feature 1..1302: note = derived and/or modified CDS sequence (opt5) from PUUV(Kuhmo/X11)__GU808825.1__N
  source 1..1302: mol_type = other RNA
atgagcgacctgaccgatatccaggaggacattacaagacacgaacaacagctcgtggtcgcccggcagaagctgaaagatgctgagcgcgccgttggcgtggaccccgatgacgtgaacaagaatacgcttcaggcgagacaacagaccgtctccgctctggaagataaactcgccgactacaagcggcgcatggccgatgctgtgtctcggaaaaagatggacacaaagcctaccgatccgacagggatcgagcccgacgatcatctgaaagaaagaagctcccttcgctatggaaacgttctggacgtgaatgccattgacatcgaggagccttctggccagaccgctgattggtacacaattggggtctatgtgatcggattcaccctccccatcattctgaaggccctgtacatgctcagcacgagaggccggcagaccgttaaagaaaacaaggggacacgcatcagatttaaagacgatacctccttcgaggacattaatggaatccggcgccctaagcacctgtatgtgtctatgcccacagcgcaaagcaccatgaaggccgaagaacttacgcctggcagatttcggacaattgtctgcggcctgttcccgacccagatccaggtgcgcaacattatgtcccccgtgatgggggtcatcggatttagcttctttgttaaagattggtctgagagaatccgggagttcatggagaaggaatgtccttttattaaacccgaggtgaagcctggcacacccgctcaggaaatcgagatgctcaaaagaaatcgcatttacttcatgcaacggcaggacgtgctggataagaaccatgtcgccgacatcgataaacttattgactatgctgcctccggggatccgaccagccctgacaatatcgactctcccaacgcgccttgggtgtttgcctgcgctcccgatagatgtccccctacctgcatctacgttgccggaatggctgagctgggcgccttcttttccattctccaggacatgcgcaatacaatcatggccagcaagacggtggggacctctgaagagaagctgaaaaagaaatccagcttctaccaatcctatctgcggagaacacagtctatgggcattcagctcgatcagcgcatcattctgcttttcatgctggaatggggaaaggagatggtcgaccactttcatctcggcgatgacatggatccggaactgcgggggcttgctcaagcgctgatcgaccagaaagtgaaggagatcagcaaccaggagcccctcaagatttga

SEQ ID NO: 7194 - RNA, 1302 nt, synthetic construct
  misc_feature 1..1302: note = derived and/or modified CDS sequence (opt5) from PUUV(Kuhmo/X5)__GU808824.1__N
  source 1..1302: mol_type = other RNA
atgagcgacctgaccgatatccaggaggacattacaagacacgaacaacagctcgtggtcgcccggcagaagctgaaagatgctgagcgcgccgttgaagtggaccccgatgacgtgaacaagaatacgcttcaggcgagacaacagaccgtctccgctctggaggataaactcgccgactacaagcggcgcatggccgatgctgtgtctcggaaaaagatggacacaaagcctaccgatccgacaggcatcgaacccgacgatcatctgaaagagagaagctcccttcgctatgggaacgttctggacgtgaatgccattgacatcgaggaaccttctggacagaccgctgattggtacacaattggcgtctatgtgatcgggttcaccctccccatcattctgaaggccctgtacatgctcagcacgagaggacggcagaccgttaaagagaacaagggcacacgcatcagatttaaagacgatacctccttcgaagacattaatgggatccggcgccctaagcacctgtatgtgtctatgcccacagcgcaaagcaccatgaaggccgaggagcttacgcctggaagatttcggacaattgtctgcggcctgttcccgacccagatccaggtgcgcaacattatgtcccccgtgatgggcgtcatcgggtttagcttctttgttaaagattggtctgaaagaatccgggagttcatggaaaaggagtgtccttttattaaacccgaagtgaagcctggaacacccgctcaggagatcgagatgctcaaaagaaatcgcatttacttcatgcaacggcaggacgtgctggataagaaccatgtcgccgacatcgataaacttattgactatgctgcctccggcgatccgaccagccctgacaatatcgactctcccaacgcgccttgggtgtttgcctgcgctcccgatagatgtccccctacctgcatctacgttgccgggatggctgaactgggagccttcttttccattctccaggacatgcgcaatacaatcatggccagcaagacggtgggcaccgctgaggaaaagctgaaaaagaaatcttccttctaccaaagctatctgcggagaacacagtccatggggattcagctcgatcagcgcatcattctgcttttcatgctggagtggggaaaggaaatggtcgaccactttcatctcggcgatgacatggatccggagctgcggggccttgcgcaagccctgatcgaccagaaagtgaaggagatctctaaccaggaacccctcaagatttga

SEQ ID NO: 7195 - RNA, 1302 nt, synthetic construct
  misc_feature 1..1302: note = derived and/or modified CDS sequence (opt5) from PUUV(Ljustrask/Mg20/05)__GQ339481.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacagatggccgatgctgtctctcggaagaagatggacacaaaacctaccgatccgacaggcatcgaacccgacgatcatctgaaggagcgcagctcccttagatacgggaacgtgctggacgttaatgccattgacatcgaggaaccttctggacagaccgctgattggtatacaattggcgtgtacgtcatcgggtttaccctccccatcattctgaaagccctgtatatgctcagcacgcggggacgccaaaccgtgaaggagaacaaaggcacaagaatccggttcaaggacgatacctcctttgaagacattaatgggatccgcagacctaagcacctgtacgtttctatgcccacagcgcagagcaccatgaaagccgaggagcttacgcctggacggttccgcacaattgtgtgcggcctgtttccgacccagatccaggtcagaaacattatgtcccccgtgatgggcgtgatcgggttcgcctttttcgtcaagggatgggctgatcggatccgcgaatttatggagaaagaatgtcctttcattaagcccgaggttaaacctggcacacccacccaagaaatcgagtttctcaagaaaaataaggtgtatttcctggacagacagaacgtgcttgataagaatcatgtcgctgacattgataaactgatcgactacgccgcgagcggggatccgacctctcctgacaacattgagtcccccaatgccccttgggtgtttgcttgcgcccccgaccggtgtccccctacatgcatctatgttgctggaatggccgaactcggcgccttcttcagcatcctgcaggatatgagaaacacgattatggcttctaagaccgtggggacagcggaggaaaaactgaagaaaaagtccagcttttaccaatcttacctccgccggacccagtccatgggaatccagctggaccagagaattatccttctgttcatgctcgagtggggcaaggaaatggtcgatcactttcatctgggcgacgatatggacccggagcttcgcgggctggcccaagctctcattgatcagaaagtgaaggagatcagcaatcaggaacccctgaaaatctga

SEQ ID NO: 7196 - RNA, 1302 nt, synthetic construct
  misc_feature 1..1302: note = derived and/or modified CDS sequence (opt5) from PUUV(Mangelbo/Mg1/05)__GQ339485.1__N
  source 1..1302: mol_type = other RNA
atgagcgacctgaccgatatccaggacgagattacaagacacgaacaacagctcgtggccgctcggcagaagctgaaagatgccgagcgcgcggtcgaaatggaccccgatgacgttaacaagaatacgcttcaggctagacaacagaccgtgtccgccctggaggataaactcgccgacttcaagcggcgcatggctgatgccgtgtctagaaagaagatggacacaaagcctaccgatccgacaggcatcgaacccgacgatcatctgaaagagcggagctcccttcgctacggggacgtcctggacgtgaacgctattgatatcgaggaaccttctggacagaccgccgactggtatacaattggcgtttacgtgatcgggtttaccctccccatcattctgaaggcgctgtatatgctcagcacgagaggacggcagaccgtcaaagagaataagggcacacgcatcagattcaaagatgacacctcctttgaagatattaacgggatccggcgccctaagcacctgtacgtgtctatgcccacagcccaaagcaccatgaaggctgaggagcttacgcctggaagattccggacaattgtttgcggcctgtttccgacccagatccaggtgcgcaatattatgtcccccgtcatgggcgtgatcgggttcagctttttcgtgaaagactgggccgaaagaatccgggagtttatggataaggaatgtcctttcattaaacccgaggtcaagcctggaacacccgctcaggaaatcgagtttctcaaaaagaacaaaatttatttcatgcaaagacaggacgttctggataagaatcatgtggccgacatcgataaacttattgactacgcggcctctggcgacccgacctcccctgataacatcgagagccccaatgctccttgggtgtttgcctgcgctcccgaccgctgtccccctacctgcatctatgtcgccgggatggccgaactgggagctttcttctctattctccaggatatgcggaacacaatcatggcgtccaaaacggtgggcaccgccgaggaaaagctgaaaaagaaaagctctttttaccaatcctacctgagacgcacacagagcatggggattcagctcgaccagcggatcattctgctttatatgctggagtggggaaaggaaatggttgatcacttccatctcggcgacgatatggacccggagctgagaggccttacccaagctctgatcgatcagaaggtgaaagagatctccaatcccgaacctctcaagatttga

SEQ ID NO: 7197 - RNA, 1302 nt, synthetic construct
  misc_feature 1..1302: note = derived and/or modified CDS sequence (opt5) from PUUV(Momignies/55Cg/96)__AJ277033.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacagatggccgatgctgtctctcggaagaagatggacacaaaacctaccgatccgacaggcatcgaacccgacgatcatctgaaggagcgcagctcccttagatacgggaacgtgctggacgttaatgccattgacatcgaggaaccttctggacagaccgctgattggtatacaattggcgtgtacgtcatcgggtttaccctccccatcattctgaaagccctgtatatgctcagcacgcggggacgccaaaccgtgaaggagaacaaaggcacaagaatccggttcaaggacgatacctcctttgaagacattaatgggatccgcagatctaagcacctgtacgttagcatgcctacagcgcagtccaccatgaaagccgaggagcttacgcccggacggttccgcacaattgtgtgcggcctgtttcctacccagatccaggtcagaaacattatgagcccggtgatgggcgtgatcgggttctcctttttcgtcaaggattgggctgaccggatccgcgaatttatggagaaagaatgtcccttcattaagcctgaggttaaacccggaacacccgcccaagaagctgagtttctcaagagaaataaaatctatttcatgcagcggcaggatgtgctggacaagaaccatgtggccgatattgacaaacttatcgattacgcggcctctggcgaccccaccagcccggacaatattgaggctcctaacgccccctgggtctttgcttgcgcccctgatagatgtccccctacctgcatctatgtggccgggatggctgaactgggagcgttcttctctatcctccaagacatgcgcaatacaattatggcctccaagacggttggcaccgctgaggaaaagctgaaaaagaaaagctctttttaccagtcctacctgcggagaacacagagcatggggatccagctcgatcaacgcattatcctgctttatatgctggagtggggaaaggaaatggtggaccacttccatctctccgatgacatggatcctgagctgcggggccttgcccaggccctgattgaccagaaggtcaaagagatctctaaccaggaaccgctcaagatctga

SEQ ID NO: 7198 - RNA, 1302 nt, synthetic construct
  misc_feature 1..1302: note = derived and/or modified CDS sequence (opt5) from PUUV(Montbliart/23Cg/96)__AJ277031.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacagatggccgatgctgtctctcggaagaagatggacacaaaacctaccgatccgacaggcatcgaacccgacgatcatctgaaggagcgcagctcccttagatacgggaacgtgctggacgttaatgccattgacatcgaggaaccttctggacagaccgctgattggtatacaattggcgtgtacgtcatcgggtttaccctccccatcattctgaaagccctgtatatgctcagcacgcggggacgccaaaccgtgaaggagaacaaaggcacaagaatccggttcaaggacgatacctcctttgaagacattaatgggatccgcagacctaagcacctgtacgtttctatgcccacagcgcagagcaccatgaaagccgaggagcttacgcctggacggttccgcacaattgtgtgcggcctgtttccgacccagatccaggtcagaaacattatgtcccccgtgatgggcgtgatcgggttcagctttttcgtcaaggattgggctgaccggatccgcgaatttatggagaaagaatgtcctttcattaagcccgaggttaaacctggaacacccgcccaagaagctgagtttctcagacggaataagatctatttcatgcagagacaggaggtgctggataaaaaccatgtggccgacattgataaacttatcgactacgcggcctctggcgatccgacctcccctgacaatattgaagctcccaacgccccttgggtctttgcttgcgcccccgaccgctgtccccctacctgcatctatatcgccgggatggctgagctgggagcgttcttcagcattctccaagatatgcggaatacaatcatggcctctaagacggtgggcaccgctgaagagaagctgaagaaaaagtccagcttttaccagtcttacctgagacgcacacagtccatggggattcagctcgaccaacggatcattctgctttatatgctggaatggggaaaagagatggttgatcacttccatctcggcgacgatatggacccggagctgagaggccttgcccaggccctgatcgatcagaaggtgaaggaaatcagcaaccaggagcccctcaaaatttga

SEQ ID NO: 7199 - RNA, 1302 nt, synthetic construct
  misc_feature 1..1302: note = derived and/or modified CDS sequence (opt5) from PUUV(MuEb10Karlstadt/10)__JN696373.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgactacaaaagacggatggccgatgctgtctctcgcaagaagatggacacaaaacctaccgatccgacaggcatcgaacccgacgatcatctgaaggagagaagctcccttcggtatgggaacgtgctggacgttaatgccattgacatcgaggaaccttctggacagaccgctgattggtacacaattggcgtgtatgtcatcgggttcaccctccccatcattctgaaagccctgtacatgctcagcacgcgcggaagacagaccgtgaaggagaacaaaggcacacggatccgctttaaggacgatacctccttcgaagacattaatgggatcagacggcctaagcacctgtatgtttctatgcccacagcgcaaagcaccatgaaagccgaggagcttacgcctggacgctttagaacaattgtgtgcggcctgttcccgacccagatccaggtccggaacattatgtcccccgtgatgggcgtgatcgggtttagcttctttgtcaaggattgggctgaacgcatcagagagttcatggaaaaagagtgtccttttattaagcccgaaatcaaacctggaacacccgttcaggaggccgagttcctcaagcggaataaagtgtactttatgcaaagacaggaagtgctggacaagaaccatgtcgctgatattgacaaacttatcgattatgccgcgtctggcgacccgacctcccctgataatattgagagccccaacgccccttgggtgttcgcttgcgcccccgaccgctgtccccctacctgcatctacgttgctgggatggccgaactgggagcctttttctctatcctccaggacatgcggaatacaattatggcttccaagacggtgggcaccgcggaggaaaagctgaaaaagaaaagctctttctaccaatcctatctgagacgcacacagagcatggggatccagctcgatcagcggattatcctgctttacatgctggagtggggaaaggagatggtcgaccactttcatctcggcgatgacatggatccggaactgagaggccttgcccaagctctgattgaccagaaggtgaaagagatctccaaccaggaacccctcaagatctga

SEQ ID NO: 7200 - RNA, 1302 nt, synthetic construct
  misc_feature 1..1302: note = derived and/or modified CDS sequence (opt5) from PUUV(MuEb12Lackenberg/10)__JN696374.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgactacaaaagacggatggccgatgctgtctctcgcaagaagatggacacaaaacctaccgatccgacaggcatcgaacccgacgatcatctgaaggagagaagctcccttcggtatgggaacgtgctggacgttaatgccattgacatcgaggaaccttctggacagaccgctgattggtacacaattggcgtgtatgtcatcgggttcaccctccccatcattctgaaagccctgtacatgctcagcacgcgcggaagacagaccgtgaaggagaacaaaggcacacggatccgctttaaggacgatacctccttcgaagacattaatgggatcagacggcctaagcacctgtatgtttctatgcccacagcgcaaagcaccatgaaagccgaggagcttacgcctggacgctttagaacaattgtgtgcggcctgttcccgacccagatccaggtccggaacattatgtcccccgtgatgggcgtgatcgggtttagcttctttgtcaaggattgggctgaacgcatcagagagttcatggaaaaagagtgtccttttattaagcccgaaatgaaacctggaacacccgcccaggaggctgagttcctcaagcggaataaagtttactttatgcaaagacaggacgtgctggataagaaccatgtggccgacatcgataaacttattgactatgcggcctctggcgatccgacctcccctgacaatatcgaaagccccaacgctccttgggtcttcgcctgcgctcccgaccgctgtccccctacctgcatttacgtggccgggatggccgagctgggagcgtttttctctatcctccaggatatgcggaatacaatcatggcttccaagacggttggcaccgccgaagagaagctgaaaaagaaaagctctttctaccaatcctatctgagacgcacacagagcatggggattcagctcgaccagcggatcattctgctttacatgctggaatggggaaaggagatggtggatcactttcatctcggcgacgatatggacccggagctgagaggccttgctcaagccctgatcgatcagaaggtcaaagaaatttccaaccaggagcccctcaagatctga

SEQ ID NO: 7201 - RNA, 1302 nt, synthetic construct
  misc_feature 1..1302: note = derived and/or modified CDS sequence (opt5) from PUUV(Munga/Mg16/05)__GQ339487.1__N
  source 1..1302: mol_type = other RNA
atgagcgacctgaccgatatccaggacgagattacaagacacgaacaacagctcgtggccgctcggcagaagctgaaagatgccgagcgcgcggtcgaaatggaccccgatgacgttaacaagaatacgcttcaggctagacaacagaccgtgtccgccctggaggataaactcgccgacttcaagcggcgcatggctgatgccgtgtctagaaagaagatggacacaaagcctaccgatccgacaggcatcgaacccgacgatcatctgaaagagcggagctcccttcgctacgggaacgtcctggacgtgaatgctattgacatcgaggaaccttctggacagaccgccgattggtatacaattggcgtttacgtgatcgggtttaccctccccatcattctgaaggcgctgtatatgctcagcacgagaggacggcagaccgtcaaagagaacaagggcacacgcatcagattcaaagacgatacctcctttgaagacattaatgggatccggcgccctaagcacctgtacgtgtctatgcccacagcccaaagcaccatgaaggctgaggagcttacgcctggaagattccggacaattgtttgcggcctgtttccgacccagatccaggtgcgcaacattatgtcccccgtcatgggcgtgatcgggttcagctttttcgtgaaagattgggccgaaagaatccgggagtttatggaaaaggagtgtcctttcattaaacccgaagtcaagcctggaacacccgctcaggagatcgagtttctcaaaaagaataaaatttatttcatgcaaagacaggacgttctggataagaaccatgtggccgacatcgataaacttattgactacgcggcctctggcgatccgacctcccctgacaatatcgaaagccccaacgctccttgggtgtttgcctgcgctcccgaccgctgtccccctacctgcatctatgtcgccgggatggccgagctgggagctttcttctctattctccaggatatgcggaatacaatcatggcgtccaaaacggtgggcaccgccgaagagaagctgaaaaagaaaagctctttttaccaatcctacctgagacgcacacagagcatggggattcagctcgaccagcggatcattctgctttatatgctggaatggggaaaggagatggttgatcacttccatctcggcgacgatatggacccggagctgagaggccttgctcaagccctgatcgatcagaaggtgaaagaaatctccaaccaggagcccctcaagatttga

SEQ ID NO: 7202 - RNA, 1302 nt, synthetic construct
  misc_feature 1..1302: note = derived and/or modified CDS sequence (opt5) from PUUV(Munga/Mg2/05)__GQ339486.1__N
  source 1..1302: mol_type = other RNA
atgagcgacctgaccgatatccaggacgagattacaagacacgaacaacagctcgtggccgctcggcagaagctgaaagatgccgagcgcgcggtcgaaatggaccccgatgacgttaacaagaatacgcttcaggctagacaacagaccgtgtccgccctggaggataaactcgccgacttcaagcggcgcatggctgatgccgtgtctagaaagaagatggacacaaagcctaccgatccgacaggcatcgaacccgacgatcatctgaaagagcggagctcccttcgctacgggaacgtcctggacatgaatgctattgacatcgaggaaccttctggacagaccgccgattggtatacaattggcgtgtacgttatcgggtttaccctccccatcattctgaaggcgctgtatatgctcagcacgagaggacggcagaccgtgaaagagaacaagggcacacgcatcagattcaaagacgatacctcctttgaagacattaatgggatccggcgccctaagcacctgtacgtctctatgcccacagcccaaagcaccatgaaggctgaggagcttacgcctggaagattccggacaattgtgtgcggcctgtttccgacccagatccaggttcgcaacattatgtcccccgtgatgggcgtcatcgggttcagctttttcgtgaaagattgggccgaaagaatccgggagtttatggaaaaggagtgtcctttcattaaacccgaagtgaagcctggaacacccgctcaggagatcgagtttctcaaaaagaataaaatttatttcatgcaaagacaggacgtcctggataagaaccatgttgccgacatcgataaacttattgactacgcggcctctggcgatccgacctcccctgacaatatcgaaagccccaacgctccttgggtgtttgcctgcgctcccgaccgctgtccccctacctgcatctatgtggccgggatggccgagctgggagctttcttctctattctccaggatatgcggaatacaatcatggcgtccaaaacggtcggcaccgccgaagagaagctgaaaaagaaaagctctttttaccaatcctacctgagacgcacacagagcatggggattcagctcgaccagcggatcattctgctttatatgctggaatggggaaaggagatggtggatcacttccatctcggcgacgatatggacccggagctgagaggccttgctcaagccctgatcgatcagaaggttaaagaaatctccaaccaggagcccctcaagatttga

SEQ ID NO: 7203 - RNA, 1302 nt, synthetic construct
  misc_feature 1..1302: note = derived and/or modified CDS sequence (opt5) from PUUV(PUU/Cg-Erft)__AJ238779.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacagatggccgatgctgtctctcggaagaagatggacacaaaacctaccgatccgacaggcatcgaacccgacgatcatctgaaggagcgcagctcccttagatacgggaacgtgctggacgttaatgccattgacatcgaggaaccttctggacagaccgctgattggtatacaattggcgtgtacgtcatcgggtttaccctccccatcattctgaaagccctgtatatgctcagcacgcggggacgccaaaccgtgaaggagaacaaaggcacaagaatccggttcaaggacgatacctcctttgaagacattaatgggatccgcagacctaagcacctgtacgtttctatgcccacagcgcagagcaccatgaaagccgaggagcttacgcctggacggttccgcacaattgtgtgcggcctgtttccgacccagatccaggtcagaaacattatgtcccccgtgatgggcgtgatcgggttcagctttttcgtcaaggattgggctgaccggatcaaaaagtttatggaaaaagagtgtcctttcattaagcccgaagttaaacctggaacaccctctcaagaggccgaatttctcaagatgaatcgcatctatttcatgcagagacaggaggtgctggataagaaccatgtggctgacattgataaacttatcgactacgccgcgtccggcgatccgaccagccctgacaatattgaggcccccaacgctccttgggtctttgcctgcgctcccgaccggtgtccccctacctgcatctatgtggccgggatggccgaactgggagctttcttctctatcctccaagatatgagaaatacaattatggcgtccaagacggttggcaccgccgaggaaaaactgaagaaaaagagctctttttaccagtcctacctgcgccggacacagagcatggggatccagctcgaccaaagaattatcctgctttatatgctggagtggggaaaggaaatggtggatcacttccatctcggcgacgatatggacccggagctgcgcggccttgctcaggccctgattgatcagaaagtcaaggagatctccaaccaggaacccctcaaaatctga

SEQ ID NO: 7204 - RNA, 1302 nt, synthetic construct
  misc_feature 1..1302: note = derived and/or modified CDS sequence (opt5) from PUUV(Puu/Kazan)__Z84204.1__N
  source 1..1302: mol_type = other RNA
atgagcgacctgaccgatatccaggaggaaattacaagacacgagcaacagctcgtggtcgcccggcagaagctgaaagacgctgaacgcgccgttgaggtggatcccgacgatgtgaacaagaatacgcttcaggcgagacaacagaccgtctccgctctggaagacaaactcgccgattacaagcggcgcatggccgacgctgtgtctcggaaaaagatggatacaaagcctaccgacccgacaggcatcgagcccgatgaccatctgaaagagcggagctcccttcgctatgggaacgttctggatgtgaatgccattgacatcgaggaaccttctggacagaccgctgactggtacacaattggcgtctatgtgatcgggttcaccatccccattatcctcaaggccctgtacatgctgagcacgagaggacggcagaccgttaaagaaaacaagggcacacgcattagatttaaagatgacacctccttcgaggatatcaatgggattcggcgccctaagcacctctatgtgtctatgcccacagcgcaaagcaccatgaaggccgaggaactgacgcctggaagatttcggacaatcgtctgcggccttttcccgacccagattcaggtgcgcaacatcatgtcccccgtgatgggcgtcatcgggtttagcttctttgttaaagactggcctgagagaattagagatttcatggaaaaggagtctccctttatcaaacctgaagtgaagcccggaacaccggctcaggagattgagttcctgaaaagaaatcgcgtgtactttatgacccggcaagacgtcctcgataagaaccatgtggccgacatcgataaactgattgactatgctgcctccggcgatcctaccagccccgacgacatcgaatctcctaatgcgccctgggttttcgcctgtgctcccgatagatgccctccgacatgtatctacgtggccgggatggctgagcttggagcctttttctccattctgcaggacatgcgcaacacgatcatggccagcaagaccgtcggcacagctgaagagaagctcaaaaagaaatcttccttctaccagagctatctgcggagaacccaatccatggggattcagctggatcagcgcatcattctcctgtacatgcttgaatggggaaaggagatggtggaccactttcatctgggcgatgacatggatcccgagctccggggcctggcgcagtctcttatcgaccaaaaagttaaggaaatcagcaatcaggagcctctgaagatttga

SEQ ID NO: 7205 - RNA, 1302 nt, synthetic construct
  misc_feature 1..1302: note = derived and/or modified CDS sequence (opt5) from PUUV(PUU/Mignovillard/CgY02/2005)__AM695638.1__N
  source 1..1302: mol_type = other RNA
atgggcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgagcgctctggaggataagctcgccgacttcaaaagacggatggccgatgctgtctcccgcaagaagatggacacaaaacctaccgatccgacagggatcgaacccgacgatcatctgaaggagagatctagccttcggtacggaaacgtgctggacgttaatgccattgacatcgaggaaccttccggccagaccgctgattggtatacaattggggtgtacgtcatcggatttaccctccccatcattctgaaagccctgtatatgctctctacgcgcggcagacagaccgtgaaggagaacaaagggacacggatccgcttcaaggacgataccagctttgaagacattaatggaatcagacggcctaagcacctgtacgtttccatgcccacagcgcaatctaccatgaaagccgaggagcttacgcctggccgcttcagaacaattgtgtgcggcctgtttccgacccagatccaggtccggaacattatgagccccgtgatgggggtgatcggattctcctttttcgtcaaggattggacagaccgcatcagagaatttatggagaaagaatgtcctttcattaagcccgagatgaaacctggcacccccgctcaggaagccgagtttctcaagcggaataaaatctatttcatgcaaagacaggatgttctggacaagaaccatgtggctgatattgacaaacttatcgattacgccgcgagcggggacccgacctctcctgacaatattgagtcccccaacgccccttgggtgtttgcttgcgcccccgatcgctgtccccctacatgcatctatgtcgctggaatggccgaactgggcgccttcttcagcatcctccaggacatgcggaatacgattatggcttctaagaccgtggggacagcggaggaaaagctgaaaaagaaatccagcttttaccaatcttacctgagacgcacccagtccatgggaatccagctcgatcagcggattatcctgctttatatgctggagtggggcaaggaaatggttgaccacttccatctcggcgatgacatggatccggagctgagagggcttgcccaagctctgattgaccagaaggtgaaagagatcagcaaccaggaacccctcaagatctga

SEQ ID NO: 7206 - RNA, 1302 nt, synthetic construct
  misc_feature 1..1302: note = derived and/or modified CDS sequence (opt5) from PUUV(PUUV/Croatia_Gerovo/Mg938/2008)__KC676609.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatggggtttaccctccccatcatcctgaaagccctgtatatgctcagcacgcgcggaagacagaccgtgaaggagaacaaaggcacacggattcgcttcaaggacgatacctcctttgaagacatcaatgggattagacggcctaagcacctgtacgtttctatgcccacagcgcaaagcaccatgaaagccgaggagcttacgcctggacgcttcagaacaatcgtgtgcggcctgtttccgacccagattcaggtccggaacatcatgtcccccgtgatgggcgtgattgggttcagctttttcgtcaaggattggtctgaacgcgttagagactttatggagaaagaatgtcctttcatcaagcccgagatcaaacctggaacaccccagcaagaagctgagtttctcaagcggaataaagtgtatttcatgcagagacaggatgtgctggacaagaaccatgtcgccgatattgacaaacttatcgattacgctgcctccggcgacccgaccagccctgacaatattgagtctcccaacgcgccttgggtgtttgcctgcgctcccgatcgctgtccccctacctgcatctatgttgccgggatggctgaactgggagccttcttctccattctccaagacatgcggaatacaatcatggccagcaagacggtgggcaccgctgaggaaaagctgaaaaagaaatcttccttttaccagagctacctgagacgcacacagtccatggggatccagctcgatcaacggattatcctgctttatatgctggagtggggaaaggaaatggtcgaccacttccatctcggcgatgacatggatccggagctgagaggccttgcgcaggccctgattgaccagaaggtgaaagagatctctaaccaggaacccctcaagatttga

SEQ ID NO: 7207 - RNA, 1302 nt, synthetic construct
  misc_feature 1..1302: note = derived and/or modified CDS sequence (opt5) from PUUV(PUUV/Croatia_Gerovo/Mg979/2008)__KC676613.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatcgggtttaccctccccatcattctgaaagccctgtatatgctcagcacgcgcggaagacagaccgtgaaggagaacaaaggcacacggatccgcttcaaggacgatacctcctttgaagacattaatgggatcagacggcctaagcacctgtacgtttctatgcccacagcgcaaagcaccatgaaagccgaggagcttacgcctggacgcttcagaacaattgtgtgcggcctgtttccgacccagatccaggtccggaacattatgtcccccgtgatgggcgtgatcgggttcagctttttcgtcaaggattggtctgaacgcgttagagactttatggagaaagaatgtcctttcatcaagcccgagattaaacctggaacacccccgcaggaagctgagtttctcaagcggaataaagtgtatttcatgcaaagacaggatgtgctggacaagaaccatgtcgccgatatcgacaaacttattgattacgctgcctccggcgaccctaccagccccgacaatatcgagtctcctaacgcgccctgggtgtttgcctgcgctcccgatcgctgtcctccgacctgcatttatgttgccgggatggctgaactgggagccttcttctccatcctccaggacatgcggaatacaatcatggccagcaagacggtgggcaccgctgaggaaaagctgaaaaagaaatcttccttttaccaaagctacctgagacgcacacagtccatggggattcagctcgatcagcggatcattctgctttatatgctggagtggggaaaggaaatggtcgaccacttccatctcggcgatgacatggatcccgagctgagaggccttgcgcaagccctgatcgaccagaaggtgaaagagatttctaaccaggaacctctcaagatctga

SEQ ID NO: 7208 - RNA, 1302 nt, synthetic construct
  misc_feature 1..1302: note = derived and/or modified CDS sequence (opt5) from PUUV(PUUV/Konnevesi/Mg_M114B/2005)__JQ319171.1__N
  source 1..1302: mol_type = other RNA
atgagcgacctgaccgatatccaggaggacattacaagacacgaacaacagctcgtggtcgcccggcagaagctgaaagatgctgagcgcgccgttgaagtggaccccgatgacgtgaacaagaatacgcttcaggcgagacaacagaccgtctccgctctggaggataaactcgccgactacaagcggcgcatggccgatgctgtgtctagaaagaagatggacacaaagcctaccgatccgacaggcatcgaacccgacgatcatctgaaagagcggagctcccttcgctatgggaacgttctggacgtgaatgccattgacatcgaggaaccttctggacagaccgctgattggtacacaattggcgtctatgtgatcgggttcaccctccccatcattctgaaggccctgtacatgctcagcacgagaggacggcagaccgttaaagagaacaagggcacacgcatcagatttaaagacgatacctccttcgaagacattaatgggatccggcgccctaagcacctgtatgtgtctatgcccacagcgcaaagcaccatgaaggccgaggagcttacgcctggaagatttcggacaattgtctgcggcctgttcccgacccagatccaggtgcgcaacattatgtcccccgtgatgggcgtcatcgggtttagcttctttgttaaagattggcctgaaagaatccgggagttcatggaaaaggagtgtccctttattaaacctgaagtgaagcccggaacaccggctcaggagatcgagatgctcaaaagaaataagatttacttcatgcaacgccaggacgtgctggataaaaaccatgtcgccgacatcgataaacttattgactatgctgcctctggcgatcctacctcccccgacaatatcgacagccctaacgcgccctgggtgtttgcctgcgctcccgatcggtgtcctccgacctgcatctacgttgccgggatggctgaactgggagccttcttttctattctccaggacatgagaaatacaatcatggcctccaagacggtgggcaccgctgaggaaaaactgaagaaaaagagctctttctaccaatcctatctgcgccggacacagagcatggggattcagctcgatcagagaatcattctgcttttcatgctggagtggggaaaagaaatggtcgaccactttcatttcggcgatgacatggatcccgagctccgcggcctggcgcaagcccttatcgaccagaaggtgaaggagatctccaaccaggaacctctgaaaatttga

SEQ ID NO: 7209 - RNA, 1302 nt, synthetic construct
  misc_feature 1..1302: note = derived and/or modified CDS sequence (opt5) from PUUV(PUUV/Konnevesi/Mg_M94A/2005)__JQ319163.2__N
  source 1..1302: mol_type = other RNA
atgagcgacctgaccgatatccaggaggacattacaagacacgaacaacagctcgtggtcgcccggcagaagctgaaagatgctgagcgcgccgttgaagtggaccccgatgacgtgaacaagaatacgcttcaggcgagacaacagaccgtctccgctctggaggataaactcgccgactacaagcggcgcatggccgatgctgtgtctagaaagaagatggacacaaagcctaccgatccgacaggcatcgaacccgacgatcatctgaaagagcggagctcccttcgctatgggaacgttctggacgtgaatgccattgacatcgaggaaccttctggacagaccgctgattggtacacaattggcgtctatgtgatcgggttcaccctccccatcattctgaaggccctgtacatgctcagcacgagaggacggcagaccgttaaagagaacaagggcacacgcatcagatttaaagacgatacctccttcgaagacattaatgggatccggcgccctaagcacctgtatgtgtctatgcccacagcgcaaagcaccatgaaggccgaggagcttacgcctggaagatttcggacaattgtctgcggcctgttcccgacccagatccaggtgcgcaacattatgtcccccgtgatgggcgtcatcgggtttagcttctttgttaaagattggcctgaaagaatcaaggagttcatggaaaaagagtgtccctttattaagcctgaagtgaaacccggaacaccggctcaggagatcgagatgctcaagcggaataaaatttacttcatgcaaagacaggacgtgctggataagaaccatgtcgccgacatcgataaacttattgactatgctgcctctggcgatcctacctcccccgacaatatcgacagccctaacgcgccctgggtgtttgcctgcgctcccgatcgctgtcctccgacctgcatctacgttgccgggatggctgaactgggagccttcttttctattctccaggacatgcggaatacaatcatggcctccaaaacggtgggcaccgctgaggaagaggtcaagaaaaagagctctttctaccaatcctatctgagacgcacacagagcatggggattcagctggatcagcggatcattctcctgttcatgcttgaatggggaaaagagatggtggaccactttcatctgggcgatgacatggatcccgagctcagaggcctggcgcaagccatgatcgaccagaaggttaaggaaatctccaaccaggagcctcttaaaatttga

SEQ ID NO: 7210 - RNA, 1302 nt, synthetic construct
  misc_feature 1..1302: note = derived and/or modified CDS sequence (opt5) from PUUV(PUUV/Konnevesi/Mg_O14B/2005)__JQ319166.1__N
  source 1..1302: mol_type = other RNA
atgagcgacctgaccgatatccaggaggacattacaagacacgaacaacagctcgtggtcgcccggcagaagctgaaagatgctgagcgcgccgttgaagtggaccccgatgacgtgaacaagaatacgcttcaggcgagacaacagaccgtctccgctctggaggataaactcgccgactacaagcggcgcatggccgatgctgtgtctagaaagaagatggacacaaagcctaccgatccgacaggcatcgaacccgacgatcatctgaaagagcggagctcccttcgctatgggaacgttctggacgtgaatgccattgacatcgaggaaccttctggacagaccgctgattggtacacaattggcgtctatgtgatcgggttcaccctccccatcattctgaaggccctgtacatgctcagcacgagaggacggcagaccgttaaagagaacaagggcacacgcatcagatttaaagacgatacctccttcgaagacattaatgggatccggcgccctaagcacctgtatgtgtctatgcccacagcgcaaagcaccatgaaggccgaggagcttacgcctggaagatttcggacaattgtctgcggcctgttcccgacccagatccaggtgcgcaacattatgtcccccgtgatgggcgtcatcgggtttagcttctttgttaaagattggcctgaaagaatccgggagttcatggaaaaggagtgtccctttattaaacctgaagtgaagcccggaacaccggctcaggagatcgagatgctcaaaagaaataagatttacttcatgcaacgccaggacgtgctggataaaaaccatgtcgccgacatcgataaacttattgactatgctgcctctggcgatcctacctcccccgacaatatcgacagccctaacgcgccctgggtgtttgcctgcgctcccgatcggtgtcctccgacctgcatctacgttgccgggatggctgaactgggagccttcttttctattctccaggacatgagaaatacaatcatggcctccaagacggtgggcaccgctgaggaaaaactgaagaaaaagagctctttctaccaatcctatctgcgccggacacagagcatggggattcagctcgatcagagaatcattctgcttttcatgctggagtggggaaaagaaatggtcgaccactttcatctcggcgatgacatggatcccgagctgcgcggccttgcgcaagccctgatcgaccagaaggtgaaggagatctccaaccaggaacctctcaaaatttga

SEQ ID NO: 7211 - RNA, 1302 nt, synthetic construct
  misc_feature 1..1302: note = derived and/or modified CDS sequence (opt5) from PUUV(PUUV/Konnevesi/Mg_O22B/2005)__JQ319168.2__N
  source 1..1302: mol_type = other RNA
atgagcgacctgaccgatatccaggaggacattacaagacacgaacaacagctcgtggtcgcccggcagaagctgaaagatgctgagcgcgccgttgaagtggaccccgatgacgtgaacaagaatacgcttcaggcgagacaacagaccgtctccgctctggaggataaactcgccgactacaagcggcgcatggccgatgctgtgtctagaaagaagatggacacaaagcctaccgatccgacaggcatcgaacccgacgatcatctgaaagagcggagctcccttcgctatgggaacgttctggacgtgaatgccattgacatcgaggaaccttctggacagaccgctgattggtacacaattggcgtctatgtgatcgggttcaccctccccatcattctgaaggccctgtacatgctcagcacgagaggacggcagaccgttaaagagaacaagggcacacgcatcagatttaaagacgatacctccttcgaagacattaatgggatccggcgccctaagcacctgtatgtgtctatgcccacagcgcaaagcaccatgaaggccgaggagcttacgcctggaagatttcggacaattgtctgcggcctgttcccgacccagatccaggtgcgcaacattatgtcccccgtgatgggcgtcatcgggtttagcttctttgttaaagattggcctgaaagaatccgggagttcatggaaaaggagtgtccctttattaaacctgaagtgaagcccggaacaccggctcaggagatcgagatgctcaaaagaaataagatttacttcatgcaacgccaggacgtgctggataaaaaccatgtcgccgacatcgataaacttattgactatgctgcctctggcgatcctacctcccccgaaaatatcgacagccctaacgcgccctgggtgtttgcctgcgctcccgaccggtgtcctccgacctgcatctacgttgccgggatggctgagctgggagccttcttttctattctccaggatatgagaaatacaatcatggcctccaagacggtgggcaccgctgaagagaaactgaagaaaaagagctctttctaccaatcctatctgcgccggacacagagcatggggattcagctcgaccagagaatcattctgcttttcatgctggaatggggaaaagagatggtcgatcactttcatctcggcgacgatatggaccccgagctgcgcggccacgcgcaagcccttatcgatcagaaggtgaaggaaatctccaaccaggagcctctgaaaatttga

SEQ ID NO: 7212 - RNA, 1302 nt, synthetic construct
  misc_feature 1..1302: note = derived and/or modified CDS sequence (opt5) from PUUV(PUUV/Konnevesi/Mg_O57A/2005)__JQ319161.2__N
  source 1..1302: mol_type = other RNA
atgagcgacctgaccgatatccaggaggacattacaagacacgaacaacagctcgtggtcgcccggcagaagctgaaagatgctgagcgcgccgttgaagtggaccccgatgacgtgaacaagaatacgcttcaggcgagacaacagaccgtctccgctctggaggataaactcgccgactacaagcggcgcatggccgatgctgtgtctagaaagaagatggacacaaagcctaccgatccgacaggcatcgaacccgacgatcatctgaaagagcggagctcccttcgctatgggaacgttctggacgtgaatgccattgacatcgaggaaccttctggacagaccgctgattggtacacaattggcgtctatgtgatcgggttcaccctccccatcattctgaaggccctgtacatgctcagcacgagaggacggcagaccgttaaagagaacaagggcacacgcatcagatttaaagacgatacctccttcgaagacattaatgggatccggcgccctaagcacctgtatgtgtctatgcccacagcgcaaagcaccatgaaggccgaggagcttacgcctggaagatttcggacaattgtctgcggcctgttcccgacccgcatccaggtgagaaacattatgtcccccgtgatgggcgtcatcgggtttagcttctttgttaaagattggcctgaacggatcaaggagttcatggaaaaagagtgttcttttattaagcccgaagtgaaacctggaacacccgctcaggagatcgagatgctcaagagaaataaaatttacttcatgcagcgccaagacgtgctggataagaaccatgtcgccgacatcgataaacttattgactatgctgcctccggcgatccgaccagccctgacaatatcgactctcccaacgcgccttgggtgtttgcctgcgctcccgatcggtgtccccctacctgcatctacgttgccgggatggctgaactgggagccttcttttccattctccaggacatgagaaatacaatcatggccagcaaaacggtgggcaccgctgaggaagaggtcaagaaaaagtcttccttctaccagagctatctgcgccggacacaatccatggggattcagctggatcagagaatcattctcctgttcatgcttgaatggggaaaagagatggtggaccactttcatctgggcgatgacatggatccggagctccgcggcctggcgcaggcccttatcgaccaaaacgttaaggaaatctctaatcaggagcccctgaagatttga

SEQ ID NO: 7213 - RNA, 1302 nt, synthetic construct
  misc_feature 1..1302: note = derived and/or modified CDS sequence (opt5) from PUUV(PUUV/Konnevesi/Mg_O6B/2005)__JQ319164.1__N
  source 1..1302: mol_type = other RNA
atgagcgacctgaccgatatccaggaggacattacaagacacgaacaacagctcgtggtcgcccggcagaagctgaaagatgctgagcgcgccgttgaagtggaccccgatgacgtgaacaagaatacgcttcaggcgagacaacagaccgtctccgctctggaggataaactcgccgactacaagcggcgcatggccgatgctgtgtctagaaagaagatggacacaaagcctaccgatccgacaggcatcgaacccgacgatcatctgaaagagcggagctcccttcgctatgggaacgttctggacgtgaatgccattgacatcgaggaaccttctggacagaccgctgattggtacacaattggcgtctatgtgatcgggttcaccctccccatcattctgaaggccctgtacatgctcagcacgagaggacggcagaccgttaaagagaacaagggcacacgcatcagatttaaagacgatacctccttcgaagacattaatgggatccggcgccctaagcacctgtatgtgtctatgcccacagcgcaaagcaccatgaaggccgaggagcttacgcctggaagatttcgggctattgtctgcggcctgttcccgacacagatccaggtgcgcaacattatgtcccccgtgatgggcgtcatcgggtttagcttctttgttaaagattggcctgaaagaatccgggagttcatgggaaaggaatgtccctttattaaacctgaggtgaagcccggcaccccggcccaggaaatcgagatgctcaaaagaaataagatttacttcatgcaacgccaggacgtgctggataaaaaccatgtcgctgacatcgataaacttattgactatgccgcgtctggggatcctacatcccccgacaatatcgacagccctaacgccccctgggtgtttgcttgcgcccccgatcggtgtcctccgacctgcatctacgttgctggaatggccgagctgggcgccttcttttctattctccaggacatgagaaataccatcatggcttccaagacagtggggacggcggaagagaaactgaagaaaaagagctctttctaccaatcctatctgcgccggacccagagcatgggcattcagctcgatcagagaatcattctgcttttcatgctggaatggggaaaagagatggtcgaccactttcatctcggcgatgacatggatcccgaactgcgcgggcttgcccaagctctgatcgaccagaaggtgaaggagatctccaaccaggagcctctcaaaatttga

SEQ ID NO: 7214 - RNA, 1302 nt, synthetic construct
  misc_feature 1..1302: note = derived and/or modified CDS sequence (opt5) from PUUV(PUUV/Konnevesi/Mg_O74B/2005)__JQ319170.1__N
  source 1..1302: mol_type = other RNA
atgagcgacctgaccgatatccaggaggacattacaagacacgaacaacagctcgtggtcgcccggcagaagctgaaagatgctgagcgcgccgttgaagtggaccccgatgacgtgaacaagaatacgcttcaggcgagacaacagaccgtctccgctctggaggataaactcgccgactacaagcggcgcatggccgatgctgtgtctagaaagaagatggacacaaagcctaccgatccgacaggcatcgaacccgacgatcatctgaaagagcggagctcccttcgctatgggaacgttctggacgtgaatgccattgacatcgaggaaccttctggacagaccgctgattggtacacaattggcgtctatgtgatcgggttcaccctccccatcattctgaaggccctgtacatgctcagcacgagaggacggcagaccgttaaagagaacaagggcacacgcatcagatttaaagacgatacctccttcgaagacattaatgggatccggcgccctaagcacctgtatgtgtctatgcccacagcgcaaagcaccatgaaggccgaggagcttacgcctggaagatttcggacaattgtctgcggcctgttcccgacccagatccaggtgcgcaacattatgtcccccgtgatgggcgtcatcgggtttagcttctttgttaaagattggcctgaaagaatccgggagttcatggaaaaggagtgtccctttattaaacctgaagtgaagcccggaacaccggctcaggagatcgagatgctcaaaagaaataagatttacttcatgcaacgccaggacgtgctggataaaaaccatgtcgccgacatcgataaacttattgactatgctgcctctggcgatcctacctcccccgacaatatcgacagccctaacgcgccctgggtgtttgcctgcgctcccgatcggtgtcctccgacctgcatctacgttgccgggatggctgaactgggagccttcttttctattctccaggacatgagaaatacaatcatggcctccaagacggtgggcaccgtcgaggaaaaactgaagaaaaagagctctttctaccaatcctatctgcgccggacacagagcatggggattcagctcgatcagagaatcattctgcttttcatgctggagtggggaaaagaaatggtggaccactttcatctcggcgatgacatggatcccgagctgcgcggccttgctcaagcgctgatcgaccagaaggttaaggagatctccaaccaggaacctctcaaaatttga

SEQ ID NO: 7215 - RNA, 1302 nt, synthetic construct
  misc_feature 1..1302: note = derived and/or modified CDS sequence (opt5) from PUUV(PUUV/Konnevesi/Mg_O78A/2005)__JQ319162.2__N
  source 1..1302: mol_type = other RNA
atgagcgacctgaccgatatccaggaggacattacaagacacgaacaacagctcgtggtcgcccggcagaagctgaaagatgctgagaaggccgttgaagtggaccccgatgacgtgaacaaaaatacgcttcaggcgcgccaacagaccgtctccgctctggaggataagctcgccgactacaaaagacggatggccgatgctgtgtctcgcaagaagatggacacaaaacctaccgatccgacaggcatcgaacccgacgatcatctgaaggagagaagctcccttcggtatgggaacgttctggacgtgaatgccattgacatcgaggaaccttctggacagaccgctgattggtacacaattggcgtctatgtgatcgggttcaccctccccatcattctgaaagccctgtacatgctcagcacgcgcggaagacagaccgttaaggagaacaaaggcacacggatccgctttaaggacgatacctccttcgaagacattaatgggatcagacggcctaagcacctgtatgtgtctatgcccacagcgcaaagcaccatgaaagccgaggagcttacgcctggacgctttagaacaattgtctgcggcctgttcccgacccagatccaggtgcggaacattatgtcccccgtgatgggcgtcatcgggtttagcttctttgttaaggattggcctgaacgcatcagagagttcatggaaaaagagtgtccctttattaagcctgaagtgaaacccggaacaccggctcaggagatcgagatgctcaagcggaataaaatttacttcatgcaaagacaggacgtgctggataagaaccatgtcgccgacatcgataaacttattgactatgctgcctctggcgatcctacctcccccgacaatatcgacagccctaacgcgccctgggtgctggcctgcgggcccgaacgctgtcctccgacctgcatctacgttgctggaatggccgagctcggcgcctttttctctattctgcaggatatgcggaatacaatcatggcttccaagacggtggggagcgacgaagtcaagctgaaaaagaaatcctttttctaccaatattacctcagacgcacccactctatgggcattcagctggatcagcggatcattcttctgtgtatgctcgagtggggaatcgaaatggtggaccatttccacctgggcgatgacatggatcccgagcttagagggctggcccaggctatgatcgaccaaaaggttaaggagattagcaaccaggaacctctcatcatttga

SEQ ID NO: 7216 - RNA, 1302 nt, synthetic construct
  misc_feature 1..1302: note = derived and/or modified CDS sequence (opt5) from PUUV(PUUV/Mg23/HungaryTR17/00)__FN377822.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacggatggccgatgctgtctctcgcaagaagatggacacaaaacctaccgatccgacaggcatcgaacccgacgatcatctgaaggagagaagctcccttcggtacgggaacgtgctggacgttaatgccattgacatcgaggaaccttctggacagaccgctgattggtatacaattggcgtgtacgtcatcgggtttaccctccccatcattctgaaagccctgtatatgctcagcacgcgcggaagacagaccgtgaaggagaacaaaggcacacggatccgcttcaaggacgatacctcctttgaagacattaatgggatcagacggcctaagcacctgtacgtttctatgcccacagcgcaaagcaccatgaaagccgaggagcttacgcctggacgcttcagaacaattgtgtgcggcctgtttccgacccagatccaggtccggaacattatgtcccccgtgatgggcgtgatcgggttcagctttttcgtcaaggattggtctgaacgcgttagagagtttatggaaaaagagtgtcctttcatcaagcccgaaattaaacctggaacacccccgcaggaggctgagtttctcaagcggaataaagtgtatttcatgcaaagacaggacgtgctggataagaaccatgtcgccgacatcgataaacttattgactacgctgcctccggcgatcctaccagccccgacaatatcgaatctcctaacgcgccctgggtgtttgcctgcgctcccgaccgctgtcctccgacctgcatttatgttgccgggatggctgagctgggagccttcttctccatcctccaggatatgcggaatacaatcatggccagcaagacggtgggcaccgctgaagagaagctgaaaaagaaatcttccttttaccaaagctacctgagacgcacacagtccatggggattcagctcgaccagcggatcattctgctttatatgctggaatggggaaaggagatggtcgatcacttccatctcggcgacgatatggaccccgagctgagaggccttgcgcaagccctgatcgatcagaaggtgaaagaaatttctaaccaggagcctctcaagatctga

SEQ ID NO: 7217 - RNA, 1302 nt, synthetic construct
  misc_feature 1..1302: note = derived and/or modified CDS sequence (opt5) from PUUV(PUUV/Mg9/HungaryTR17/00)__FN377821.1__N
  source 1..1302: mol_type = other RNA
atgagcgacctggccgatatccaggaggacattaccagacacgaacaacagctcgtggtcgctcggcagaagctgaaagatgccgagaaggcggttgaaatggaccccgatgacgtgaacaaaaatacacttcaggctcgccaacagacggtgtccgccctggaggataagctcgccgacttcaaaagacggatggctgatgccgtctctcgcaagaagatggacaccaaacctacagatccgaccggcatcgaacccgacgatcatctgaaggagagaagctcccttcggtacgggaacgtgctggacgttaatgctattgacatcgaggaaccttctggacagacagccgattggtataccattggcgtgtacgtcatcgggtttacactccccatcattctgaaagcgctgtatatgctcagcacccgcggaagacagacggtgaaggagaacaaaggcacccggatccgcttcaaggacgatacatcctttgaagacattaatgggatcagacggcctaagcacctgtacgtttctatgcccaccgcccaaagcacaatgaaagctgaggagcttacccctggacgcttcagaacgattgtgtgcggcctgtttccgacacagatccaggtccggaacattatgtcccccgtgatgggcgtgatcgggttcagctttttcgtcaaggattggtctgaacgcgttagagagtttatggaaaaagagtgtcctttcatcaagcccgaaattaaacctggaacacccccgcaggaggccgagtttctcaagcggaataaagtgtatttcatgcaaagacaggacgtgctggataagaaccatgtcgctgacatcgataaacttattgactacgccgcgtccggcgatcctaccagccccgacaatatcgaatctcctaacgccccctgggtgtttgcttgcgcccccgaccgctgtcctccgacctgcatttatgttgctgggatggccgagctgggagccttcttctccatcctccaggatatgcggaataccatcatggctagcaagacagtgggcacggcggaagagaagctgaaaaagaaatcttccttttaccaaagctacctgagacgcacccagtccatggggattcagctcgaccagcggatcattctgctttatatgctggaatggggaaaggagatggtcgatcacttccatctcggcgacgatatggaccccgagctgagaggccttgcccaagctctgatcgatcagaaggtgaaagaaatttctaaccaggagcctctcaagatctga

SEQ ID NO: 7218 - RNA, 1302 nt, synthetic construct
  misc_feature 1..1302: note = derived and/or modified CDS sequence (opt5) from PUUV(PUUV/NL/Mg1012/2010)__KU314900.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgactacaaaagacggatggccgatgctgtctctcgcaagaagatggacacaaaacctaccgatccgacaggcatcgaacccgacgatcatctgaaggagagaagctcccttcggtatgggaacgtgctggacgttaatgccattgacatcgaggaaccttctggacagaccgctgattggtacacaattggcgtgtatgtcatcgggttcaccctccccatcattctgaaagccctgtacatgctcagcacgcgcggaagacagaccgtgaaggagaacaaaggcacacggatccgctttaaggacgatacctccttcgaagacattaatgggatcagacggcctaagcacctgtatgtttctatgcccacagcgcaaagcaccatgaaagccgaggagcttacgcctggacgctttagaacaattgtgtgcggcctgttcccgacccagatccaggtccggaacattatgtcccccgtgatgggcgtgatcgggtttagcttctttgtcaaggattggcctgaccgcatcagagagttcatggaaaaagaatgtccctttattaagcctgaggttaaacccggaacaccggctcaggaagccgagttcctcaagcggaataaagtgtactttatgcaaagacaggatgtgctggacaagaaccatgtcgctgatatcgacaaacttattgattatgccgcgtctggcgaccctacctcccccgacaatatcgagagccctaacgccccctgggtgttcgcttgcgcccccgatcgctgtcctccgacctgcatttacgttgctgggatggccgaactgggagcctttttctctatcctccaggacatgcggaatacaatcatggcttccaagacggtgggcgcggccgaggaaaagctgaaaaagaaaagctctttctaccaatcctatctgagacgcacccagagcatggggattcagctcgatcagcggatcattctgctttacatgctggagtggggaaaggaaatggtcgaccactttcatctcggcgatgacatggatcccgagctgagaggccttgctcaagccctgatcgaccagaaggtgaaagagatttccaaccaggaacctctcaagatctga

SEQ ID NO: 7219 - RNA, 1302 nt, synthetic construct
  misc_feature 1..1302: note = derived and/or modified CDS sequence (opt5) from PUUV(PUUV/NL/Mg1439/2011)__KU314901.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgactacaaaagacggatggccgatgctgtctctcgcaagaagatggacacaaaacctaccgatccgacaggcatcgaacccgacgatcatctgaaggagagaagctcccttcggtatgggaacgtgctggacgttaatgccattgacatcgaggaaccttctggacagaccgctgattggtacacaattggcgtgtatgtcatcgggttcaccctccccatcattctgaaagccctgtacatgctcagcacgcgcggaagacagaccgtgaaggagaacaaaggcgcgcggatccgctttaaggacgatacatccttcgaagacattaatgggatcagacggcctaagcacctgtatgtttctatgcccaccgcccaaagcacaatgaaagctgaggagcttacccctggacgctttagaacgattgtgtgcggcctgttcccgacacagatccaggtccggaacattatgtcccccgtgatgggcgtgatcgggtttagcttctttgtcaaggattggcctgaccgcatcagagaatttatggagcgggaatgtccctttattaaacctgaggttaagcccggaaccccggcccaggaagctgagttcctcaaaagaaataaggtgtactttatgcaacgccaggatgtgctggacaaaaaccatgtcgccgatatcgacgagcttattgattatgcggcctctggcgaccctacatcccccgacaatatcgaaagccctaacgctccctgggtgttcgcctgcgctcccgatcggtgtcctccgacctgcatttacgttgccgggatggccgagctgggagctttcttctctatcctccaggacatgagaaataccatcatggcgtccaagacagtgggcacggccgaagagaagctgaaaaagaaaagctctttctaccaatcctatctgcgccggacccagagcatggggattcagctcgatcagagaatcattctgctttacatgctggaatggggaaaggagatggtcgaccactttcatctcggcgatgacatggatcccgagctgcgcggccttgctcaagccctgatcgaccagaaagtgaaggaaatttccaaccaggagcctctcaagatctga

SEQ ID NO: 7220 - RNA, 1302 nt, synthetic construct
  misc_feature 1..1302: note = derived and/or modified CDS sequence (opt5) from PUUV(PUUV/NL/Mg2/2008)__KU314902.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaacgacccttcaggcgcgccaacagacagtgtccgctctggaggataagctcgccgacttcaaaagacagatggccgatgctgtctctcggaagaagatggacaccaaacctgccgatccgacaggcatcgaacccgacgatcatctgaaggagcgcagctcccttagatacgggaatgtgctggacgttaacgctattgacatcgaggaaccttctggacagaccgccgattggtatacaattggcgtgtacgtcatcgggtttaccctccccatcattctgaaagcgctgtatatgctcagcacgcggggacgccaaaccgtgaaggagaataaaggcacaagaatccggttcaaggacgatacctcctttgaagacattaacgggatccgcagacctaagcacctgtacgtttctatgcccacagcccagagcaccatgaaagctgaggagcttacgcctggacggttccgcacaattgtgtgcggcctgtttccgacccagatccaggtcagaaatattatgtcccccgtgatgggcgtgatcgggttcagctttttcgtcaaggattgggccgaccggatccgcgaatttatggagaaagaatgtcctttcattaagcccgatgttaaacctggaacacccgctcaagaggccgaatttctcaagagaaacaaaatctatttcatgcagcggcaggaggtgctggacaagaatcatgtggcggatattgacaaacttatcgattacgccgcttctggcgacccgacctcccctgacaacattgagagccccaattctccttgggtctttgcctgcgctcccgatagatgtccccctacctgcatctatgtggccgggatggccgaactgggagctttcttctccatcctccaagacatgcgcaacacaattatggcgagcaagacggttggcaccgccgaggaaaagctgaaaaagaaatcttccttttaccagagctacctgcggagaacacagtccatggggatccagctcgatcaacgcattatcctgctttatatgctggagtggggaaaggaaatggtggaccacttccatctcggcgatgacatggatccggagctgcggggccttgctcaggccctgattgaccagaaggtcgaggaaatctctaatcaggagcccctcaaaatctga

SEQ ID NO: 7221 - RNA, 1302 nt, synthetic construct
  misc_feature 1..1302: note = derived and/or modified CDS sequence (opt5) from PUUV(PUUV/NL/Mg25/2007)__KU314897.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgactacaaaagacggatggccgatgctgtctctcgcaagaagatggacacaaaacctaccgatccgacaggcatcgaacccgacgatcatctgaaggagagaagctcccttcggtatgggaacgtgctggacgttaatgccattgacatcgaggaaccttctggacagaccgctgattggtacacaattggcgtgtatgtcatcgggttcaccctccccatcattctgaaagccctgtacatgctcagcacgcgcggaagacagaccgtgaaggagaacaaaggcacacggatccgctttaaggacgatacctccttcgaagacattaatgggatcagacggcctaagcacctgtatgtttctatgcccacagcgcaaagcaccatgaaagccgaggagcttacgcctggacgctttagaacaattgtgtgcggcctgttcccgacccagatccaggtccggaacattatgtcccccgtgatgggcgtgatcgggtttagcttctttgtcaaggattggcctgaccgcatcagagagttcatggaaaaagaatgtccctttattaagcctgaggttaaacccggaacaccggctcaggaagccgagttcctcaagcggaataaagtgtactttatgcaaagacaggatgtgctggacaagaaccatgtcgctgatatcgacaaacttattgattatgccgcgtctggcgaccctacctcccccgacaatatcgagagccctaacgccccctgggtgttcgcttgcgcccccgatcgctgtcctccgacctgcatttacgttgctgggatggccgaactgggagcctttttctctatcctccaggacatgcggaatacaatcatggcttccaagacggtgggcaccgcggaggaaaagctgaaaaagaaaagctctttctaccaatcctatctgagacgcacacagagcatggggattcagctcgatcagcggatcattctgctttacatgctggagtggggaaaggaaatggtcgaccactttcatctcggcgatgacatggatcccgagctgagaggccttgcccaagctctgatcgaccagaaggtgaaagagatttccaaccaggaacctctcaagatctga

SEQ ID NO: 7222 - RNA, 1302 nt, synthetic construct
  misc_feature 1..1302: note = derived and/or modified CDS sequence (opt5) from PUUV(PUUV/NL/Mg31/2007)__KU314896.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgactacaaaagacggatggccgatgctgtctctcgcaagaagatggacacaaaacctaccgatccgacaggcatcgaacccgacgatcatctgaaggagagaagctcccttcggtatgggaacgtgctggacgttaatgccattgacatcgaggaaccttctggacagaccgctgattggtacacaattggcgtgtatgtcatcgggttcaccctccccatcattctgaaagccctgtacatgctcagcacgcgcggaagacagaccgtgaaggagaacaaaggcacacggatccgctttaaggacgatacctccttcgaagacattaatgggatcagacggcctaagcacctgtatgtttctatgcccacagcgcaaagcaccatgaaagccgaggagcttacgcctggacgctttagaacaattgtgtgcggcctgttcccgacccagatccaggtccggaacattatgtcccccgtgatgggcgtgatcgggtttagcttctttgtcaaggattggcctgaccgcatcagagagttcatggaaaaagaatgtccctttattaagcctgaggttaaacccggaacaccggctcaggaagccgagttcctcaagcggaataaagtgtactttatgcaaagacaggatgtgcctgacaagaaccatgtcgctgatatcgacaagctgattgattatgccgcgtctggcgaccccacctcccctgacaatatcgagagccccaacgccccctgggtgttcgcttgcgcccctgatcgctgtccgcctacctgcatttacgttgctgggatggccgaacttggagcctttttctctatcctgcaggacatgcggaatacaatcatggcttccaaaacggtgggcaccgcggaggaaaagctcaaaaagaaaagctctttctaccaatcctatctgagacgcacacagagcatggggattcagctggatcagcggatcattctcctgtacatgcttgagtggggaaaggaaatggtcgaccactttcatctgggcgatgacatggatcccgagctcagaggcctggcccaagctcttatcgaccagaaggtgaaagagatttccaaccaggaacccctgaagatctga

SEQ ID NO: 7223 - RNA, 1302 nt, synthetic construct
  misc_feature 1..1302: note = derived and/or modified CDS sequence (opt5) from PUUV(PUUV/NL/Mg502/2008)__KU314904.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacagatggccgatgctgtctctcggaagaagatggacacaaaacctgccgatccgaccggcatcgaacccgacgatcatctgaaggagcgcagctcccttagatacgggaacgtgctggacgttaatgctattgacatcgaggaaccttctggacagacagccgattggtataccattggcgtgtacgtcatcgggtttacactccccatcattctgaaagcgctgtatatgctcagcacccggggacgccaaacggtgaaggagaacaaaggcaccagaatccggttcaaggacgatacatcctttgaagacattaatgggatccgcagacctaagcacctgtacgtttctatgcccaccgcccagagcacaatgaaagctgaggagcttacccctggacggttccgcacgattgtgtgcggcctgtttccgacacagatccaggtcagaaacattatgtcccccgtgatgggcgtgatcgggttcagctttttcgtcaaggattgggccgaccggatccgcgaatttatggagaaagaatgtcctttcattaagcccgatgttaaacctggaacccccgctcaagaggccgaatttctcaagagaaataaaatctatttcatgcagcggcaggaggtgctggacaagaaccatgtggcggatattgacaaacttatcgattacgccgcttctggcgacccgacatcccctgacaatattgagagccccgattctccttgggtctttgcctgcgctcccgacagatgtccccctacctgcatctatgtggccgggatggccgaactgggagctttcttctccatcctccaagatatgcgcaacaccattatggcgagcaagacagttggcacggccgaggaaaagctgaaaaagaaatcttccttttaccagagctacctgcggagaacccagtccatggggatccagctcgaccaacgcattatcctgctttatatgctggagtggggaaaggaaatggtggatcacttccatctcggcgacgatatggacccggagctgcggggccttgctcaggccctgattgatcagaaggtcaaagagatctctaatcaggaacccctcaagatctga

SEQ ID NO: 7224 - RNA, 1302 nt, synthetic construct
  misc_feature 1..1302: note = derived and/or modified CDS sequence (opt5) from PUUV(PUUV/NL/Mg591/2008)__KU314905.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacagatggccgatgctgtctctcggaagaagatggacacaaaacctaccgatccgacaggcatcgaacccgacgatcatctgaaggagcgcagctcccttagatacgggaacgtgctggacgttaatgccattgacatcgaggaaccttctggacagaccgctgattggtatacaattggcgtgtacgtcatcgggtttaccctccccatcattctgaaagccctgtatatgctcagcacgcggggacgccaaaccgtgaaggagaacaaaggcacaagaatccggttcaaggacgatacctcctttgaagacattaatgggatccgcagacctaagcacctgtacgtttctatgcccacagcgcagagcaccatgaaagccgaggagcttacgcctggacggttccgcacaattgtgtgcggcctgtttccgacccagatccaggtcagaaacattatgtcccccgtgatgggcgtgatcgggttcagctttttcgtcaaggattgggctgaccggatccgcgaatttatggagaaagaatgtcctttcattaagcccgatgttaaacctggaacacccgcccaagaggctgaatttctcaagagaaataaaatctatttcatgcagcggcaggaggtgctggacaagaaccatgtggccgatattgacaaacttatcgattacgcggcctctggcgacccgacctcccctgacaatattgagagccccaactctccttgggtctttgcttgcgcccccgatagatgtccccctacctgcatctatgtggctgggatggccgaactgggagccttcttctccatcctccaagacatgcgcaatacaattatggctagcaagacggttggcaccgcggaggaaaagctgaaaaagaaatcttccttttaccagagctacctgcggagaacacagtccatggggatccagctcgatcaacgcattatcctgctttatatgctggagtggggaaaggaaatggtggaccacttccatctcggcgatgacatggatccggagctgcggtctcttgcccaggctctgattgaccagaaggtcaaagagatcagcaaccaggaacccctcaagatctga

SEQ ID NO: 7225 - RNA, 1302 nt, synthetic construct
  misc_feature 1..1302: note = derived and/or modified CDS sequence (opt5) from PUUV(Samara_49/CG/2005)__AB433843.2__N
  source 1..1302: mol_type = other RNA
atgagcgacctgaccgatatccaggaggaaattacaagacacgagcaacagctcgtggtcgcccggcagaagctgaaagacgctgaacgcgccgttgaggtggatcccgacgatgtgaacaagaatacgcttcaggcgagacaacagaccgtctccgctctggaagacaaactcgccgattacaagcggcgcatggccgacgctgtgtctcggaaaaagatggatacaaagcctaccgacccgacaggcatcgagcccgatgaccatctgaaagagcggagctcccttcgctatgggaacgttctggatgtgaatgccattgacatcgaagaaccttctggacagaccgctgactggtacacaattggcgtctatgtgatcgggttcaccatccccattatcctcaaggccctgtacatgctgagcacgagaggacggcagaccgttaaagaaaacaagggcacacgcattagatttaaagatgacacctccttcgaggatatcaatgggattcggcgccctaagcacctctatgtgtctatgcccacagcgcaaagcaccatgaaggccgaggaactgacgcctggaagatttcggacaatcgtctgcggccttttcccgacccagattcaggtgcgcaacatcatgtcccccgtgatgggcgtcatcgggtttagcttctttgttaaagactggcctgagagaattagagagttcatggagagagaatgtccctttatcaagcctgaggtgaaacccggaacaccggctcaggaggtggagttcctgaagcgcaatcgggtctactttatgaccagacaagatgtgctcgacaaaaaccatgttgccgatattgacaagctgatcgattatgctgcctctggcgaccctacctcccccgatgacattgaaagccctaatgcgccctgggtgttcgcctgcgctcccgaccgctgtcctccgacatgcatctacgtcgccgggatggctgaacttggagcctttttctctatcctgcaggatatgcggaacacgattatggcctccaaaaccgtgggcacagctgaggaaaagctcaagaaaaagagctctttctaccagtcctatctgagacgcacccaaagcatggggatccagctggaccagcggattatcctcctgtacatgcttgagtggggaaaagagatggttgatcactttcatctgggcgacgatatggaccccgaactcagaggcctggcgcagtcccttattgatcaaaaggtgaaagagatctctaatcaggaacctctgaagatctga

SEQ ID NO: 7226 - RNA, 1302 nt, synthetic construct
  misc_feature 1..1302: note = derived and/or modified CDS sequence (opt5) from PUUV(Thuin/33Cg/96)__AJ277030.1__N
  source 1..1302: mol_type = other RNA
atgagcgacctgaccgatatccaggaggacattacaagacacgaacaacagctcgtggtcgcccggcagaagctgaaagatgctgagaaggccgttgaaatggaccccgatgacgtgaacaaaaatacgcttcaggcgcgccaacagaccgtgtccgctctggaggataagctcgccgacttcaaaagacagatggccgatgctgtctctcggaagaagatggacacaaaacctaccgatccgacaggcatcgaacccgacgatcatctgaaggagcgcagctcccttagatacgggaacgtgctggacgttaatgccattgacatcgaggaaccttctggacagaccgctgattggtatacaattggcgtgtacgtcatcgggtttaccctccccatcattctgaaagccctgtatatgctcagcacgcggggacgccaaaccgtgaaggagaacaaaggcacaagaatccggttcaaggacgatacctcctttgaagacattaatgggatccgcagacctaagcacctgtacgtttctatgcccacagcgcagagcaccatgaaagccgaggagcttacgcctggacggttccgcacaattgtgtgcggcctgtttccgacccagatccaggtcagaaacattatgtcccccgtgatgggcgtgatcgggttcagctttttcgtcaaggattgggctgaccggatccgcgaatttatggagaaagaatgtcctttcattaagcccgaggttaaacctggaacacccgtgcaagaagccgagtttctcaagagaaataaaatctatttcatgcagcggcaggaggtgctggataagaaccatgtcgctgacattgataaacttatcgactacgccgcgtctggcgatccgacctcccctgacaatattgaagcccccaacgctccttgggtgtttgcctgcgctcccgacagatgtccccctacctgcatctatgttgccgggatggccgagctgggagctttcttcagcatcctccaagatatgcgcaatacaattatggcgtctaagacggtgggcaccgccgaagagaagctgaaaaagaaatccagcttttaccagtcttacctgcggagaacacagtccatggggatccagctcgaccaacgcattatcctgctttatatgctggaatggggaaaggagatggtcgatcacttccatctcggcgacgatatggacccggagctgcggggccttgctcaggccctgattgatcagaaggtgaaagaaatcagcaaccaggagcccctcaagatctga

SEQ ID NO: 7227 - RNA, 1302 nt, synthetic construct
  misc_feature 1..1302: note = derived and/or modified CDS sequence (opt5) from PUUV(Udmurtia/338Cg/92)__Z30708.1__N
  source 1..1302: mol_type = other RNA
atgagcgacctgaccgatatccaggaggaaattacaagacacgagcaacagctcgtggtcgcccggcagaagctgaaagacgctgaacgcgccgttgaggtggatcccgacgatgtgaacaagaatacgcttcaggcgagacaacagaccgtctccgctctggaagacaaactcgccgattacaagcggcgcatggccgactctgtgagccggaaaaagatggatacaaagcctaccgacccgacaggcatcgagcccgatgaccatctgaaagagagatcctctcctcgctatgggaacgttcttgatgtgaatgctattgacatcgaggaacccagcggacagaccgccgactggtacacaattggcgtctatgtgatcgggttcaccatccctattatcctgaaggctctctacatgctgtccacgagaggacggcagaccattaaagaaaacaagggcacacgcatcagatttaaagatgacacctctttcgaggatattaatgggatccggcgccccaagcacctgtatgttagcatgcctacagcccaatccaccatgaaggcggaggaactcacgccgggaagatttcggacaattgtgtgcggcctgttccccacccagatccaggtccgcaacatcatgagccctgtgatgggcgtgattgggttttctttctttgtcaaagactggcccgagagaatccgggatttcatggaaaaggagtgtccttttattaaacccgaagttaagccgggaacccctgcccaggagatcgagttccttaaaagaaatcgcgtgtactttatgacacggcaagacgtgctggataagaaccatgtcgctgacattgataaactcatcgactatgccgcttccggcgatcccaccagccctgacgacatcgaatctcccaatgccccctgggtgttcgcgtgcgcccctgatagatgtccgcccacatgcatttacgttgctgggatggccgagctgggagcctttttctccatccttcaggacatgcgcaacacgattatggctagcaagaccgtgggcacagccgaagagaagctgaaaaagaaatcttccttctaccagagctatctccggagaacccaatccatggggatccagctggatcagcgcattatcctgctctacatgctggaatggggaaaggagatggtcgaccactttcatcttggcgatgacatggatcctgagctgcggggcctcgctcagtctctgatcgaccaaaaagtgaaggaaattagcaatcaggagccccttaagatctga

SEQ ID NO: 7228 - RNA, 1302 nt, synthetic construct
  misc_feature 1..1302: note = derived and/or modified CDS sequence (opt5) from PUUV(Udmurtia/444Cg/88)__Z30706.1__N
  source 1..1302: mol_type = other RNA
atgagcgacctgaccgatatccaggaggaaattacaagacacgagcaacagctcgtggtcgcccggcagaagctgaaagacgctgaacgcgccgttgaggtggatcccgacgatgtgaacaagaatacgcttcaggcgagacaacagaccgtctccgctctggaagacaaactcgccgattacaagcggcgcatggccgacgctgtgtctcggaaaaagatggatacaaagcctaccgacccgacaggcatcgagcccgatgaccatctgaaagagcggagctcccttcgctatgggaacgttctggatgtgaatgccattgacatcgaggaaccttctggacagaccgctgactggtacacaattggcgtctatgtgatcgggttcaccatccccattatcctcaaggccctgtacatgctgagcacgagaggacggcagaccgttaaagaaaacaagggcacacgcattagatttaaagatgacacctccttcgaggatatcaatgggattcggcgccctaagcacctctatgtgtctatgcccacagcgcaaagcaccatgaaggccgaggaactgacgcctggaagatttcggacaatcgtctgcggccttttcccgacccagattcaggtgcgcaacatcatgtcccccgtgatgggcgtcatcgggtttagcttctttgttaaagactggcctgagagaattagagatttcatggaaaaggagtgtccctttatcaaacctgaagtgaagcccggaacaccggctcaggagattgagttcctgaaaagaaatcgcgtgtactttatgacccggcaagacgtcctcgataagaaccatgtggccgacatcgataaactgattgactatgctgcctctggcgatcctacctcccccgacgacatcgaaagccctaatgcgccctgggttttcgcctgcgctcccgatagatgtcctccgacatgcatctacgtggccgggatggctgagcttggagcctttttctctattctgcaggacatgcgcaacacgatcatggcctccaagaccgtcggcacagctgaagagaagctcaaaaagaaaagctctttctaccagtcctatctgcggagaacccaaagcatggggattcagctggatcagcgcatcattctcctgtacatgcttgaatggggaaaggagatggtggaccactttcatctgggcgatgacatggatcccgagctccggggcctggcgcagtcccttatcgaccaaaaagttaaggaaatctctaatcaggagcctctgaagatttga

SEQ ID NO: 7229 - RNA, 1302 nt, synthetic construct
  misc_feature 1..1302: note = derived and/or modified CDS sequence (opt5) from PUUV(Udmurtia/894Cg/91)__Z21497.1__N
  source 1..1302: mol_type = other RNA
atgagcgacctgaccgatatccaggaggaaattacaagacacgagcaacagctcgtggtcgcccggcagaagctgaaagacgctgaacgcgccgttgaggtggatcccgacgatgtgaacaagaatacgcttcaggcgagacaacagaccgtctccgctctggaagacaaactcgccgattacaagcggcgcatggccgacgctgtgtctcggaaaaagatggatacaaagcctaccgacccgacaggcatcgagcccgatgaccatctgaaagagcggagctcccttcgctatgggaacgttctggatgtgaatgccattgacatcgaggaaccttctggacagaccgctgactggtacacaattggcgtctatgtgatcgggttcaccatccccattatcctcaaggccctgtacatgctgagcacgagaggacggcagaccgttaaagaaaacaagggcacacgcattagatttaaagatgacacctccttcgaggatatcaatgggattcggcgccctaagcacctctatgtgtctatgcccacagcgcaaagcaccatgaaggccgaggaactgacgcctggaagatttcggacaatcgtctgcggccttttcccgacccagattcaggtgcgcaacatcatgtcccccgtgatgggcgtcatcgggtttagcttctttgttaaagactggcctgagagaattagagatttcatggaaaaggagtgtccctttatcaaacctgaagtgaagcccggaacaccggctcaggagattgagttcctgaaaagaaatcgcgtgtactttatgacccggcaagacgtcctcgataagaaccatgtggccgacatcgataaactgattgactatgctgcctctggcgatcctacctcccccgacgacatcgaaagccctaatgcgccctgggttttcgcctgcgctcccgatagatgtcctccgacatgcatctacgtggtcgggatggccgagcttggagcctttttctctattctgcaggacatgcgcaacacgatcatggcttccaagaccgtgggcacagccgaagagaagctcaaaaagaaaagctctttctaccagtcctatctgcggagaacccaaagcatggggattcagctggatcagcgcatcattctcctgtacatgcttgaatggggaaaggagatggttgaccactttcatctgggcgatgacatggatcccgagctccggggcctggctcagtcccttatcgaccaaaaagtgaaggaaatctctaatcaggagcctctgaagatttga

SEQ ID NO: 7230 - RNA, 1302 nt, synthetic construct
  misc_feature 1..1302: note = derived and/or modified CDS sequence (opt5) from PUUV(Fusong-Cr-247)__EF442087.1__N
  source 1..1302: mol_type = other RNA
atgagcgacctgaaggatatccaggaggacattgccagacacgaacaacagctcgtggtcgctcggcagaaactgcgcgatgccgagaaggcggttgaaatggaccccgatgacgtgaacaataacacccttcaggctagacaacagacagtgtccgccctggaggataaaatcgccgacttcaagcggcgcatggctgatattgtctctcggaaaaagatggacacgaagcctgccgatccgaccggcatcgaacccgacgatcatctcaaagagagaagctccctgcgctacgggaatgtgcttgacgttaacgctattgacatcgaggaaccttctggacagacagccgattggtataccatcggcgtgtacattatcgggtttacactgcccattatcctcaaggcgctgtatatgctgagcaccagaggacggcagacagtcaaagagaataagggcacccgcattagattcaaagacgatacgtcctttgaagacgtgaacgggatccggcgccctaagcacctctacgtttctatgcccaccgcccaaagcacaatgaaggctgaggagctgacccctggaagattccggacaattgtgtgcggcctttttccgacccagatccaggtccgcaatacgatgtcccccgtgatgggcgtgatcgggttcagctttttcgccaaagattggcctgacagaattaaggaatttatggagaaagaatgtcccttcatcaagcctgaggtcaaacccggaacaccggctaaggaagttgagattctgaaacggaacaagatctattttatgcagagacaagatgtgctcgacaagaatcatgtgcctgatattgacaaactgatcgattacgccgcgtctggcgaccccacctcccctgagaacatcgacagccccaatgccccctgggtcttcgcttgcgcccctgatcgctgtccgcccacatgcatttatgtggctgggatggccgaacttggagcctttttctctatcctgcaggacatgcggaacaccattatggcttccaagaccgttggcacagcggaggaaaaactcaagaaaaagagctctttctaccagtcctacctgagacgcacgcaaagcatggggatccagctggatcagcggattatcctcctgtatatgcttgagtggggaaaggaaatggtggaccactttcatctgggcgatgacatggatcctgagctcagatccctggcccaggctcttatcgaccaaaaagtcaaggagatttctaatcaggaacccctgaaaatctga

SEQ ID NO: 7231 - RNA, 1302 nt, synthetic construct
  misc_feature 1..1302: note = derived and/or modified CDS sequence (opt5) from MUV(11-4)__JX046484.1__N
  source 1..1302: mol_type = other RNA
atgagcgacctgaaggagatccaggaagatattgccagacacgagcaacagctcgtggtcgctcggcagaaactgcgcgacgccgaaaaggcggttgaggtggatcccgacgatgtgaacaaaaatacccttcaggctagacaacagacagtctccgccctggaagacaagctcgccgatttcaaacggcagatggctgactttgtgtctcgcaagaagatggatacgaaacctaccgacccgacaggcatcgagcccgatgaccatctgaaggagagaagctcccttcggtacgggaacgttctggatgtgaatgccattgacatcgaggaaccttctggacagaccgctgactggtatacaattggcgtctacatcatcgggttcaccctccccattgtgctgaaagccctgtatatgctcagcacacgcggaagacaaaccgttaaggaaaacaaaggcacgcggatccgctttaaggatgacacctccttcgaggatattaatgggatcagacggcctaagcacctgtacgtgtctatgcccacagcgcagagcaccatgaaagccgaggaacttacacctggacgctttagaaccattgtctgcggcctgttcccgacgcagatccaggtgcggaacattatgtcccccgtgatgggcgtcatcgggtttagcttctttgttaaggactgggctgatcgcatcaaagagttcatggaaaaggagtgtccttttattaaacccgaacctaagcccggaacaccggcctctgaggtggagttcctcaaaagaaataagatctattttatgtcccggcaagacgtgctggataagaaccatgtccctgacattgataaacttatcgactacgctgccagcggcgatcccacctctcctgacaatattgaagaccccaacgcgccctgggtgttctcctgcgcccctgatagatgtccgcccacatgcctgtatgttgctgggatggccgagctcggagctttctttagcatcctgcaggacatgcgcaataccatcatggcctctaagaccgtgggcacagccgaagagaaactgaagaaaaagtccagcttctaccagtcctacctccggagaacgcaatctatggggattcagctggatcagcgcatcattcttctgtatatgctcgaatggggaaaggagatggtcgaccactttcatctgggcgatgacatggatcctgagcttcggaccctggctcaggcgctcatcgaccaaaaagtgaaggaaattagcaaccaggagcccctgaaaatctga

SEQ ID NO: 7232 - RNA, 1302 nt, synthetic construct
  misc_feature 1..1302: note = derived and/or modified CDS sequence (opt5) from MUV(00-18)__DQ138128.1__N
  source 1..1302: mol_type = other RNA
atgagcgacctgaaggagatccaggaagatattgccagacacgagcaacagctcgtggtcgctcggcagaaactgcgcgacgccgaaaaggcggttgaggtggatcccgacgatgtgaacaaaaatacccttcaggctagacaacagacagtctccgccctggaagacaagctcgccgatttcaaacggcagatggctgactttgtgtctcgcaagaagatggatacgaaacctaccgacccgacaggcatcgagcccgatgaccatctgaaggagagaagctcccttcggtacgggaacgttctggatgtgaatgccattgacatcgaagaaccttctggacagaccgctgactggtatacaattggcgtctacgtgatcgggttcaccctccccatcgttctgaaagccctgtatatgctcagcacacgcggaagacaaaccgtgaaggaaaacaaaggcacgcggattcgctttaaggatgacacctccttcgaggatatcaatgggattagacggcctaagcacctgtacgtctctatgcccacagcgcagagcaccatgaaagccgaggaacttacacctggacgctttagaaccatcgtgtgcggcctgttcccgacgcagattcaggtgcggaacatcatgtcccccgtcatgggcgttattgggtttagcttctttgtgaaggactgggtggagcgcatcaaagagttcatggagaaggaatgtccttttatcaaacccgagcctaagcccggaacaccggcttctgaggtcgagttcctcaaaagaaataagatttattttatgaaccggcaagatgtgctggacaagaatcatgttcctgatatcgacaaacttattgattacgccgcttccggcgaccccaccagccctgataacatcgaagaccccaatgccccctgggtgttctcttgcgcgcctgacagatgtccgcccacatgcctgtatgtcgccgggatggctgaactcggagccttcttttccattctgcaggatatgcgcaacaccatcatggctagcaagaccgtgggcacagccgaggaaaaactgaagaaaaagtcttccttctaccagagctacctccggagaacgcaatccatggggatccagctggaccagcgcattatccttctgtatatgctcgagtggggaaaggagatggttgatcactttcatctgggcgacgatatggaccctgaacttcggaccctggcccaggctctcattgatcaaaaagtgaaggagatctctaatcaggaacccctgaaaatttga

SEQ ID NO: 7233 - RNA, 1302 nt, synthetic construct
  misc_feature 1..1302: note = derived and/or modified CDS sequence (opt5) from MUV(11-1)__JX028273.1__N
  source 1..1302: mol_type = other RNA
atgagcgacctgaaggagatccaggaagatattgccagacacgagcaacagctcgtggtcgctcggcagaaactgcgcgacgccgaaaaggcggttgaggtggatcccgacgatgtgaacaaaaatacccttcaggctagacaacagacagtctccgccctggaagacaagctcgccgatttcaaacggcagatggctgactttgtgtctcgcaagaagatggatacgaaacctaccgacccgacaggcatcgagcccgatgaccatctgaaggagagaagctcccttcggtacgggaacgttctggatgtgaatgccattgacatcgaggaaccttctggacagaccgctgactggtatacaattggcgtctacatcatcgggttcaccctccccattgtgctgaaagccctgtatatgctcagcacacgcggaagacaaaccgttaaggaaaacaaaggcacgcggatccgctttaaggatgacacctccttcgaggatattaatgggatcagacggcctaagcacctgtacgtgtctatgcccacagcgcagagcaccatgaaagccgaggaacttacacctggacgctttagaaccattgtctgcggcctgttcccgacgcagatccaggtgcggaacattatgtcccccgtgatgggcgtcatcgggtttagcttctttgttaaggactgggctgatcgcatcaaagagttcatggaaaaggagtgtccttttattaaacccgaacctaagcccggaacaccggcctctgagatcgagttcctcaaaagaaataagatttattttatgtcccggcaagacgtgctggataagaaccatgtgcctgacatcgataaacttattgactacgctgccagcggcgatcccacctctcctgacaatatcgaagaccccaacgcgccctgggtcttctcctgcgcccctgatagatgtccgcccacatgcctgtatgtggctgggatggccgagctcggagctttctttagcatcctgcaggacatgcgcaataccattatggcctctaagaccgttggcacagccgaagagaaactgaagaaaaagtccagcttctaccagtcctacctccggagaacgcaatctatggggatccagctggatcagcgcattatccttctgtatatgctcgaatggggaaaggagatggtggaccactttcatctgggcgatgacatggatcctgagcttcggaccctggctcaggcgctcattgaccaaaaagtcaaggaaatcagcaaccaggagcccctgaaaatctga

SEQ ID NO: 7234 - RNA, 1302 nt, synthetic construct
  misc_feature 1..1302: note = derived and/or modified CDS sequence (opt5) from MUV(96-1)__DQ138133.1__N
  source 1..1302: mol_type = other RNA
atgagcgacctgaaggagatccaggaagatattgccagacacgagcaacagctcgtggtcgctcggcagaaactgcgcgacgccgaaaaggcggttgaggtggatcccgacgatgtgaacaaaaatacccttcaggctagacaacagacagtctccgccctggaagacaagctcgccgatttcaaacggcagatggctgactttgtgtctcgcaagaagatggatacgaaacctaccgacccgacaggcatcgagcccgatgaccatctgaaggagagaagctcccttcggtacgggaacgttctggatgtgaatgccattgacatcgaggaaccttctggacagaccgctgactggtatacaattggcgtctacgtgatcgggttcaccctccccatcgttctgaaagccctgtatatgctcagcacacgcggaagacaaaccgtgaaggaaaacaaaggcacgcggattcgctttaaggatgacacctccttcgaggatatcaatgggattagacggcctaagcacctgtacgtctctatgcccacagcgcagagcaccatgaaagccgaggaacttacacctggacgctttagaaccatcgtgtgcggcctgttcccgacgcagattcaggtgcggaacatcatgtcccccgtcatgggcgttattcgctttagcttcctcgtgaaggactggtctgagaaaatcaaggaatttatggagaaagaatgtcctttcatcaagcccgagcctaaacccgggacaccggcttccgagattgaatttctgaagagaaataagatctatttcatgaaccggcaagatgtgcttgacaaaaatcatgtccctgatattgacaagctgatcgattacgccgctagcggagaccccacctctcctgataacattgaggcccccaatgcgccctgggtgttttcctgcgcccctgacagatgtccgcccacatgcctctatgttgctggcatggccgaactgggggctttcttcagcatcctgcaggacatgcgcaacaccatcatggcctctaaaaccgtgggaacagccgaggaaaagctcaaaaagaagtccagcttttaccagtcctacctgcggagaacgcaatctatgggcattcagcttgatcagcgcatcattctgctctatatgctggagtgggggaaagagatggtcgaccacttccatcttggagatgacatggatcctgaactgcggaccctcgctcaggcgctgatcgaccaaaaggtgaaagagattagcaatcaggaacccctgaagatctga

SEQ ID NO: 7235 - RNA, 1302 nt, synthetic construct
  misc_feature 1..1302: note = derived and/or modified CDS sequence (opt5) from MUV(99-28)__DQ138142.1__N
  source 1..1302: mol_type = other RNA
atgagcgacctgaaggagatccaggaagatattgccagacacgagcaacagctcgtggtcgctcggcagaaactgcgcgacgccgaaaaggcggttgaggtggatcccgacgatgtgaacaaaaatacccttcaggctagacaacagacagtctccgccctggaagacaagctcgccgatttcaaacggcagatggctgactttgtgtctcgcaagaagatggatacgaaacctaccgacccgacaggcatcgagcccgatgaccatctgaaggagagaagctcccttcggtacgggaacgttctggatgtgaatgccattgacatcgaagaaccttctggacagaccgctgactggtatacaattggcgtctacgtgatcgggttcaccctccccatcgttctgaaagccctgtatatgctcagcacacgcggaagacaaaccgtgaaggaaaacaaaggcacgcggattcgctttaaggatgacacctccttcgaggatatcaatgggattagatctcctaagcacctgtacgtcagcatgcccacagcgcagtccaccatgaaagccgaggaacttacacctggacggtttcgcaccatcgtgtgcggcctgttcccgacgcagattcaggtgagaaacatcatgagccccgtcatgggcgttattgggttttctttctttgtgaaggactgggtggagcggatcaaagagttcatggagaaggaatgtccttttatcaaacccgagcctaagcccggaacaccggcttccgaggtcgagttcctcaaacgcaataagatttattttatgaacagacaagatgtgctggacaagaatcatgttcctgatatcgacaaacttattgattacgccgctagcggcgaccccacctctcctgataacatcgaagaccccaatgccccctgggtgttctcctgcgcgcctgaccggtgtccgcccacatgcctgtatgtcgccgggatggctgaactcggagccttctttagcattctgcaggatatgagaaacaccatcatggcttctaagaccgtgggcacagccgaggaaaaactgaagaaaaagtccagcttctaccagtcctacctccgccggacgcaatctatggggatccagctggaccagagaattatccttctgtatatgctcgagtggggaaaggagatggttgatcactttcatctgggcgacgatatggaccctgaacttcgcaccctggcccaggctctcattgatcaaaaagtgaaggagatcagcaatcaggaacccctgaaaatttga

SEQ ID NO: 7236 - RNA, 1290 nt, synthetic construct
  misc_feature 1..1290: note = derived and/or modified CDS sequence (opt5) from SANGV(SA14)__NC_034526.1__N
  source 1..1290: mol_type = other RNA
atggccaccctggaggaaatccagaaggagattaacatccacgaaggccaactcattatcgctaaacagaaggtgaaagacgccgagaagcagtacgaaaaagatcccgacgatctgaataagagagcgcttagcgaccgggaggggattgctcattccatccagtctaagatcgatgagctgcgcagacaactcgccgaccgggtcgccgctggacgcaacctgggccaggaaagagatcctacaggggttgagccgggagaccaccttcgggaaaagagcatgctgtcctatggcaatgtgattgatctcaaccatctggacatcgatgagcccacggggcagaccgccgactggctgtctattgtgatctacctcaccagcttcgtcgtgcctattctgcttaaggctctgtatatgctcacaacacgcggaagacagaccacaaaagataataagggcatgcggatccgctttaaagacgactcctctttcgaggatgttaacggcattagaaagcccaagcacctgtttcttagcatgcctaatgcccaatccagcatgaaagcggaagagatcacccccgggcggttccgcacggccgtgtgcggactgtaccctgctcagatcaaggccagaaacatggtctctccggtgatgtccgttattggctttatcaccctcgctcgggactggacagaacgcattgagaattggctggatcagccctgtaaattcatgagcgaaccttctcagacctccctgcaaaaggggcccgccacaaacagagactatctcaatcagcggcaggcgagcctggcccaaatggagaccaaagaggctcaggccgtgagacagcaggctgtcgatgccggatgcaaccttgtggaccatatcgattctccttccagcatttgggtgtttgccggcgctcccgaccgctgtccgcctacgtgcctgttcatctccgggatggcggaactcggagcctttttctctatcctgcaagatatgcggaatacaattatggctagcaagaccgtcggcacatccgaggaaaaacttagaaagaaaagctctttttaccagtcctatctgcgccggacccagagcatgggcatccagctcgaccaaagaattatcattatgttcatggttgagtgggggaaagaagccgtggatggatttcacctgggcgacgacatggatcccgagctgcgctctttcgcccaggctctcatcgaccagaaggtgaaagagatcagcaaccaggaacctctgaagatttga

SEQ ID NO: 7237 - RNA, 1290 nt, synthetic construct
  misc_feature 1..1290: note = derived and/or modified CDS sequence (opt5) from SANGV(SA22)__JQ082303.1__N
  source 1..1290: mol_type = other RNA
atggccaccctggaggaaatccagaaggagattaacatccacgaaggccaactcattatcgctaaacagaaggtgaaagacgccgagaagcagtacgaaaaagatcccgacgatctgaataagagagcgcttagcgaccgggaggggattgctcattccatccagtctaagatcgatgagctgcgcagacaactcgccgaccgggtcgccgctggacgcaacctgggccaggaaagagatcctacaggggttgagccgggagaccaccttcgggaaaagagcatgctgtcctatggcaatgtgattgatctcaaccatctggacatcgatgagcccacggggcagaccgccgactggctgtctattgtgatctacctcaccagcttcgtcgtgcctattctgcttaaggctctgtatatgctcacaacacgcggaagacagaccacaaaagataataagggcatgcggatccgctttaaagacgactcctctttcgaggatgttaacggcattagaaagcccaagcacctgtttcttagcatgcctaatgcccaatccagcatgaaagcggaagagatcacccccgggcggttccgcacggccgtgtgcggactgtaccctgctcagatcaaggccagaaacatggtctctccggtgatgtccgttattggctttatcaccctcgctcgggactggacagaacgcattgagaattggctggatcagccctgtaaattcatgagcgaaccttctcagacctccctgcaaaaggggcccgccacaaacagagactatctcaatcagcggcaggcgagcctggcccaaatggagaccaaagaggctcaggccgtgagacagcaggctgtcgatgccggatgcaaccttgtggaccatatcgattctccttccagcatttgggtgtttgccggcgctcccgaccgctgtccgcctacgtgcctgttcatctccgggatggcggaactcggagcctttttctctatcctgcaagatatgcggaatacaattatggctagcaagaccgtcggcacatccgaggaaaaacttagaaagaaaagctctttttaccagtcctatctgcgccggacccagagcatgggcatccagctcgaccaaagaattatcattatgttcatggttgagtgggggaaagaagtggtggatggatttcacctgggcgacgacatggatcccgagctgcgctctttcgcccaggccctcatcgaccagaaggtcaaagagatcagcaaccaggaacctctgaagatttga

SEQ ID NO: 7238 - RNA, 1290 nt, synthetic construct
  misc_feature 1..1290: note = derived and/or modified CDS sequence (opt5) from SEOV(L99)__AF288299.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcacactgcatgacagagagtccgttgctgcctctattcagagcaaaatcgatgagcttaagcggcaactggccgaccgcattgctgccgggaagaatatcggacaggatagagaccctacgggcgtggaaccgggggatcacctcaaagagcggtccgctctgtcttatggaaacacccttgacctgaatagcctcgatatcgacgaacccacaggccagaccgccgattggctgacaattatcgtgtacctgacctccttcgtcgtgcctattatcctcaaggcgctgtatatgcttacaacccgcgggagacagacgtctaaagacaacaagggaatgcggattcgctttaaagacgatagctcctacgaggacgttaatggcatcagaaagcccaagcatctgtatgtgagcatgcctaacgcccaatcttccatgaaagctgaggaaattacccccggccggttccgcacagccgtctgcgggctctaccctgctcagatcaaggccagaaatatggtgagcccggttatgtctgtggtcggatttctggcgcttgccaaagattggacctcccggatcgaggaatggctgggcgctccctgtaagttcatggccgagagccctattgctgggtctctctccggaaaccccgtgaatcgcgactatatcagacagcggcagggcgccctggccgggatggaacctaaagagtttcaagctctgagacagcacgcgaaggatgccggatgcacactcgtggagcatattgaaagcccctcctctatctgggtcttcgctggcgccccggaccgctgtcctcctacctgcctgtttgttggcgggatggccgagcttggagctttctttagcattctgcaggatatgcggaacacgatcatggcctccaaaacagtgggcaccgcggacgaaaagctcagaaagaaaagctctttctaccaatcctacctgcgccggacacagagcatggggatccagcttgatcagagaattatcgtgatgtttatggtcgcttggggaaaggaggccgtgtataatttccacctgggcgacgatatggaccccgaactccgctctctggcccaaattctgatcgaccagaaagttaaggagattagcaaccaggagcccatgaaactctga

SEQ ID NO: 7239 - RNA, 1290 nt, synthetic construct
  misc_feature 1..1290: note = derived and/or modified CDS sequence (opt5) from SEOV(SG42/2011)__KY807171.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggtccaccattatcgtgtacctgacatctttcgtcgtgcctattatcctgaaggccctctatatgctgaccacacgcgggagacagaccagcaaagacaacaagggaatgcggattcgctttaaagacgattccagctacgaggacgttaatggcatcagaaagcccaagcatctttatgtgtctatgcctaacgctcaatccagcatgaaagccgaggaaattacgcccggccggttccgcaccgctgtctgcgggctgtaccctgcccagatcaaggcgagaaatatggtgtctccggttatgtccgtggtcggatttctcgccctggctaaagattggagctctcggatcgaggaatggcttggcgccccctgtaagttcatggctgagtcccctattgccgggagcctgtccggaaaccccgtgaatcgcgactatatcagacagcggcagggcgccctcgctgggatggaacctaaagagtttcaagcgctgagacagcactctaaggatgccggatgcacactggtggagcatattgaaagcccctccagcatctgggtcttcgctggcgccccggaccgctgtcctcctacctgcctctttgttggcgggatggccgagctgggagctttcttttctattcttcaggatatgcggaacacaatcatggcctccaaaaccgtgggcacggcggacgaaaagctgagaaagaaaagctctttctaccaaagctacctccgccggacacagtccatggggatccagctggatcagagaattatcgtgatgtttatggtcgcttggggaaaggaggccgtggacaatttccaccttggcgatgacatggaccccgaactgcgctctctcgcccaaattctgatcgatcagaaagttaaggagattagcaaccaggagcccatgaaactgtga

SEQ ID NO: 7240 - RNA, 1290 nt, synthetic construct
  misc_feature 1..1290: note = derived and/or modified CDS sequence (opt5) from SEOV(XJ2/2011)__KY807169.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgctctagacagaccagcaaagacaacaaggggatgcggattcgctttaaagacgattccagctacgaggacgttaatggaatcagaaagcccaagcatctgtatgtgtctatgcctaacgctcaatccagcatgcgggccgaggaaattacgcccggccgcttcagaaccgctgtctgcggcctctaccctgcccagatcaaagcgcggaatatggtgtctccggttatgtccgtggtcgggtttctggcccttgctaaggattggacaagccgcatcgaggaatggctgggagccccctgtaaattcatggctgagtctcctattgccggctccctcagcgggaaccccgtgaatagagactatatccggcagagacagggagccctggctggctgggaacctaaggagtttcaagcgctgcgccagcactccaaagatgccgggtgcaccctcgtggagcatattgaatctcccagctccatctgggtcttcgctggagccccggaccggtgtcctcccacatgcctgtttgttggcggcatggccgagcttggggctttctttagcattctgcaggatatgagaaacaccatcatggcctctaagacggtgggaacagcggacgaaaaactccgcaagaagtccagcttctaccaatcttacctgcggagaacccagagcatgggcatccagcttgatcagcgcattatcgtgatgtttatggtcgcttgggggaaagaggccgtggacaatttccacctgggagatgacatggaccctgaactccggtccctggcccaaattctgatcgatcagaaggttaaagagatttctaaccaggagcccatgaagctctga

SEQ ID NO: 7241 - RNA, 1290 nt, synthetic construct
  misc_feature 1..1290: note = derived and/or modified CDS sequence (opt5) from SEOV(XJ5/2011)__KY807170.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaaaccccgtgaatcgcgactatatcagacagcggcagggcgccctggctgggatggaacctaaagagtttcaagcgctgagacagcaccccaaggatgccggatgcaccctcgtggagcatattgaaagcccgtcctctatctgggtcttcgctggcgcccctgaccgctgtccccctacatgcctgtttgttggcgggatggccgagcttggagctttctttagcattctgcaggatatgcggaacaccatcatggcctccaaaacggtgagcacagcggacgaaaagctcagaaagaaatcttccttctaccaaagctacctgcgccggacccagtctatgggcatccagcttgatcagagaattatcgtgatgtttatggtcgcttgggggaaggaggccgtggacaatttccacctgggagatgacatggaccccgaactccgcagcctggcccaaattctgatcgatcagaaagttaaggagatttccaaccaggagcccatgaaactctga

SEQ ID NO: 7242 - RNA, 1290 nt, synthetic construct
  misc_feature 1..1290: note = derived and/or modified CDS sequence (opt5) from SEOV(10-134)__JF693882.2__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcctccctattatcctgaaggccctttatatgctgaccacacgcgggagacagacctctaaagacaacaagggaatgcggattcgctttaaagacgatagctcctacgaggacgtgaatggcatcagaaagcccaagcatctctatgttagcatgcctaacgctcaatcttccatgaaagccgaggaaattacgcccggccggttccgcaccgctgtgtgcgggctgtaccctgcccagatcaaggcgagaaatatggtcagcccggtgatgtctgttgtgggatttcttgccctggctaaagattggacatcccggatcgaggaatggctcggcgccccctgtaagttcatggctgagagccctattgccgggtctctgtccggaaaccccgtcaatcgcgactatatcagacagcggcagggcgccctggctgggatggaacctaaagagtttcaagcgctcagacagcacagcaaggatgccggatgcaccctggtggagcatattgaatccccctctagcatctgggtgttcgctggcgccccggaccgctgtcctcccacatgcctttttgtcggcgggatggccgagctgggagctttcttttccattctccaggatatgcggaacaccatcatggccagcaaaacggttggcacagcggacgaaaagctgagaaagaaatcttccttctaccaaagctaccttcgccggacccagtctatggggatccagctggatcagagaattatcgtgatgtttatggtggcttggggaaaggaggccgtcgacaatttccacctcggcgatgacatggaccctgaactgcgcagcctggcccaaattctcatcgatcagaaagtgaaggagatttccaaccaggagcccatgaaactgtga

SEQ ID NO: 7243 - RNA, 1290 nt, synthetic construct
  misc_feature 1..1290: note = derived and/or modified CDS sequence (opt5) from SEOV(DPRK08)__JX853575.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaaaccccgtgaatcgcgactatatcagacagcggcagggcgccctggctgggatggaacctaaagagtttcaagcgctgagacagcacgccaaggatgctggatgcaccctcgtggagcatattgaaagcccctcctctatctgggtcttcgccggcgccccggaccgctgtcctcccacatgcctgtttgttggcgggatggctgagcttggagccttctttagcattctgcaggatatgcggaacaccatcatggcgtccaaaacggtgggcacagctgacgaaaagctcagaaagaaaagctctttctaccaatcctacctgcgccggacccagagcatggggatccagcttgatcagagaattatcgtgatgtttatggtcgcctggggaaaggaggccgtggacaatttccacctgggcgatgacatggaccctgaactccgctctctggctcaaattctgatcgatcagaaagttaaggagattagcaaccaggagcccatgaaactctga

SEQ ID NO: 7244 - RNA, 1290 nt, synthetic construct
  misc_feature 1..1290: note = derived and/or modified CDS sequence (opt5) from SEOV(Fj372/2013)__KP645198.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaagccccgtgaaccgcgactatatcagacagcggcagggcgccctggctgggatggaacctaaagagtttcaagcgctgagacagcacgccaaggatgctggatgcaccctcgtggagcatattgaatccccctctagcatctgggtcttcgccggcgccccggaccgctgtcctcccacatgcctgtttgttggcgggatggctgagcttggagccttcttttccattctgcaggatatgcggaataccatcatggcgagcaaaacggtgggcacagctgacgaaaagctcagaaagaaatcttccttctaccaaagctacctgcgccggacccagtctatggggatccagcttgatcagagaattatcgtgatgtttatggtcgcctggggaaaggaggccgtggacaacttccacctgggcgatgacatggaccctgaactccgcagcctggctcaaattctgatcgatcagaaagttaaggagatttccaatcaggagcccatgaaactctga

SEQ ID NO: 7245 - RNA, 1290 nt, synthetic construct
  misc_feature 1..1290: note = derived and/or modified CDS sequence (opt5) from SEOV(HeB38)__JN377553.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgaaaattcggtttaaggacgatagctcctacgaggacgttaatggcatccgcaagcccaaacatctgtatgtgagcatgcctaacgctcaatcttccatgaaggccgaggaaattacgcccggcagattccggaccgctgtctgcgggctctaccctgcccagatcaaagcgcgcaatatggtgagcccggttatgtctgtggtcggatttctggcccttgctaaggattggacatccagaatcgaggaatggctgggcgccccctgtaaattcatggctgagagccctattgccgggtctctctccggaaaccccgtgaatcgggactatatccgccagagacagggcgccctggctgggatggaacctaaggagtttcaagcgctgcggcagcacagcaaagatgccggatgcaccctcgtggagcatattgaatccccctctagcatctgggtcttcgctggcgccccggacagatgtcctcccacatgcctgtttgttggcgggatggccgagcttggagctttcttttccattctgcaggatatgcgcaacaccatcatggccagcaagacggtgggcacagcggacgaaaagctccggaaaaagtctcctttctaccaatcctacctgagacgcacccagagcatggggatccagcttgatcagcggattatcgtgatgtttatggtcgcttggggaaaagaggccgtggacaatttccacctgggcgatgacatggaccccgaactcagagggctggcccaaattctgatcgatcagaaggttaaagagatttctaaccaggagcccatgaagctctga

SEQ ID NO: 7246 - RNA, 1290 nt, synthetic construct
  misc_feature 1..1290: note = derived and/or modified CDS sequence (opt5) from SEOV(JiangxiXinjianRn-07-2011)__KP859511.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaaaccccgtgaatcgcgactatatcagacagcggcagggcgccctggctgggatggaacctaaagagtttcaagcgctgagacagcacagcaaggatgccggatgcaccctcgtggagcatattgaatccccctctagcatctgggtcttcgctggcgccccggaccgctgtcctcccacatgcctgtttgttggcgggatggccgagcttggagctttcttttccattctgcaggatatgcggaacaccatcatggccagcaaaacggtgggcacagcggacgaaaagctcagaaagaaatcttccttctaccaaagctacctgcgccggacccagtctatggggatccagcttgatcagagaattatcgtgatgtttatggtcgcttggggaaaggaggccgtggacaatttccacctgggcgatgacatggaccctgaactccgcagcctggcccaaattctgatcgatcagaaagttaaggagatttccaaccaggagcccatgaaactctga

SEQ ID NO: 7247 - RNA, 1290 nt, synthetic construct
  misc_feature 1..1290: note = derived and/or modified CDS sequence (opt5) from SEOV(JiangxiXinjianRn-09-2011)__KP859512.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaattctctatgaaagccgaggaaattacgcccggccggtttcgcaccgctgtctgcgggctctaccctgcccagatcaaggcgagaaatatggtgtccccggttatgagcgtggtcggattcctggcccttgctaaagattggacatctcggatcgaggaatggctgggcgccccctgtaagtttatggctgagtcccctattgccgggagcctctctggaaaccccgtgaatcgcgactatatcagacagcggcagggcgccctggctgggatggaacctaaagagttccaagcgctgagacagcactccaaggatgccggatgcaccctcgtggagcatattgaaagcccctcctctatctgggtctttgctggcgccccggaccgctgtcctcccacatgcctgttcgttggcgggatggccgagcttggagcctttttcagcattctgcaggatatgcggaacaccatcatggcttccaaaacggtgggcacagcggacgaaaagctcagaaagaaaagctctttttaccaatcctacctgcgccggacccagagcatggggatccagcttgatcagagaattatcgtgatgttcatggtcgcttggggaaaggaggccgtggacaattttcacctgggcgatgacatggaccctgaactccgctctctggcccaaattctgatcgatcagaaagttaaggagattagcaaccaggagcccatgaaactctga

SEQ ID NO: 7248 - RNA, 1290 nt, synthetic construct
  misc_feature 1..1290: note = derived and/or modified CDS sequence (opt5) from SEOV(Singapore/06(RN41))__GQ274944.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaaaccccgtgaatcgcgactatatcagacagcggcagggcgccctggctgggatggaacctaaagagtttcaagcgctgagacagcacagcaaggatgccggatgcaccctcgtggagcatattgaatccccctctagcatctgggtcttcgctggcgccccggaccgctgtcctcccacatgcctgtttgttggcgggatggccgagcttggagctttcttttccattctgcaggatatgcggaacaccatcatggccagcaaaacggtgggcacagcggacgaaaagctcagaaagaaatcttccttctaccaaagctacctgcgccggacccagtctatggggatccagcttgatcagagaattatcgtgatgtttatggtcgcttggggaaaggaggccgtggacaatttccacctgggcgatgacatggaccctgaactccgcgggctggcccaaattctgatcgatcagaaagttaaggagattagcaaccaggagcccatgaaactctga

SEQ ID NO: 7249 - RNA, 1290 nt, synthetic construct
  misc_feature 1..1290: note = derived and/or modified CDS sequence (opt5) from SEOV(YaluRiver12)__HQ611980.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccggggacctcaacaagcgcgctctgcatgatagagagtccgttgccgcctctattcagagcaaaatcgacgagcttaagcggcaactggctgatcgcattgccgctggaaagaatatcggccaggacagagatcctacaggggtggaaccgggagaccacctcaaagagcggtccgccctgtcttatggcaacacgcttgatctgaatagcctcgacatcgatgaacccaccgggcagacagcggactggctgaccattatcgtgtacctgacatccttcgtcgtgcctattatcctcaaggccctgtatatgcttaccacacgcggaagacagacctctaaagatagcaagggcatgcggattcgctttaaagacgactccagctacgaggatgttaacggcatcagaaagcccaagcatctgtatgtgtctatgcctaatgctcaatccagcatgaaaacggaggaaattacccccgggcggttccgcacagccgtctgcggactctaccctgctcagatcaaggccagaaacatggtgtctccggttatgtccgtggtcggctttctggcgcttgccaaagactggaccagccggatcgaggaatggctgggggctccctgtaagttcatggccgagtctcctattgctggatccctcagcgaaaatcccgtgaaccgcgattatatcagacagcggcagggcgccctggccgggatggagcctaaagagtttcaagctctgagacagcacgcgaaggacgccggatgcacactcgtggaacatattgagtccccctctagcatctgggtcttcgctggcgccccggatcgctgtcctcctacctgcctgtttgttggcgggatggccgaacttggagctttcttttccattctgcaggacatgcggaatacgatcatggccagcaaaacagtgggcaccgcggatgagaagctcagaaagaaatcttccttctaccaaagctacctgcgccggacacagtctatggggatccagcttgaccagagaattatcgtgatgtttatggtcgcttggggaaaggaagccgtggataacttccacctgggcgacgatatggaccccgagctccgcagcctggcccaaattctgatcgaccagaaagttaaggagatttccaatcaggaacccatgaaactctga

SEQ ID NO: 7250 - RNA, 1290 nt, synthetic construct
  misc_feature 1..1290: note = derived and/or modified CDS sequence (opt5) from SEOV(14D12)__AB618124.1__N
  source 1..1290: mol_type = other RNA
atggccaccatggaggaaatccagaaggagattagcgctcacgaaggccaactggtgatcgccagacagaaagtcaaggacgcggagaaacagtacgaaaaggatcccgacgatctcaacaaacgggctctgcatgaccgcgagtccgttgccgcctctattcagagcaagatcgatgagcttaagagacaactggctgaccggattgccgctgggaaaaatatcggacaggatcgcgaccctacaggcgtggaaccgggggatcacctcaaggagagatccgccctgtcttatggaaacacgcttgacctgaatagcctcgatatcgacgaacccaccggccagacagcggattggctgaccattatcgtgtacctgacatccttcgtcgtgcctattatcctcaaagccctgtatatgcttaccacacgggggcgccagacctctaaggacaacaaaggaatgcggattagatttaaggacgatagctcctacgaggacgttaatggcatccgcaagcccaaacatctgtatgtgagcatgcctaacgctcaatcttccatgaaggccgaggaaattacgcccggcagattccggaccgctgtctgcgggctctaccctgcccagatcaaagcgcgcaatatggtgagcccggttatgtctgtggtcggatttctggcccttgctaaggattggacatccagaatcgaggaatggctgggcgccccctgtaaattcatggctgagagccctattgccgggtctctctccggaaaccccgtgaatcgggactatatccgccagagacagggcgccctggctgggatggaacctaaggagtttcaagcgctgcggcagcacagcaaagatgccggatgcaccctcgtggagcatattgaatccccctctagcatctgggtcttcgctggcgccccggacagatgtcctcccacatgcctgtttgttggcgggatggccgagcttggagctttcttttccattctgcaggatatgcgcaacaccatcatggccagcaagacggtgggcacagcggacgaaaagctccggaaaaagtcttccttctaccaaagctacctgagacgcacccagtctatggggatccagcttgatcagcggattatcgtgatgtttatggtcgcttggggaaaagaggccgtggacaatttccacctgggcgatgacatggaccctgaactcagaagcctggcccaaattctgatcgatcagaaggttaaagagatttccaaccaggagcccatgaagctctga

SEQ ID NO: 7251 - RNA, 1281 nt, synthetic construct
  misc_feature 1..1281: note = derived and/or modified CDS sequence (opt5) from SEOV(19CSG)__AB618114.1__N
  source 1..1281: mol_type = other RNA
atggaggaaatccagagagagattagcgcccacgaaggccaactggtgatcgctcggcagaaggtcaaagacgccgagaagcagtacgaaaaagatcccgacgatctcaacaagcgcgcgctgcatgacagagagtccgttgctgcctctattcagagcaaaatcgatgagcttaagcggcaactggccgaccgcattgctgccgggaagaatatcggacaggatagagaccctaccggcgtggaaccgggggatcacctcaaagagcggtccgctctgtcttatggaaacacacttgacctgaatagcctcgatatcgacgaacccacgggccagaccgccgattggctgacaattatcgtgtacctgacctccttcgtcgtgcctattatcctcaaggcgctgtatatgcttacaacccgcgggagacagacatctaaagacaacaagggaatgcggattcgctttaaagacgatagctcctacgaggacgttaatggcatcagaaagcccaagcatctgtatgtgagcatgcctaacgcccaatcttccatgaaagctgaggaaattacccccggccggttccgcacggccgtctgcgggctctaccctgctcagatcaaggccagaaatatggtgagcccggttatgtctgtggtcggatttctggcgcttgccaaagattggacctcccggatcgaggaatggctgggcgctccctgtaagttcatggccgagagccctattgctgggtctctctccggaaaccccgtgaatcgcgactatatcagacagcggcagggcgccctggccgggatggaacctaaagagtttcaagctctgagacagcacagcaaggatgcgggatgcacactcgtggagcatattgaatccccctctagcatctgggtcttcgccggcgctccggaccgctgtcctcctacctgcctgtttgttggcgggatggccgagcttggagccttcttttccattctgcaggatatgcggaacacaatcatggctagcaaaaccgtgggcacggccgacgaaaagctcagaaagaaatcttccttctaccaaagctacctgcgccggacacagtctatggggatccagcttgatcagagaattatcgtgatgtttatggtcgcgtggggaaaggaggctgtggacaatttccacctgggcgatgacatggaccccgaactccgcagcctggcccaaattctgatcgatcagaaagttaaggagatttccaaccaggagcccatgaaactctga

SEQ ID NO: 7252 - RNA, 1290 nt, synthetic construct
  misc_feature 1..1290: note = derived and/or modified CDS sequence (opt5) from SEOV(93HBX12)__EF192308.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcggcaagcccaagcatctgtatgtgagcatgcctaacgctcaatcttccatgaaagccgaggaaattacgcccgggagattccggaccgctgtctgcggactctaccctgcccagatcaaggcgcgcaatatggtgagcccggttatgtctgtggtcggctttctggcccttgctaaagattggacatccagaatcgaggaatggctgggggccccctgtaagttcatggctgagagccctattgccggatctctctccggcaaccccgtgaatcgggactatatccgccagagacagggggccctggctggaatggaacctaaagagtttcaagcgctgcggcagcacagcaaggatgccggctgcaccctcgtggagcatattgaatccccctctagcatctgggtcttcgctggcgccccggacagatgtcctcccacatgcctgtttgttgggggaatggccgagcttggcgctttcttttccattctgcaggatatgcgcaacaccatcatggccagcaaaacggtggggacagcggacgaaaagctccggaagaaatcttccttctaccaaagctacctgagacgcacccagtctatgggaatccagcttgatcagcggattatcgtgatgtttatggtcgcttggggcaaggaggccgtggacaatttccacctgggggatgacatggaccctgaactcagaggactggcccaaattctgatcgatcagaaagttaaggagattagcaaccaggagcccatgaaactctga

SEQ ID NO: 7253 - RNA, 1290 nt, synthetic construct
  misc_feature 1..1290: note = derived and/or modified CDS sequence (opt5) from SEOV(Cherwell)__KC626089.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcattgctgagagccctatcgccgggtctctctccggaaaccccgtgaatcgcgactatattagacagcggcagggcgccctggctgggatggaacctaaagagtttcaagcgctgagacagcacagcaaggatgccggatgcaccctcgtggagcatatcgaatccccctctagcatttgggtcttcgctggcgccccggaccgctgtcctcccacatgcctgtttgttggcgggatggccgagcttggagctttcttttccatcctgcaggatatgcggaacaccatcatggccagcaaaacggtgggcacagcggacgaaaagctcagaaagaaatcttccttctaccaaagctacctgcgccggacccagtctatggggattcagcttgatcagagaatcattgtgatgtttatggtcgcttggggaaaggaggccgtggacaatttccacctgggcgatgacatggaccctgaactccgcagcctggcccaaatcctgattgatcagaaagttaaggagatctccaaccaggagcccatgaaactctga

SEQ ID NO: 7254 - RNA, 1290 nt, synthetic construct
  misc_feature 1..1290: note = derived and/or modified CDS sequence (opt5) from SEOV(CixiRf23)__FJ803201.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaaaccccgtgaatcgcgactatatcagacagcggcagggcgccctggctgggatggaacctaaagagtttcaagcgctgagacagcacgccaaggatgctggacgcaccctcgtggagcatattgaaagcccctcctctatctgggtcttcgccggcgccccggaccggtgccctcccacatgtctgtttgttggcgggatggctgagcttggagccttctttagcattctgcaggatatgagaaacaccatcatggcgtccaaaacggtgggcacagctgacgaaaagctccgcaagaaaagctctttctaccaatcctacctgcggagaacccagagcatggggatccagcttgatcagcgcattatcgtgatgtttatggtcgcctggggaaaggaggccgtggacaatttccacctgggcgatgacatggaccctgaactccggtctctggctcaaattctgatcgatcagaaagttaaggagattagcaaccaggagcccatgaaactctga

SEQ ID NO: 7255 - RNA, 1290 nt, synthetic construct
  misc_feature 1..1290: note = derived and/or modified CDS sequence (opt5) from SEOV(CixiRf56)__FJ803202.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaaaccccgtgaatcgcgactatatcagacagggccagggggccctggctggaatggaacctaaagagtttcaagcgctgcggcagcacgccaaggatgctggctgcaccctcgtggagcatattgaaagcccctcctctatctgggtcttcgccggcgccccggacagatgtcctcccacatgcctgtttgttgggggaatggctgagcttggcgccttctttagcattctgcaggatatgcgcaacaccatcatggcgtccaaaacggtggggacagctgacgaaaagctccggaagaaaagctctttctaccaatcctacctgagacgcacccagagcatgggaatccagcttgatcagcggattatcgtgatgtttatggtcgcctggggcaaggaggccgtggacaatttccctctggttcacgatatggaccccaaactcagatctctgagccaaattctgatcgaccagaaggtgaacgaaatttccaatcaggagcccatgaaactctga

SEQ ID NO: 7256 - RNA, 1290 nt, synthetic construct
  misc_feature 1..1290: note = derived and/or modified CDS sequence (opt5) from SEOV(CixiRn21)__FJ803205.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaaaccccgtgaatcgcgactatatcagacagcggcagggcgccctggctgggatggaacctaaagagtttcaagcgctgagacagcacagcaaggatgccggatgcaccctcgtggagcatattgaatccccctctagcatctgggtcttcgctggcgccccggaccgctgtcctcccacatgcctgtttgttggcgggatggatgagcttggagccttcttttccattctgcaggacatgcggaacaccatcatggctagcaaaacggtgggcacagccgatgaaaagctcagaaagaaatcttccttctaccaaagctacctgcgccggacccagtctatggggatccagcttgaccacagaattatcgtgatgtttatggtcgcgtggggaaaggaggctgtggataatttccacctgggcgacgacatggatcctgaactccgcacactggcccagattctgatcgaccaaaaagttaaggagattagcaaccaggagcccatgaaactctga

SEQ ID NO: 7257 - RNA, 1290 nt, synthetic construct
  misc_feature 1..1290: note = derived and/or modified CDS sequence (opt5) from SEOV(CixiRn76)__FJ803206.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagctctcaaaacgctcagtccagcatgaaagccgaggaaattacgcctggccggttccgcaccgctgtctgcgggctctaccccgcccagatcaaggcgagaaatatggtgtctcctgttatgtccgtggtcggatttctggcccttgctaaagattggacaagccggatcgaggaatggctgggcgccccgtgtaagttcatggctgagtctcccattgccgggtccctcagcggaaaccctgtgaatcgcgactatatcagacagggccaaggggccctggctggaatggaacccaaagagtttcaggcgctgcggcagcacgccaaggatgctggctgcaccctcgtggagcatattgaatccccttctagcatctgggtcttcgccggcgccagagaccgctgtcccccgacatgcctgtttgttgggggaatggctgagcttggcgccttcttttccattctgcaagatatgcggaacaccatcatggcgagcaaaacggtggggacagctgacgaaaagctcagaaagaaatcttccttctaccagagctacctgcgccggacccagtctatgggaatccagcttgatcaaagaattatcgtgatgtttatggtcgcctggggcaaggaggccgtggacaatttccacctgggggatgacatggaccctgaactccgcagcctggctcagattctgatcgatcagaaagttaaggagatttccaaccaggagcccatgaaactctga

SEQ ID NO: 7258 - RNA, 1290 nt, synthetic construct
  misc_feature 1..1290: note = derived and/or modified CDS sequence (opt5) from SEOV(CUI)__GQ279395.1__N
  source 1..1290: mol_type = other RNA
atggccaccatggaggaactgcagagagagatcagcgctcacgaaggccaactcgtgattgcccggcagaaggtcaaggacgcggagaagcagtacgaaaaagatcccgacgatctgaacaagcgcgcccttcatgacagagagtccgttgctgcctctatccagagcaaaattgatgagctgaagcggcaactcgctgaccgcatcgccgctgggaagaatattggacaggatagagaccctacaggcgtggaaccgggggatcacctgaaagagcggtccgccctttcttatggaaacacgctggacctcaatagcctggatatcgacgaacccaccggccagacagcggattggctgaccatcattgtgtacctcacatccttcgtcgtgcctatcattctgaaggccctttatatgctgaccacacgcgggagacagacctctaaagacaacaagggaatgcggatccgctttaaagacgatagctcctacgaggacgttaatggcattagaaagcccaagcatctctatgtgagcatgcctaacgctcaatcttccatgaaagccgaggaaatcacgcccggccggttccgcaccgctgtctgcgggctgtaccctgcccagattaaggcgagaaatatgcttagcccggtgatgtctgttgtgggatttctggccctcgctaaagattggacatcccggatcgaggaatggctgggcgccccctgtaagttcatggctgagagccctatcgccgggtctctgtccggaaaccccgtcaatcgcgactatattagacagcggcagggcgccctcgctgggatggaacctaaagagtttcaagcgctgagacagcacagcaaggatgccggatgcacccttgtggagcatatcgaatccccctctagcatttgggtgttcgctggcgccccggaccgctgtcctcccacatgcctgtttgtcggcgggatggccgagctcggagctttcttttccatcctgcaggatatgcggaacaccattatggccagcaaaacggttggcacagcggacaagaaacttagaaagaagtcttccttctaccaaagctacctgcgccggacccagtctatggggatccagctcgatcagagaatcattgtgatgtttatgttcgcttggggaaaagaagccgtggacaattttcacctgggcgatgacatggaccctgagctgcgcgggctcgcccaaatcctgattgatcagaaggtcaaagaaatcagcaaccaggagcccatgaaactttga

SEQ ID NO: 7259 - RNA, 1290 nt, synthetic construct
  misc_feature 1..1290: note = derived and/or modified CDS sequence (opt5) from SEOV(FeixianRn1)__GU592942.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattaccgggtctctctccggaaaccccgtgaatcgcgactatatcagacagcggcagggcgccctggccgggatggaacctaaagagtttcaagctctgagacagcacgcgaaggatgccggatgcacactcgtggagcatattgaaagcccctcctctatctgggtcttcgctggcgccccggaccgctgtcctcctacctgcctgtttgttggcgggatggccgagcttggagctttctttagcattctgcaggatatgcggaacacgatcatggcctccaaaacagtgggcaccgcggacgaaaagctcagaaagaaaagctctttctaccaatcctacctgcgccggacacagagcatggggatccagcttgatcagagaattatcgtgatgtttatggtcgcttggggaaaggaggccgtggacaatttccacctgggcgatgacatggaccccgaactccgctctctggcccaaattctgatcgatcagaaagttaaggagattagcaaccaggagcccatgaaactctga

SEQ ID NO: 7260 - RNA, 1290 nt, synthetic construct
  misc_feature 1..1290: note = derived and/or modified CDS sequence (opt5) from SEOV(GanyuRn66)__GU592932.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcaccgctgagagccctattgccgggtctctctccggaaaccccgtgaatcgcgactatatcagacagcggcagggcgccctggctgggatggaacctaaagagtttcaagcgctgagacagcacgccaaggatgctggatgcacactcgtggagcatattgaaagcccctcctctatctgggtcttcgccggcgccccggaccgctgtcctcctacctgcctgtttgttggcgggatggctgagcttggagccttctttagcattctgcaggatatgcggaacacgatcatggcgtccaaaacagtgggcaccgctgacgaaaagctcagaaagaaaagctctttctaccaatcctacctgcgccggacacagagcatggggatccagcttgatcagagaattatcgtgatgtttatggtcgcctggggaaaggaggccgtggacaatttccacctgggcgatgacatggaccccgaactccgctctctggctcaaattctgatcgatcagaaagttaaggagattagcaaccaggagcccatgaaactctga

SEQ ID NO: 7261 - RNA, 1290 nt, synthetic construct
  misc_feature 1..1290: note = derived and/or modified CDS sequence (opt5) from SEOV(Gongzhuling108)__KF745947.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagtccgctctgcatgaccgcgagtctgttgccgccagcattcagtccaaaatcgatgagcttaagagacaactggctgaccggattgccgctgggaagaatatcggacaggatcgcgaccctacaggcgtggaaccgggggatcacctcaaagagagatctgccctgagctatggaaacacgcttgacctcaattccctggatatcgacgaacccaccggccagacagcggattggctgaccattctggtgtacctcacatctttcgtcgtgcctatcattctgaaggccctttatatgctgaccacacgggggcgccagaccagcaaagacaacaagggaatgagaatccggtttaaagacgatggctcctacgaggacgttaatggcattcgcaagcccaagcatctctatgtgcctatgcccaacgctcaaagctctatgaaagccgaggaaatcacgcctgggagattccggaccgctgtctgcggactgtacccggcccagattaagccccgcaatatggtgtcccctgttatgagcgtggtcggctttcttgcgctggccaaagattggacatctagaatcgaggaatggctcggggctccctgtaagttcatggccgagtcccctatcgctggaagcctgtctggcaaccccgtgaatcgggactatattcgccagagacagggggccctggccggaatggaaccgaaagagtttcaagctctccggcagcacgcgaaggatgccggctgcaccctggtggagcatatcgaatcccctagctccattagagtcttcgctggcgcccccgcccgctgtcctcccacatgcctttttgttgggggaatggctgagctgggcgccttcttttctatcctccaggacatgcggaacaccattatggcgagcaaaacggtggggacagctgatgaaaagctgagaaagaaatccagcttctaccaatcttaccttcgccggtcccagagcatgggaatccagctggaccagagaatcattgtgatgtttatggtcgcctctggcaaggaggccgtggataatttccacctcggggacgatatggaccccgaactgcgcagcctggttcaaatcctcattgaccagaaagtgaaggagatctccaaccaggagcctatgaaactgtga

SEQ ID NO: 7262 - RNA, 1290 nt, synthetic construct
  misc_feature 1..1290: note = derived and/or modified CDS sequence (opt5) from SEOV(Gongzhuling147)__KF745948.1__N
  source 1..1290: mol_type = other RNA
atggccaccatggaggaaatccagagagagattagcgctcacgaaggccaactggtgatcgcccggcagattgtcaaggacgcggagaaacagtacgaaaaggatcccgctgacctcaacaaacgcgccctgcatgatagagagtccgttgccgcttctatccagagcaagattgacgagcttaaacggcacctggccgatcgcatcgctgccgggaagaatatcggacaagacagagatcctacaggcgtggaaccgggggaccatctcaaggagcggtccgcgctgtcttatggaaacacgcttgatctgaatagcctcgacattgatgaacccaccggccagacagccgactggctgaccatcattgtgtacctgacatccttcgtcgtgcctatcattctcaaagctctgtatatccttaccacatctgggcgccagaccagcaaggataacaaaggaatgcggattagatttaaggacgactccagctacgaggatgttaatggcatccgcatgcccaaacacctgtatgtgcctatgcccaacgcccagtcttccatgaaggctgaggacatcacgcctggcagattccggaccgccgtctgcgggctctacccggcgcaaattaaggcccgcaatatggtgagccccctgatgtctgttgtgggatttcttgctctgcctaaagattggacatccagaatcgacgaatggctcggcgccccctgtaagttcatggctgagagccctattgccgggtctctgtccggaaaccccgtcaatcgggatcatatccgccagagacagggcgccctggctgggatggacccgaaagaatttcaggcggtgcggcaacacgccaaggatgctggatgcaccctcgtggagcacattgaaagcccttcctctatctgggtcttcgccggcgcccccgacagatgtcctcccacatgcctgtttgttggcgggatggctgagcttggagccttctttaccatcctgcaggatatgcgcaacacgattatgcccagcaaaacagtgggcaccgcggacgagaagctccggaaaaagtccagcttctatcagtcttacctgagacgcacacaatccatggggatccagcttgatcagcggattatcgtgatttttatggtcgcttgggccaaggaagccgtggacaatttccatctgggagacgatatggaccctgagctcagaagcctggctcagatcctgatcgatcaaaaagttaaggaaatttctaaccaggtgccgatgaaactctga

SEQ ID NO: 7263 - RNA, 1290 nt, synthetic construct
  misc_feature 1..1290: note = derived and/or modified CDS sequence (opt5) from SEOV(Gongzhuling415)__KF745949.1__N
  source 1..1290: mol_type = other RNA
atggccaccatggaggaaatccagagagagattagcgctcacgaaggccaactggtgatcgcccggcagatggtcaaggacgcggagaaacagtacgaaaaggatctcgctgacctgaacaaacgcgcccttcatgatagagagtccgttgccgcttctattcagagcaagatcgacgagctgaaacggcaactcgccgatcgcattgctgccgggaagaatatcgaacaggacagagatcccacaggagtggagcctggcgaccacctgaaggaacggtccgcgctttcttatgggaacacgctggatctcaatagcctggacatcgatgagccgaccggacagacagccgactggctgaccattatcgtgtacctcacatccttcgtcgtgcccattatcctgaaagctctttatattctgaccacacgcggcagacagacctctaaggataacaaagggatgacgatccggtttaaggacgacagctcctacgaggatgttaatggcattcgcatgcctaaacatctctatgtgcccatgcctaacgcccaaagctctatgaaggctgaagacatcacccccggaagattccggacagccgtctgcggcctgtaccctgcgcagatcaaggcccgcaatatggtgtccccgcttatgagcgttgtggggtttctggctctccccaaagattggacctctagaattgacgagtggctgggagccccttgtaagttcatggctgaatcccccatcgccggcagcctgtctgggaaccctgtcaatcgggatcacattcgccagagacagggagccctcgctggcatggaccccaaagagtttcaagcggtgcggcagcatgccaaggatgctgggtgcacactggtggaacacatcgagtccccgagctccatttgggtcttcgccggagcccctgacagatgtcttcctacctgcctgtttgttggcggcatggctgagctcggggccttctttacgatcctgcaggatatgcgcaacacaatcatggcgtctaaaaccgtgggaacagctgacgaaaagctgggcaaaaagagctccttctatcaaagctaccttcggagaacccagtctatggggattcagctcgatcagcgcatcattgtgatgtttatggtcgcctgggccaaggaggctgtggacaatatccacctgggagacgatatggaccccgaactgcggtccctcgcccaaattctgatcgatcagaaagttaaggagatcagcaaccaggtgcccatgaaactttga

SEQ ID NO: 7264 - RNA, 1290 nt, synthetic construct
  misc_feature 1..1290: note = derived and/or modified CDS sequence (opt5) from SEOV(Gongzhuling42)__KF745942.1__N
  source 1..1290: mol_type = other RNA
atggccaccatggaggaaatccagagagagattagcgctcacgaaggccaactggtgatcgcccggcagaaggtcaaagacgcgcagaagcagtacgagaaagatcccgacgatctcaacaagcgcgctctgcatgacagagaatccgttgccgcctctattcaacttaaaatcgatgagctgaagcggcagctcgctgaccgcattgccgctgggaagaatatcggacaggatagagaccctacaggcgtggagccgggggatcacctgaaagaacggagcgccctttcctatggaaacacgctggacctcaattctctggatatcgacgagcccaccggccagacagcggattggctgaccattatcgtgtacctcaccagcttcgtcgtgcctattatcctgaaggccctttatatgctgacaacacgcgggagacaaacctccaaagacaacaagggaatgcggattcgctttaaagacgattctagctacgaagacgttaagggcatcagaaagcccaaacatctctatgtgcctatgcccaatgctcagtccagcatgaaggccgaggagattacgcctggccggtgccgcaccgctgtctgtgggctgtacccggcccagatcaaagcgagaaacatggtgtctcccgttatgtccgccgtgggaatccttgctctggccaaggattggacaagccggattgaagagtggctcggcaccccttgcaaattcatggctgaatctcccatcgccgggtccctgagcggaaatcctgtcaaccgcgaccacattagacagcggcaaggcgccctggctgggatggagcccaaggaatttcagggactcagacagcatgcgaaagatgccggctgtacactggtggagcacatcgagtctccgtccagcatttgggtgttcgctggcgcccctgaccgctgtccccctacctgcctttttgtcgggggaatggccgaactgggcgctttctttgccatcctccaagatatgcggaatacgatcatggcgtccaagacagttgggaccgctgacgagaagctgcgcaaaaagtctagcttctatcagtcctaccttagacggacacagagcatgggcattcagctggatcaaagaatcattgtgatgtttatggtggcctgggccaaagaagctgtcgacaacttccacctcggagatgacatggaccccgagctgcgctctctggcccagatcctcatggatcagaaggtgaaagaaatttccaatcaggagcccatgaagctgtga

SEQ ID NO: 7265 - RNA, 1290 nt, synthetic construct
  misc_feature 1..1290: note = derived and/or modified CDS sequence (opt5) from SEOV(Gongzhuling45)__KF745943.1__N
  source 1..1290: mol_type = other RNA
atggccaccatggaggaaatccagagagagattagcgctcacgaaggccaactggtgatcgcccggcagatggtcaaggacgcggagaaacagtacgaaaaggatcccgctgacctcaacaaacgcgccctgcatgatagagagtccgttgccgcttctattcagagcaagatcgacgagcttaaacggcaactggccgatcgcattgctgccgggaagaatatcggacaggacagagatcctacaggcgtggaaccgggggaccacctcaaggagcggtccgcgctgtcttatcgcaacacgcttgatctgaatagcctcgacatcgatgaacccaccggacagacagccgactggctgaccattatcgtgtacctgacatccttcgtcgtgcctattatcctcaaagctctgtatattcttaccacaagaggccggcagacctctaaggataacaaagggatgcgcatcagatttaaggacgacagctcctacgaggatgttaatggcattcggatgcccaaacatctgtatctccctatgcccaacgcccaaagctctatgaaggctgaggacatcacgcctggacgcttcagaaccgccgtgtgcggcctgtacccggcgcagatcaaggcccggaatatggtcagcccccttatgtccgtggttgggtttctggctctccctaaagattggacatctcgcattgacgaatggctgggagccccctgtaagttcatggctgagtcccctatcgccggcagcctgtctgggaaccccgtgaatagagatcacattcggcagagacagggagccctcgctggcatggacccgaaagaatttcaagcggtccgccagcatgccaaggatgctgggtgcaccctggtggagcacatcgaatcccctagctccatttgggtgttcgccggagcccccgaccggtgtcctcccacatgcctttttgtcggcggcatggctgagctgggggccttctttaccatcctccaggatatgagaaacacgatcatggcgtctaaaacagttggaaccgctgacgagaagctgcgcaaaaagagctccttctatcaaagctaccttcggagaacacagtctatgggcattcagctggatcagcgcatcattgtgatgtttatggtggcctgggccaaggaagctgtcgacaatttccacctcggggacgatatggaccccgagctgcggtccctggcccaaatcctcattgatcataaagtgaaggaaatcagcaaccaggttcctatgaaactgtga

SEQ ID NO: 7266 - RNA, 1290 nt, synthetic construct
  misc_feature 1..1290: note = derived and/or modified CDS sequence (opt5) from SEOV(Gongzhuling58)__KF745944.1__N
  source 1..1290: mol_type = other RNA
atggccaccatggaggaaatccagagagagattagcgctcacgaaggccaactggtgatcgcccggcagatggtcaaggacgcggagaaacagtacgaaaaggatcccgctgacctcaacaaacgcgccctgcatgatagagagtccgttgccgcttctattcagagcaagatcgacgagcttaaacggcaactggccgatcgcattgctgccgggaagaatatcggacaggacagagatcctacaggcgtggaaccgggggaccacctcaaggagcggtccgcgctgtcttatggaaacacgcttgatctgaatagcctcgacatcgatgaacccaccggccagacagccgactggctgaccattatcgtgtacctgacatccttcgtcgtgcctattatcctcaaagctctgtatattcttaccacacgcgggagacagacctctaaggataacaaaggaatgcggatccgctttaaggacgacagctcctacgaggatgttaatggcattagaatgcccaaacatctgtatgtgcctatgcccaacgcccaaagctctatgaaggctgaggacatcacgcctggccggttccgcaccgccgtctgcgggctctacccggcgcagatcaaggccagaaatatggtgagccccctgatgtccgttgtgggatttcttgctctgcctaaagattggacatctcggattgacgaatggctcggcgccccctgtaagttcatggctgagtcccctatcgccgggagcctgtctggaaaccccgtcaatcgcgatcacattagacagcggcagggcgccctggctgggatggacccgaaagaatttcaagcggtgagacagcatgccaaggatgctggatgcaccctcgtggagcacatcgaatcccctagctccatttgggtcttcgccggcgcccccgaccgctgtcctcccacatgcctgtttgttggcgggatggctgagcttggagccttctttaccatcctgcaggatatgcggaacacgatcatggcgtctaaaacagtgggcaccgctgacgagaagctccgcaaaaagagctccttctatcaaagctacctgagacggacacagtctatggggattcagcttgatcagagaatcattgtgatgtttatggtcgcctgggccaaggaagctgtggacaatttccacctgggagacgatatggaccccgagctccgctccctggcccaaatcctgattgatcagaaagttaaggaaatcagcaaccaggtgcctatgaaactctga

SEQ ID NO: 7267 - RNA, 1290 nt, synthetic construct
  misc_feature 1..1290: note = derived and/or modified CDS sequence (opt5) from SEOV(Gongzhuling85)__KF745945.1__N
  source 1..1290: mol_type = other RNA
atggccaccatggaggaaatccagagagagattagcgctcacgaaggccaactggtgatcgcccggcagatggtcaaggacgcggagaaacagtacgaaaaggatcccgctgacctcattaaacgcgccctgcatgatagagagtccgttgccgcttctatccagagcaagattgacgagcttaaacggcaactggccgatcgcatcgctgccgggaagaacatcggacaggacagagatcctacaggcctcgaaccgggggaccacctgaaggagcggtccgcgctttcttatggaaatacgctggatctcaacagcctggacattgatgaacccaccggccagacagccgactggctgaccgtgatcgtgtacctcacatccttcgtcgtgcctattatcctgaaagctctttatattctgaccacacgcgggagacagacctctaaggataataaaggaatgcggatccgctttaaggacgttagctcctacgaggacgtgaacggcattagaatgcccaaacatctctatgtccctatgcccaatgcccaaagctctatgaaggctgaggatatcacgcctggccggttccgcaccgccgtgtgcgggctgtacccggcgcagatcaaggccagaaacatggttagcccccttatgtccgtggtcggatttctggctctccctaaagactggacatctcggattgatgaatggctgggcgccccctgtaagttcatggctgagtcccctatcgccgggagcctgtctggaaatcccgtgaaccgcgaccacattagacagcggcagggcgccctcgctgggatggatccgaaagaatttcaagcggtgagacagcatgccaaggacgctggatgcaccctggtcgagcacatcgaatcccctagctccatttgggttttcgccggcgcccccgatcgctgtcctcccacatgcctttttgtgcggggcatggctgagctgggggccttctttaccatcctccaggacatgagaaatacgatcatggcgtctaaaacagtgggaaccgctgatgagaagctgcgcaaaaagagctccttctatcaaagctaccttcggagaacacagtctatgggcattcagctggaccagcgcatcattgtcatgtttatggtggcctgggccaaggaagctgttgataacttccacctcggggacgacatgcatcccgagctgcggtccctggcccaaatcctcattgatcagaaagtgaaggaaatcagcaatcaggtccctatgaaactgtga

SEQ ID NO: 7268 - RNA, 1290 nt, synthetic construct
  misc_feature 1..1290: note = derived and/or modified CDS sequence (opt5) from SEOV(Gongzhuling97)__KF745946.1__N
  source 1..1290: mol_type = other RNA
atggccaccatggaggaaatccagagagagattagcgctcacgaaggccaactggtgatcgcccggcagatggtcaaggacgcggagaaacagtacgaaaaggatcccgctgacctcaacaaacgcgccctgcatgatagagagtccgttgccgcttctattcagagcaagatcgacgatcttaaacggcaactggccgaccgcattgctgccgggaagaatatcggacaggatagagaccctacaggcgtggagccgggggatcacctcaaggaacggtccgcgctgtcttatggaaacacgcttgacctgaatagcctcgatatcgacgagcccaccggccagacagccgattggctgaccattatcgtgtacctgacatccttcgtcgtgcctattatcctcaaagctctgtatatgcttaccacacgcgggagacagacctctaaggacaacaaaggaatgcggattcgctttaaggacgatagctcctacgaagacgttaatggcatcagaatgcccaaacatctgtatgtgcggatgcctaacgcccaaagctctatgaaggctgaggatattacgcccggccgcttcagaaccgccgtctgcgggctctaccctgcgcagatcaaggcccggaatatggtgtccccgctgatgagcgttgtgggatttcttgctctgcccaaagactggacatctcgcatcgatgagtggctcggcgccccttgtaagttcatggctgaatcccccattgccgggagcctgtctggaaaccctgtcaatagagaccacatccggcagagacagggcgccctggctgggatggatcccaaagagtttcaagcggtgcgccagcatgccaaggacgctggatgcaccctcgtggaacacattgagtccccgagctccatctgggtcttcgccggcgcccctgatcggtgtccccctacatgcctgtttgttggcgggatggctgaacttggagccttctttaccattctgcaggacatgagaatcacgatcatggcgtctaaaacagtgggcaccgctgatgagaagctccgcaaaaagagctccttctatcaaagctacctgcggagaacacagtctatggggattcagcttgaccagcgcctgatcgtgatgtttatggtcgcctgggccaaggaggctgtggacaacttccacctcggagatgacatggatcccgaactgcggtccctggcccaaattctcatcgaccagaaagttaagcagattagcaatcaggtgcccatgaaactgtga

SEQ ID NO: 7269 - RNA, 1290 nt, synthetic construct
  misc_feature 1..1290: note = derived and/or modified CDS sequence (opt5) from SEOV(Gou3)__AB027522.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggcagcttccggaccgctgtctgcgggctctaccctgccacaatcaaggcgcgcaatatggtgtctccggttatgtccgtggtcggatttctggcccttgctaaagattggaccagcagaatcgaggactggctgggcgccccctgtaagttcatggctgaatctcctattgccgggtccctcagcggaaaccccgtgaatcgggattatatccgccagagacagggcgccctggctgggatggagcctaaagaatttcaggcgctgcggcaacactccaaggacgccggatgcacaatggtggagcagattgagtctcccagctccatctgggtcttcgctggcgccccggatagatgtcctcctacctgcctctttgttggcgggatggccgaactgggagctttctttagcattcttcaggacatgcgcaacacgatcatggcctctaaaacagtgggcaccgcggatgagaagctgcggaagaaatccagcttctaccaatcttacctcagacgcacacagagcatggggatccagctggaccagcggattatcgtgatgtttatggtcgcttggggaaaggaagccgtggataatttccatcttggcgacgacatggatcccgagctgagatccctcgcccaaattctgatcgaccagaaagttaaggaaatttctaaccaggagcccatgaaactgtga

SEQ ID NO: 7270 - RNA, 1290 nt, synthetic construct
  misc_feature 1..1290: note = derived and/or modified CDS sequence (opt5) from SEOV(Hb8610)__AF288643.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagtccatcggacaggatagagaccctacaggcgtggaaccgggggatcacctcaaagagcggtctgccctgagctatggaaatacgcttgacctgaactccctcgatatcgacgaacccaccggccagacagcggattggctgaccattatcgtgtacctgacatctttcgtcgtgcctattatcctcaaggccctgtatatgcttaccacacgcgggagacagaccagcaaagacaataagggaatgcggattcgctttaaagacgattccagctacgaggacgttaacggcatcagaaagcccaagcatctgtatgtgtctatgcctaatgctcaatccagcatgaaagccgaggaaattacgcccggccggttccgcaccgctgtctgcgggctctaccctgcccagatcaaggcgagaaacatggtgtctccggttatgtccgtggtcggatttctggcccttgctaaagattggacaagccggatcgaggaatggctgggcgccccctgtaagttcatggctgagtctcctattgccgggtccctcagcggaaatcccgtgaaccgcgactatatcagacagcggcagggcgccctggctgggatggaacctaaagagtttcaagcgctgagacagcacgccaaggatgctggatgcaccctcgtggagcatattgaatccccctctagcatctgggtcttcgccggcgccccggaccgctgtcctcccacatgcctgtttgttggcgggatggctgagcttggagccttcttttccattctgcaggatatgcggaataccatcatggcgagcaaaacggtgggcacagctgacgaaaagctcagaaagaaatcttccttctaccaaagctacctgcgccggacccagtctatggggatccagcttgatcagagaattatcgtgatgtttatggtcgcctggggaaagaaagccgtggacaacttccacctgggcgatgacatggaccctgagctccgcagcctggctcaaattctgatcgatcagaaggttaaagaaatttccaatcaggagcccatgaagctctga

SEQ ID NO: 7271 - RNA, 1290 nt, synthetic construct
  misc_feature 1..1290: note = derived and/or modified CDS sequence (opt5) from SEOV(HuBJ16)__GQ279380.1__N
  source 1..1290: mol_type = other RNA
atggccaccatggaggaaatccagagagagattagcgctcacgaaggccaactggtgatcgcccggcagaaggtcaaaaacgcggagaagcagtacgaaaaagaccccgatgacctcaataagcgcgctctgcatgatagagagtccgttgccgcctctattcagagcaaaatcgacgagcttaagcggcaactggctgatcgcattgccgctgggaagaacatcggacaggacagagatcctacaggcgtggaaccgggggaccacctcaaagagcggtccgccctgtcttatggaaatacgcttgatctgaacagcctcgacatcgatgaacccaccggccagacagcggactggctgaccattatcgtgtacctgacatccttcgtcgtgcctattatcctcaaggccctgtatatgcttaccacacgcgggagacagacctctaaagataataagggaatgcggattcgctttaaagacgacagctcctacgaggatgttaacggcatcagaaagcccaagcatctgtatgtgagcatgcctaatgctcaatcttccatgaaagccgaggaaattacgcccggccggttccgcaccgctgtctgcgggctctaccctgcccagatcaaggcgagaaacatggtgagcccggttatgtctgtggtcggatttctggcccttgctaaagactggacatcccggatcgaggaatggctgggcgccccctgtaagttcatggctgagagccctattgccgggtctctctccggaacccccgtgaatcgcgattatatcagacagcggcagggcgccctggctgggatggaacctaaagagtttcaagcgctgagacagcacgccaaggacgctggatgcacactcgtggagcatattgaaagcccctcctctatctgggtcttcgccggcgccccggatcgctgtcctcctacctgcctgtttgttggcgggatggctgagcttggagccttctttagcattctgcaggacatgcggaacacgatcatggcgtccaaaacagtgggcaccgctgatgaaaagctcagaaagaaaagctctttctaccaatcctacctgcgccggacacagagcatggggatccagcttgaccagagaattatcgtgatgtttatggtcgcctggggaaaggaggccgtggataatttccacctgggcgacgatatggaccccgaactccgctctctggctcaaattctgatcgaccagaaagttaaggagattagcaaccaggagcccatgaaactctga

SEQ ID NO: 7272 - RNA, 1290 nt, synthetic construct
  misc_feature 1..1290: note = derived and/or modified CDS sequence (opt5) from SEOV(HuBJ22)__GQ279379.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaacccccgtgaaccgcgactatatcagacagcggcagggcgccctggctgggatggaacctaaagagtttcaagcgctgagacagcacgccaaggatgctggatgcacactcgtggagcatattgaaagcccctcctctatctgggtcttcgccggcgccccggaccgctgtcctcctacctgcctgtttgttggcgggatggctgagcttggagccttctttagcattctgcaggatatgcggaatacgatcatggcgtccaaaacagtgggcaccgctgacgaaaagctcagaaagaaaagctctttctaccaatcctacctgcgccggacacagagcatggggatccagcttgatcagagaattatcgtgatgtttatggtcgcctggggaaaggaggccgtggacaacttccacctgggcgatgacatggaccccgaactccgctctctggctcaaattctgatcgatcagaaagttaaggagattagcaatcaggagcccatgaaactctga

SEQ ID NO: 7273 - RNA, 1290 nt, synthetic construct
  misc_feature 1..1290: note = derived and/or modified CDS sequence (opt5) from SEOV(HuBJ3)__GQ279391.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagttaacaagggaatgcggattcgctttaaagacgacagctcctacgaggatgtgaatggcatcagaaagcccaagcatctgtatgtcagcatgcctaacgctcaatcttccatgaaagccgaggaaattacgcccggccggttccgcaccgctgtgtgcgggctctaccctgcccagatcaaggcgagaaatatggttagcccggtgatgtctgtcgtgggatttctggcccttgctaaagactggacatcccggatcgaggaatggctgggcgccccctgtcgcttcatggctgagagccctattgccgggtctctctccggaaaccccgtgaatagagattatatccggcagagacagggcgccctggctgggatggaacctaaggagtttcaagcgctgcgccagcacgccaaagacgctggatgcaccctcgtcgagcatattgaaagcccctcctctatctgggttttcgccggcgccccggagggctgtcctcccacatgcctgtttgtcgggggaatggctgaacttggcgccttctttagcattctgcaggatatgcggaacaccatcatggcgtccaagacggtggggacagctgacgagaaactcagaaagaaaagctctttctaccaatcctacctgcgccggacccagagcatgggaatccagcttgatcagagaattatcgtgatgtttatggtggcctggggcaaggaagccgttgacaatttccacctgggggatgacatggatcctgagctccgctctctggctcaaattctgatcgaccagaaggtgaaagagattagcaaccaggaacccatgaagctctga

SEQ ID NO: 7274 - RNA, 1290 nt, synthetic construct
  misc_feature 1..1290: note = derived and/or modified CDS sequence (opt5) from SEOV(K24-e7)__AF288653.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatttcaacaagcgcgctctccatgacagagagtccgttgccgcctctattcagagcaaaatcgatgagctgaagcggcaacttgctgaccgcattgccgctgggaagaatatcggacaggatagagaccctacaggcgtggaaccgggggatcacctgaaagagcggtccgccctctcttatggaaacacgctggaccttaatagcctggatatcgacgaacccaccggccagacagcggattggctcaccattatcgtgtacctgacatcctttgtcgtgcctattatcctgaaggccctctatatgctgaccacacgcgggagacagacctctaaagacaacaagggaatgcggattcgcttcaaagacgatagctcctacgaggacgttaatggcatcagaaagcccaagcatctttatgtgagcatgcctaacgctcaatcttccatgaaagccgaggaaattacgcccggccggtttcgcaccgctgtctgcgggctgtaccctgcccagatcaaggcgagaaatatggtgagcccggttatgtctgtggtcggattcctcgccctggctaaagattggacatcccggatcgaggaatggcttggcgccccctgtaagtttatggctgagagccctattgccgggtctctgtccggaaaccccgtgaatcgcgactatatcagacagcggcagggcgccctcgctgggatggaacctaaagagttccaagcgctgagacagcacgccaaggatgctggatgcaccctggtggagcatattgaaagcccctcctctatctgggtctttgccggcgccccggaccgctgtcctcccacatgcctcttcgttggcgggatggctgagctgggagcctttttcagcattcttcaggatatgcggaacaccatcatggcgtccaaaacggtgggcacagctgacgaaaagctgagaaagaaaagctctttttaccaatcctacctccgccggacccagagcatggggatccagctggatcagagaattatcgtgatgttcatggtcgcctggggaaaggaggccgtggacaattttcaccttggcgatgacatggaccctgaactgcgctctctcgctcaaattctgatcgatcagaaagttaaggagattagcaaccaggagcccatgaaactgtga

SEQ ID NO: 7275 - RNA, 1290 nt, synthetic construct
  misc_feature 1..1290: note = derived and/or modified CDS sequence (opt5) from SEOV(K24-v2)__AF288655.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatttcaacaagcgcgctctccatgacagagagtccgttgccgcctctattcagagcaaaatcgatgagctgaagcggcaacttgctgaccgcattgccgctgggaagaatatcggacaggatagagaccctacaggcgtggaaccgggggatcacctgaaagagcggtccgccctctcttatggaaacacgctggaccttaatagcctggatatcgacgaacccaccggccagacagcggattggctcaccattatcgtgtacctgacatcctttgtcgtgcctattatcctgaaggccctctatatgctgaccacacgcgggagacagacctctaaagacaacaagggaatgcggattcgcttcaaagacgatagctcctacgaggacgttaatggcatcagaaagcccaagcatctttatgtgagcatgcctaacgctcaatcttccatgaaagccgaggaaattacgcccggccggtttcgcaccgctgtctgcgggctgtaccctgcccagatcaaggcgagaaatatggtgagcccggttatgtctgtggtcggattcctcgccctggctaaagattggacatcccggatcgaggaatggcttggcgccccctgtaagtttatggctgagagccctattgccgggtctctgtccggaaaccccgtgaatcgcgactatatcagacagcggcagggcgccctcgctgggatggaacctaaagagttccaagcgctgagacagcacgccaaggatgctggatgcaccctggtggagcatattgaaagcccctcctctatctgggtctttgccggcgccccggaccgctgtcctcccacatgcctcttcgttggcgggatggctgagctgggagcctttttcagcattcttcaggatatgcggaacaccatcatggcgtccaaaacggtgggcacagctgacgaaaagctgagaaagaaaagctctttttaccaatcctacctccgccacacccagagcatggggatccagctggatcagcggattatcgtgatgttcatggtcgcctggggaaaggaggccgtggacaattttcaccttggcgatgacatggaccctgaactgagatctctcgctcaaattctgatcgatcagaaagttaaggagattagcaaccaggagcccatgaaactgtga

SEQ ID NO: 7276 - RNA, 1290 nt, synthetic construct
  misc_feature 1..1290: note = derived and/or modified CDS sequence (opt5) from SEOV(OuhaiRf35)__FJ803208.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaaaccccgtgaatcgcgactatatcagacagcggcagggcgccctggctgggatggaacctaaagagtttcaagcgctgagacagcacgccaaggatgctggatgcaccctcgtggagcatattgaaagcccctcctctatctgggtcttcgccggcgcccgcgaccggtgtccgcctacatgcctgtttgttggcgggatggctgagcttggagccttctttagcattctgcaggatatgagaaacaccatcatggcgtccaaaacggtgggcacagctgacgaaaagctccgcaagaaaagctctttctaccaatcctacctgcggagaacccagagcatggggatccagcttgatcagcgcattatcgtgatgtttatggtcgcctggggaaaggaggccgtggacaatttccacctgggcgatgacatggaccccgaactccggtctctggctcaaattctgatcgatcagaaagttaaggagattagcaaccaggagcctatgaaactctga

SEQ ID NO: 7277 - RNA, 1290 nt, synthetic construct
  misc_feature 1..1290: note = derived and/or modified CDS sequence (opt5) from SEOV(OuhaiRn146)__FJ803210.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaaaccccgtgaatcgcgactatatcagacagggccagggggccctggctggaatggaacctaaagagtttcaagcgctgcggcagcacgccaaggatgctggctgcaccctcgtggagcatattgaaagcccctcctctatctgggtcttcgccggcgccagagaccgctgtccgcctacatgcctgtttgttgggggaatggctgagcttggcgccttctttagcattctgcaggatatgcggaacaccatcatggcgtccaaaacggtggggacagctgacgaaaagctcagaaagaaaagctctttctaccaatcctacctgcgccggacccagagcatgggaatccagcttgatcagagaattatcgtgatgtttatggtcgcctggggcaaggaggccgtggacaatttccacctgggggatgacatggaccccgaactccgctctctggctcaaattctgatcgatcagaaagttaaggagattagcaaccaggagcctatgaaactctga

SEQ ID NO: 7278 - RNA, 1290 nt, synthetic construct
  misc_feature 1..1290: note = derived and/or modified CDS sequence (opt5) from SEOV(Pf26)__AY006465.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctgtgcagagcaaaattgatgagcttaagcggcaactggctgaccgcatcgccgctgggaagaatattggacaggatagagaccctacaggcgtggaaccgggggatcacctcaaagagcggtccgccctgtcttatggaaacacgcttgacctgaatagcctcgatatcgacgaacccaccggccagacagcggattggctgaccatcattgtctacctgacatccttcgtggttcctatcattctcaaggccctgtatatgcttaccacacgcgggagacagacctctaaagacaacaagggaatgcggatccgctttaaagacgatagctcctacgaggacgtgaatggcattagaaagcccaagcatctgtatgtcagcatgcctaacgctcaatcttccatgaaagccgaggaaatcacgcccggccggttccgcaccgctgtgtgcgggctctaccctgcccagattaagccgagaaatatggttagccccgtgatctctgtcgtgggatttctggcgcttgccaaagattggacatcccggatcgaggaatggctgggcgctccttgtaagttcatggccgagagccccattgctgggtctctctccggaaaccctgtgaatcgcgactatatcagacagcggcagggcgccctggccgggatggaacccaaagagtttcaagctctgagacagcacgcgaaggatgccggatgcaccctcgtcgagcatattgaaagcccgtcctctatctgggttttcgctggcgcccctgaccgctgtccccctacatgcctgtttgtgggcgggatggccgagcttggagctttctttagcattctgcaggatatgcggaacaccatcatggcctccaaaacggtgggcacagcggacgaaaagctcagaaagaaaagctctttctaccaatcctacctgcgccggacccagagcatggggatccagcttgatcagagaattatcgtcatgtttatggtggcttggggaaaggaggccgttgacaatttccacctgggcgatgacatggaccccgaactccgctctctggcccaaattctgatcgatcagaaagtgaaggagattagcaaccaggagcccatgaaactctga

SEQ ID NO: 7279 - RNA, 1290 nt, synthetic construct
  misc_feature 1..1290: note = derived and/or modified CDS sequence (opt5) from SEOV(Rn-CP7)__GQ279382.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaagcatggtgtctccggttatgtccgtggtcggatttctggcccttgctaaagattggacaagccggatcgaggaatggctgggcgccccctgtaagttcatggctgagtctcctattgccgggtccctcagcggaaatcccgtgaaccgcgactatatcagacagcggcagggcgccctggctgggatggaacctaaagagtttcaagcgctgagacagcacgccaaggatgctggatgcaccctcgtggagcatattgaatccccctctagcatctgggtcttcgccggcgccccggaccgctgtcctcccacatgcctgtttgttggcgggatggctgagcttggagccttcttttccattctgcaggatatgcggaataccatcatggcgagcaaaacggtgggcacagctgacgaaaagctcagaaagaaatcttccttctaccaaagctacctgcgccggacccagtctatggggatccagcttgatcagagaattatcgtgatgtttatggtcgcctggggaaaggaggccgtggacaacttccacctgggcgatgacatggaccctgaactccgcagcctggctcaaattctgatcgatcagaaagttaaggagatttccaatcaggagcccatgaaactctga

SEQ ID NO: 7280 - RNA, 1290 nt, synthetic construct
  misc_feature 1..1290: note = derived and/or modified CDS sequence (opt5) from SEOV(Rn-DC8)__GQ279386.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccgctcgcgggagacagacatctaaagacaacaagggaatgcggattcgctttaaagacgatagctcctacgaggacgttaatggcatcagaaagcccaagcatctgtatgtgagcatgcctaacgcccaatcttccatgaaagctgaggaaattacccccggccggttccgcacggccgtctgcgggctctaccctgcgcagatcaaggccagaagcatggtgtctccggttatgtccgtggtcggatttctggctcttgccaaagattggaccagccggatcgaggaatggctgggcgctccctgtaagttcatggccgagtctcctattgccgggtccctcagcggaaatcccgtgaaccgcgactatatcagacagcggcagggcgctctggcggggatggaacctaaagagtttcaagccctgagacagcacgctaaggatgccggatgcacactcgtggagcatattgaatccccctctagcatctgggtcttcgccggcgctccggaccgctgtcctcctacctgcctgtttgttggcgggatggccgagcttggagcgttcttttccattctgcaggatatgcggaatacaatcatggctagcaaaaccgtgggcacggccgacgaaaagctcagaaagaaatcttccttctaccaaagctacctgcgccggacacagtctatggggatccagcttgatcagagaattatcgtgatgtttatggtcgcctggggaaaggaggctgtggacaacttccacctgggcgatgacatggaccccgaactccgcagcctggcccaaattctgatcgatcagaaagttaaggagatttccaatcaggagcccatgaaactctga

SEQ ID NO: 7281 - RNA, 1290 nt, synthetic construct
  misc_feature 1..1290: note = derived and/or modified CDS sequence (opt5) from SEOV(Rn-M11)__GQ279383.1__N
  source 1..1290: mol_type = other RNA
atggccaccatggaggaaatccagagagagattagcgctcacgaaggccaactggtgatcgcccggcagaaggtcaaaaacgcggagaagcagtacgaaaaagaccccgatgacctcaataagcgcgctctgcatgatagagagtccgttgccgcctctattcagagcaaaatcgacgagcttaagcggcaactggctgatcgcattgccgctgggaagaacatcggacaggacagagatcctacaggcgtggaaccgggggaccacctcaaagagcggtccgccctgtcttatggaaatacgcttgatctgaacagcctcgacatcgatgaacccaccggccagacagcggactggctgaccattatcgtgtacctgacatccttcgtcgtgcctattatcctcaaggccctgtatatgcttaccacacgcgggagacagacctctaaagataataagggaatgcggattcgctttaaagacgacagctcctacgaggatgttaacggcatcagaaagcccaagcatctgtatgtgagcatgcctaatgctcaatcttccatgaaagccgaggaaattacgcccggccggttccgcaccgctgtctgcgggctctaccctgcccagatcaaggcgagaagcatggtgtctccggttatgtccgtggtcggatttctggcccttgctaaagactggacaagccggatcgaggaatggctgggcgccccctgtaagttcatggctgagtctcctattgccgggtccctcagcggaaaccccgtgaatcgcgattatatcagacagcggagaggcgccctggctgggatggaacctaaagagtttcaggcgctgcgccaacacgccaaggacgctggatgcaccctcgtggagcatattgaatccccctctagcatctgggtcttcgccggcgccccggatcggtgtcctcccacatgcctgtttgttggcgggatggctgagcttggagccttcttttccattctgcaggacatgagaaacaccatcatggcgagcaaaacggtgggcacagctgatgaaaagctccgcaagaaatcttccttctaccagagctacctgcggagaacccaatctatggggatccagcttgaccagcgcattatcgtgatgtttatggtcgcctggggaaaggaggccgtggataatttccacctgggcgacgatatggaccctgaactccggagcctggctcagattctgatcgaccaaaaagttaaggagatttccaaccaggagcccatgaaactctga

SEQ ID NO: 7282 - RNA, 1290 nt, synthetic construct
  misc_feature 1..1290: note = derived and/or modified CDS sequence (opt5) from SEOV(RuianRf74)__FJ803213.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcatggctgtctgcgggctctaccctgcccagatcaaggcgagaaatatggtgagcccggttatgtctgtggtcggatttctggcccttgctaaagattggacctcccggatcgaggaatggctgggcgccccctgtaagttcatggctgagagccctattgccgggtctctctccggaaaccccgtgaatcgcgactatatcagacagcggcagggcgccctggctgggatggaacctaaagagtttcaagcgctgagacagcacgccaaggatgctggatgcacactcgtggagcatattgaaagcccctcctctatctgggtcttcgccggcgccccggaccgctgtcctcctacctgcctgtttgttggcgggatggctgagcttggagccttctttagcattctgcaggatatgcggaacacaatcatggcgtccaaaaccgtgggcacggctgacgaaaagctcagaaagaaaagctctttctaccaatcctacctgcgccggacacagagcatggggatccagcttgatcagagaattatcgtgatgtttatggtcgcctggggaaaggaggccgtggacaatttccacctgggcgatgacattgaccccgaactccgctctctggctcaaatcctgattgatcagaaagttaaggagatcagcaaccaggagcccatgaaactctga

SEQ ID NO: 7283 - RNA, 1290 nt, synthetic construct
  misc_feature 1..1290: note = derived and/or modified CDS sequence (opt5) from SEOV(RuianRn23)__FJ803214.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaaaccccgtgaatcgcgactatatcagacagcggcagggcgccctggctgggatggaacctaaagagtttcaagcgctgagacagcacgccaaggatgctggatgcaccctcgtggagcatattgaaagcccctcctctatctgggtcttcgccggcgccccggaccgctgtcctcccacatgcctgtttgttggcgggatggctgagcttggagccttctttagcattctgcaggatatgcggaacaccatcaaagcgtccaagacggtgggcacagctgacgaaaagctccgcaaaaagagctctttctaccaatcctacctgagacggacccagagcatggggatccagcttgatcagagaattatcgtgatgtttatggtcgcctggggaaaagaggccgtggacaatttccacctgggcgatgacatggaccctgaactccgctctctggctcaaattctgatcgatcagaaggttaaagagattagcaaccaggagcccatgaagctctga

SEQ ID NO: 7284 - RNA, 1290 nt, synthetic construct
  misc_feature 1..1290: note = derived and/or modified CDS sequence (opt5) from SEOV(RuianRn33)__FJ803215.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaaaccccgtgaatcgcgactatatcagacagcggcagggcgccctggctgggatggaacctaaagagtttcaagcgctgagacagcacgccaaggatgctggatgcaccctcgtggagcatattgaaagcccctcctctatctgggtcttcgccggcgccccggaccgctgtcctcccacatgcctgtttgttggcgggatggctgagcttggagccttctttagcattctgcaggatatgcggaacaccatcatggcgtccaaaacggtgggcacagctgacgaaaagctcagaaagaaaagctctttctaccaatcctacctgcgccggacccagagcatggggatccagcttgatcagagaattatcgtgatgtttatggtcgcccgcggaaaggaggccatgtataatctgcacctccgggacgatatgacacctcaactgctgctcctggtgcagattcttctggaccaccaggttaaagaaatctctaaccaggagctcatgaagctgtga

SEQ ID NO: 7285 - RNA, 1290 nt, synthetic construct
  misc_feature 1..1290: note = derived and/or modified CDS sequence (opt5) from SEOV(SC106)__GU361893.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgcctatgcccaacgctcaaagctctatgaaagccgaggaaattacgcctggccggttccgcaccgctgtctgcgggctctacccggcccagatcaaggcgagaaatatggtgtcccccgttatgagcgtggtcggatttctggcccttgctaaagattggacatctcggatcgaggaatggctgggcgccccttgtaagttcatggctgagtcccccattgccgggagcctctctggaaaccctgtgaatcgcgactatatcagacagcggcagggcgccctggctgggatggaacccaaagagtttcaagcgctgagacagcacgccaaggatgctggatgcaccctcgtggagcatattgaatccccgagctccatctgggtcttcgccggcgcccctgaccgctgtccccctacatgcctgtttgttggcgggatggctgagcttggagccttcttttctattctgcaggatatgcggaacaccatcatggcgagcaaaacggtgggcacagctgacgaaaagctcagaaagaaatccagcttctaccaatcttacctgcgccggacccagtccatggggatccagcttgatcagagaattatcgtgatgtttatggtcgcctggggaaaggaggccgtggacaatttccacctgggcgatgacatggaccccgaactccgcagcctggctcaaattctgatcgatcagaaagttaaggagatttctaaccaggagcccatgaaactctga

SEQ ID NO: 7286 - RNA, 1290 nt, synthetic construct
  misc_feature 1..1290: note = derived and/or modified CDS sequence (opt5) from SEOV(SEO/Belgium/Rn895/2005)__JQ898106.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgacagccctattgccgggtctctctccggaaaccccgtgaatcgcgattatatcagacagcggcagggcgccctggctgggatggagcctaaagaatttcaagcgctgagacagcacagcaaggacgccggatgcaccctcgtggagcatattgagtccccctctagcatctgggtcttcgctggcgccccggatcgctgtcctcccacatgcctgtttgttggcgggatggccgaacttggagctttcttttccattctgcaggacatgcggaacaccatcatggccagcaaaacggtgggcacagcggatgagaagctcagaaagaaatcttccttctaccaaagctacctgcgccggacccagtctatggggatccagcttgaccagagaattatcgtgatgtttatggtcgcttggggaaaggaagccgtggataatttccacctgggcgacgacatggatcctgagctccgcagcctggcccaaattctgatcgaccagaaagttaaggaaatttccaaccaggagcccatgaaactctga

SEQ ID NO: 7287 - RNA, 1290 nt, synthetic construct
  misc_feature 1..1290: note = derived and/or modified CDS sequence (opt5) from SEOV(Taonan420)__KF745951.1__N
  source 1..1290: mol_type = other RNA
atggccaccatggaggaaatccagagagagattagcgctcacgaaggccaactggtgatcgcccggcagaacgtcaaggacgcggagaaacagtacgaaaaggatcccgacgatctcaataaacgcgctctgcatgacagagagtccgttgccgcctctattcagagcaagatcgatgagcttaaacggcaacctgctgaccgcattgccgctgggaagaacatcggacaggatagagacccgacaggcgtggaacccggggatcacctgaaggagcggtccgccctctcttatggaaatacgctggaccttaaccgcctggatatcgacgaacctaccggccagagagcggattggctcacaattatcgtgtacctgaccagcttcgtcgtgcggattatcctgaaagccctctatatgttttccacacgcgggagacagacctctaaggacaataaaggactgcggattcgcttcaaggacgatagctcctacgaggactttaacggcatcagaaaacccaagcatctttatgttcctatgcccaatgctcaaagctctatgaaggccgaggaaattacacctggccggttccgcaccgctgtgtgcgggctgtacccggcccagatcaaagcgagaaacatggtctcccccgtgatgagcgttgtgggatttctcgccctggctaaggattggacgtctcggatcgaggaatggcttggcgccccttgtaaattcatggctgagtcccccattgccgggagcctgtctggaaatcctgtcaacagagactatatccgccagcggcagggcgccctcgctgcgatggaacccaaggagtttcaagccctgagacagcacgctaaagatccggggtgcaccctggtggagcatattgaatcccctagctccatctgggtgtctgccggagcccccgaccgctgtcctcccacatgcctcttcgtcggcggcatggctgagctgggggcctttttcagcatttttcaggatatgcggaataccatcatgccctccaagacagttggaaccgcggacgaaaaacttagaaagaaaagcctgttctaccaatcttacctccgccggacgcagtccatgggcatccagctggatcagagaattatcgtgatgtttatggtggcttgggggaaggaggccgtcgacaacttccaccttcctgatgacatggacccggaactgcgcagcctcgcccaaattctgatcgtgcagaaggttaaagagatttctaatcaggagcccatgaagctgtga

SEQ ID NO: 7288 - RNA, 1290 nt, synthetic construct
  misc_feature 1..1290: note = derived and/or modified CDS sequence (opt5) from SEOV(Taonan52)__KF745950.1__N
  source 1..1290: mol_type = other RNA
atggccaccatggaggaaatccagagagagattagcgctcacgaaggccaactggtgacagcccggcagaaggtcaaagacgcggagaagcagtacgaaaaagatcccgacgatctcaacaagcgcgctctgcatgacagagagtccgttgccgcctctatccagagcaaaattgatgaggtgaagcggcaacttgctgaccgcatcgccgctgggaagaatattggacaggatagagaccctacgggcgtggaaccgggggatcaccccaaagagcggtccgccctgtcttatggaaacaccctcgacctgaatagccttgatatcgacgaacctacaggccagaccgcggattggctgacaatcattgtctacctcacctccttcgtggttcccatcattctgaaggccctgtatatgtctacaacccgcgggagacagacgagcaaagacaaccggggaatgcgcatcagatttcaagacgattccagctacgaggacgtgaatggcattcggaagcctaaacatctctatgtccccatgcctaacgctcagtcttccatgaaggccgaggaagtgaccccgggccgcttcagaacagctgtttgcgggctgtaccccgcccagatcaaggcgcggaatatggtgcgccctgtcatgagcgtggtgggatttcttgccctggctaaagcctggacctctagaattgaggaatggctcggcgctccctgtaagttcatggccgagtcccctatcgccgggagcctgtctggaaaccccgtctatcgggattacatcagacagcgccaaggcgctcttgcggggatggaaccgaaagagtttcaggccctgcggcagcacgctaaggacgccggatgcacactcgttgagctgattgaatcccctagctccatctctgtgttcgccggcgctcccgatagatgtcctcggacctgcctgtttgtgggcgggatggccgagctcggagcgaatttcagcatgctgcaagacatgtccaacacgattatggctagcaaaacagtcggcaccgccgatgaaaaacttcgcaagaagtcttccttttaccagagctatctgagacgcacacagtctatggggatccagctcgaccaacggattatcgtgatgttcatggttgccagcggaaaggaggctgtggattactttcatctgggcgacgatatggaccccgaacttagatccctggcccccatcctcattgaccagaaagtcaaggagatctctaatcaggagcctatgaaactgtga

SEQ ID NO: 7289 - RNA, 1290 nt, synthetic construct
  misc_feature 1..1290: note = derived and/or modified CDS sequence (opt5) from SEOV(WuhanMm24)__JQ665911.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgccgccgcttctattcagagcaaaatcgatgagcttaagcggcaactggccgaccgcattgctgccgggaagaatatcggacaggatagagaccctacaggcgttgaaccgggggatcacctcaaagagcggtccgcgctgtcttatggaaacacgcttgacctgaatagcctcgatatcgacgaacccaccggccagacagccgattggctgaccattatcgtgtacctgacatccttcgtggtccctattatcctcaaggctctgtatatgcttaccacacgcgggagacagacctctaaagacaacaagggaatgcggattcgctttaaagacgatagctcctacgaggacgtgaatggcatcagaaagcccaagcatctgtatgttagcatgcctaacgcccaatcttccatgaaagctgaggaaattacgcccggccggttccgcaccgccgtgtgcgggctctaccctgcgcagatcaaggccagaaatatggtcagcccggtgatgtctgttgtgggatttctggctcttgccaaagattggacatcccggatcgaggaatggctgggcgctccctgtaagttcatggccgagagccctattgccgggtctctctccggaaaccccgtcaatcgcgactatatcagacagcggcagggcgctctggcggggatggaacctaaagagtttcaagccctgagacagcacagcaaggatgctggatgcaccctcgtggagcatattgaatccccctctagcatctgggtgttcgccggcgccccggaccgctgtcctcccacatgcctgtttgtcggcgggatggctggacttggcgccttcttttccattctgcaggatatgcggaacaccatcatggcgagcaaaacggttgggacagctgacgagaagctcagaaagaaatcttccttctaccaaagctacctgcgccggacccagtctatgggaatccagcttgatcagagaattatcgtgatgtttatggtggcctggggcaaggaagccgtcgacaatttccacctgggggatgacatggaccctgagctccgcagcctggctcaaattctgatcgatcagaaagtgaaggaaatttccaaccaggagcccatgaaactctga

SEQ ID NO: 7290 - RNA, 1290 nt, synthetic construct
  misc_feature 1..1290: note = derived and/or modified CDS sequence (opt5) from SEOV(WuhanRf02)__JQ665912.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcgaggaacggtccgccctgtcttatggaaacacgcttgacctgaatagcctcgatatcgacgagcccaccggccagacagcggattggctgaccattatcgtgtacctgacatccttcgtcgtgcctattatcctcaaagccctgtatatgcttaccacacgcgggagacagacctctaaggacaacaaaggaatgcggattcgctttaaggacgatagctcctacgaggacgttaatggcatcagaaaacccaagcatctgtatgtgagcatgcctaacgctcaatcttccatgaaggccgaagagattacgcccggccggttccgcaccgctgtctgcgggctctaccctgcccagatcaaagcgagagatatggtgagcccggttatgtctgtggtcggatttctggcccttgctaaggactggacatcccggatcgaagagtggctgggcgccccctgtaaattcatggctgaaagccctattgccgggtctctctccggaaatcccgtgaaccgcgattatatcagacagcggcagggcgccctggctgggatggagcctaaggagtttcaagcgctgagacagcacagcaaagacgccggatgcaccctcgtggaacatattgagtccccctctagcatctgggtcttcgctggcgcccgcgatcggtgtccgcctacatgcctgtttgttggcgggatggccgaacttggagctttcttttccattctgcaggacatgagaaataccatcatggccagcaagacggtgggcacagcggatgagaaactccgcaagaagtcttccttctaccaaagctacctgcggagaacccagtctatggggatccagcttgaccagcgcattatcgtgatgtttatggtcgcttggggaaaagaagccgtggataacttccacctgggcgacgacatggatcccgagctccggagcctggcccaaattctgatcgaccagaaggttaaagagatttccaatcaggaacctatgaagctctga

SEQ ID NO: 7291 - RNA, 1290 nt, synthetic construct
  misc_feature 1..1290: note = derived and/or modified CDS sequence (opt5) from SEOV(WuhanRf07)__JQ665913.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaaaccccgtgaatcgcgactatatcagacagcggcagggcgccctggctgggatggaacctaaagagtttcaagcgctgagacagcacagcaaggatgccggatgcaccctcgtggagcatattgaatccccctctagcatctgggtcttcgctggcgcccgcgaccggtgtccgcctacatgcctgtttgttggcgggatggccgagcttggagctttcttttccattctgcaggatatgagaaacaccatcatggccagcaaaacggtgggcacagcggacgaaaagctccgcaagaaatcttccttctaccaaagctacctgcggagaacccagtctatggggatccagcttgatcagcgcattatcgtgatgtttatggtcgcttggggaaaggaggccgtggacaatttccacctgggcgatgacatggaccccgaactccggagcctggcccaaattctgatcgatcagaaagttaaggagatttccaaccaggagcctatgaaactctga

SEQ ID NO: 7292 - RNA, 1290 nt, synthetic construct
  misc_feature 1..1290: note = derived and/or modified CDS sequence (opt5) from SEOV(ZJ5)__FJ753400.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaaacctggtgaatcgcgactatatcagacagcggcagggcgccctggctgggatggaacccaaagagtttcaagcgctcagacagcacagcaaggatgccggatgcaccctggtggagcatattgaatccccttctagcatctgggtcttcgctggcgcccccgaccgctgtccgcctacatgcctttttgttggcgggatggccgagctgggagctttcttttccattctccaggatatgcggaacaccatcatggccagcaaaacggtgggcacagcggacgaaaagctgagaaagaaatcttccttctaccaaagctaccttcgccggacccagtctatggggatccagctggatcagagaattatcgtgatgtttattgtcgcttggggaaaggaggccgtggacaatttccacctcggcgatgacctggaccccgaactgcgcagcctcgcccaaatcctgattgatcagaaagttaaggagatctccaaccaggagcctatgaaactttga

SEQ ID NO: 7293 - RNA, 1290 nt, synthetic construct
  misc_feature 1..1290: note = derived and/or modified CDS sequence (opt5) from SEOV(ZT10)__AY766368.1__N
  source 1..1290: mol_type = other RNA
atggccctgtgcgaggaaatccagagagagattagcgctcacgaaggccaactcgtgatcgcccggcagaaggtcaaagacgcggagaagcagtacgaaaaagatcccgacgatttcaacaagcgcgctctgcatgacagagagtccgttgccgcctctattcagagcaaaatcgatgagcttaagcggcaactggctgaccgcattgccgctgggaagaatatcggacaggatagagaccctaccggcgtggaaccgggggatcacctcaaagagcggtccgccctgtcttatggaaacacacttgacctgaatagcctcgatatcgacgaacccacgggccagaccgcggattggctgacaattatcgtgtacctgacctcctttgtcgtgcctattatcctcaaggccctgtatatgcttacaacccgcgggagacagacatctaaagacaacaagggaatgcggattcgcttcaaagacgatagctcctacgaggacgttaatggcatcagaaagcccaagcatctgtatgtgagcatgcctaacgctcaatcttccatgaaagccgaggaaattacccccggccggtttcgcacggctgtctgtgggctctaccctgcccagatcaaggcgagaaatatggtgagcccggttatgtctgtggtcggattcctggcccttgctaaagattggacctcccggatcgaggaatggctgggcgccccctgcaagtttatggctgagagccctattgccgggtctctctccggaaaccccgtgaatcgcgactatatcagacagcggcagggcgccctggctgggatggaacctaaagagttccaagcgctgagacagcacgccaaggatgctggatgtacactcgtggagcatattgaaagcccctcctctatctgggtctttgccggcgccccggaccgctgccctcccacctgtctgttcgttggcgggatggctgagcttggagcctttttcagcggcctggcggatatgcggaacacaattatggcttccaaaaccgaagggacggccgacgagaagctcagaaagaaaagctctttttaccagtcctacctgcgccggcaacagagcatgggaatccagcttgatcagagaatcattgtgatgttcatggtggcctggggcaaggaagctgtcgacaattttcacctgggggatgacatggaccctgagctccgctctctggcccaaatcctgattgatcagaaagtgaaggagatcagcaaccaggaacccatgaaactctga

SEQ ID NO: 7294 - RNA, 1290 nt, synthetic construct
  misc_feature 1..1290: note = derived and/or modified CDS sequence (opt5) from SEOV(ZT71)__AY750171.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatttcaacaagcgcgctctccatgacagagagtccgttgccgcctctattcagagcaaaatcgatgagctgaagcggcaacttgctgaccgcattgccgctgggaagaatatcggacaggatagagaccctacaggcgtggaaccgggggatcacctgaaagagcggtccgccctctcttatggaaacacgctggaccttaatagcctggatatcgacgaacccaccggccagacagcggattggctcaccattatcgtgtacctgacatcctttgtcgtgcctattatcctgaaggccctctatatgctgaccacacgcgggagacagacctctaaagacaacaagggaatgcggattcgcttcaaagacgatagctcctacgaggacgttaatggcatcagaaagcccaagcatctttatgtgagcatgcctaacgctcaatcttccatgaaagccgaggaaattacgcccggccggtttcgcaccgctgtctgcgggctgtaccctgcccagatcaaggcgagaaatatggtgagcccggttatgtctgtggtcggattcctcgccctggctaaagattggacatcccggatcgaggaatggcttggcgccccctgtaagtttatggctgagagccctattgccgggtctctgtccggaaaccccgtgaatcgcgactatatcagacagcggcagggcgccctcgctgggatggaacctaaagagttccaagcgctgagacagcacgccaaggatgctggatgcaccctggtggagcatattgaaagcccctcctctatctgggtctttgccggcgccccggaccgctgtcctcccacatgcctcttcgttggcgggatggctgagctgggagcctttttcagcattcttcaggatatgcggaacaccatcatggcgtccaaaacggaaggcacagctgacgagaagctgagaaagaaaagctctttttaccaatcctacctccgccggcagcagagcatggggatccagctggatcaaagaattatcgtgatgttcatggtggcctggggaaaggaagccgtcgacaattttcaccttggcgatgacatggaccctgagctgcgctctctcgctcagattctgatcgatcagaaagtgaaggagattagcaaccaggaacccatgaaactgtga

SEQ ID NO: 7295 - RNA, 1290 nt, synthetic construct
  misc_feature 1..1290: note = derived and/or modified CDS sequence (opt5) from SEOV(zy27)__AF406965.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgattccaacaagcgcgctctccatgacagagagtctgttgccgccagcattcagtccaaaatcgatgagctgaagcggcaacttgctgaccgcattgccgctgggaagaatatcggacaggatagagaccctacaggcgtggaaccgggggatcacctgaaagagcggtctgcccccagctatggaaacacgctcgaccttaattcccttgatatcgacgaacctaccggccagacagcggattggctgaccattatcgtgtacctcacatctttcgtcgtgcccattatcctgaaggccctgtatatgctcaccacacgcgggagacagaccagcaaagacaacaagggaatgcggattcgctttaaagacgattccagctacgaggacgttaatggcatcagaaagcctaagcatctgtatgtgtctatgcccaacgctcaatccagcatgaaagccgaggaaattacgcctgagcggttccgcaccgctgtctgcggcctttacccggcccagatcaaggcgagaaatatggtgtctcccgttatgtccgtggtcgggtttctggccctcgctaaagattggacaagccggatcgaagagtggctgggagccccttgtaagttcatggctgaatctcccattgccggctcccttagcgggaaccctgtgaatcgcgaccacatcagacagcggcagggagccctggctggcatggagcccaaagagtttcaagcgctcagacagcatgccaaggatgctgggtgcaccctggtggaacacattgagtccccgtctagcatctgggtcttcgccggagcccctgaccgctgtccccctacatgcctgtttgttggcggcatggctgaactcggggccttcttttccattctgcaggatatgcggaacaccatcatggcgagcaaaacggtgggaacagctgacgagaagctgagaaagaaatcttccttctatcaaagctacctgcgccggacccagtctatgggcatccagctcgatcagagaattatcgtgatgtttatggtcgcctgggggaaggaagccgtggacaatttccacctgggagatgacatggaccccgagcttcgcagcctggctcaaattctcatcgatcagaaagttaaggagatttccaaccaggaacccatgaaactgtga

SEQ ID NO: 7296 - RNA, 1290 nt, synthetic construct
  misc_feature 1..1290: note = derived and/or modified CDS sequence (opt5) from SEOV(DN2)__KX289954.1__N
  source 1..1290: mol_type = other RNA
atggccaccatggaggaaatccagagagagattagcgctcacgaaggccaactggtgatcgcccggcagaaggcgaaagacgctgagaagcagtacgaaaaagatcccgacgatctcaacaagcgcgccctgcatgacagagggtccgtcgccgcttctattcagagcaaaatcgatgagcttaagcggcaactggccgaccgcattgctgccggaaagaatatcggccaggatagagaccctacaggggttgagccgggagatcacctcaaagaacggtccgcgctgtcttatggcaacacgcttgacctgaatagcctcgatatcgacgagcccaccgggcagacagccgattggctgaccattatcgtgtacctgacatccttcgtggtccctattatcctcaaggctctgtatatgcttaccacacgcggaagacagacctctaaagacaacaagggcatgcggattcgctttaaagacgatagctcctacgaagacgtgaatggcatcagaaagcccaagcatctgtatgttagcatgcctaacgcccaatcttccatgaaagctgaggagattacgcccgggcggttccgcaccgccgtgtgcggactctaccctgcgcagatcaaggccagaaatatggtcagcccggtgatgtctgttgtgggctttctggctcttgccaaagattggacatcccggatcgaagagtggctgggggaaccctgtaagttcatggctgagagccctattgccggatctctctccggcaaccccgtcaatcgcgactatatcagacagcggcagggggccctggctggaatggaacctaaagagtttcaagcgctgagacagcacagcaaggatgccggctgcaccctcgtggagcatattgaatccccctctagcatctgggtgttcgctggcgccccggaccgctgtcctcccacatgcctgtttgtcgggggaatggccgagcttggcgttttcttttccattctgcaggatatgcggaacaccatcatggctagcaaaacggtggggacagccgacgaaaagctcagaaagaaatcttccttctaccaaagctacctgcgccggacccagtctatgggaatccagcttgatcagagaattatcgtgatgtttatggtcgcgtggggcaaggaggctgtggacaatttccacctgggggatgacatggaccctgaactccgcagcctggcccaaattctgatcgatcagaaagttaaggagatttccaaccaggagcccatgaaactctga

SEQ ID NO: 7297 - RNA, 1290 nt, synthetic construct
  misc_feature 1..1290: note = derived and/or modified CDS sequence (opt5) from SEOV(IR162)__KX079476.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctggacaccccctgtaagttcatggtggagagccctattgccggctctctctccgggaaccccgtgaatcgcgattatatcagacagcggcagggagctctggccggcatggaacctaaagagtttcaagccctgagacagcacagcaaggacgctgggtgcacactcgtcgagcatattgaatccccctctagcatctgggttttcgcgggagccccggatcgctgtcctcctacctgcctgtttgtgggcggcatggctgagcttggggccttcttttccattctgcaggacatgcggaacacgatcatggccagcaaaacagtgggaaccgctgatgaaaagctcagaaagaaatcttccttctaccaaagctacctgcgccggacacagtctatgggcatccagcttgaccagagaattatcgtcatgtttatggtggcctgggggaaggaggcggttgataatttccacctgggagacgacatggatcccgaactccgcagcctggctcaaattctgatcgaccagaaagtgaaggagatttccaaccaggagcccatgaaactctga

SEQ ID NO: 7298 - RNA, 1290 nt, synthetic construct
  misc_feature 1..1290: note = derived and/or modified CDS sequence (opt5) from SEOV(Gou3)__AF184988.1__N
  source 1..1290: mol_type = other RNA
atggccaccatggaggaaatccagagagagattagcgctcacgaaggccaactggtgatcgcccggcgcaaggtcaaagacgcggagaagcagtacgaaaaagatcccgacgatctcaacaagagagctctgcatgaccgggagtccgttgccgcctctattcagagcaaaatcgatgagcttaagcgccagctggctgacagaattgccgctgggaagaatatcggacaagatcgggaccctacaggcgtggaaccgggggatcacctcaaagagcgctccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacaagagggcggcagacctctaaagacaacaagggaatgcgcattagatttaaagacgatagctcctacgaggacgttaatggcatccggaagcccaagcatctgtatgtgagcatgcctaacgctcagtcttccatgaaagccgaggaaattacgcccggccgcttcagaaccgctgtctgcgggctctaccctgcccaaatcaaggcgcggaatatggtgagcccggttatgtctgtggtcggatttctggcccttgctaaagattggacatcccgcatcgaggactggctgggcgccccctgtaagttcatggctgaaagccctattgccgggtctctctccggaaaccccgtgaatagagattatatccggcagagacagggcgccctggctgggatggagcctaaagaatttcaggcgctgcgccaacacagcaaggacgccggatgcaccctcgtggagcatattgagtccccctctagcatctgggtcttcgctggcgccccggatcggtgtcctcccacatgcctgtttgttggcgggatggccgaacttggagctttctttttcattctgcaggacatgagaaacaccatcatggcctccaaaacggtgggcacagcggatgagaagctccgcaagaaaagctctttttaccagtcctacctgcggagaacccaaagcatggggatccagcttgaccagcgcattatcgtgatgttcatggtcgcttggggaaaggaagccgtggataattttcacctgggcgacgacatggatcctgagctccggtctctggcccagattctgatcgaccaaaaagttaaggaaattagcaaccaggagcccatgaaactctga

SEQ ID NO: 7299 - RNA, 1290 nt, synthetic construct
  misc_feature 1..1290: note = derived and/or modified CDS sequence (opt5) from SEOV(Gou3-v9)__AF288651.1__N
  source 1..1290: mol_type = other RNA
atggccaccaaggaggaaatccagagagagattagcgctcacgaaggccaactggtgatcgcccggcagaaagtcaaggacgcggagaaacagtacgaaaaggatcccgacgttctcaacaaacgcgctctgcatgatagagagtccgtggccgcctctattcagagcaagatcgacgagcttaagcggcaactggctgatcgcattgccgctgggaaatccatcggacaggacagagatcctacaggcgtggaaccgggggaccacctcaaggagcggtctgccctgagctatggaaatacgcttgatctgaactccctcgacatcgatgaacccaccggccagacagcggactggctgaccattatcgtctacctgacatctttcgtggttcctattatcctcaaagccctgtatatgcttaccacacgcgggagacagaccagcaaggataatcggggaatgcgcattagatttaaagacgactccagctacgaggatgtgaacggcatccggaagcccaagcatctgtatgtctctatgcctaatgctcaatccagcatgaaagccgaggaaattacgcccggccgcttcagaaccgctgtgtgcgggctctaccctgcccagatcaaggcgcggaacatggtttctccggtgatgtccgtcgtgggatttctggcccttgctaaagactggacaagccgcatcgaggattggctgggcgccccctgtaagttcatggctgaatctcctattgccgggtccctcagcggaaatcccgtgaacagagactatatccggcagagacagggcgccctggctgggatggagcctaaagaatttcaagcgctgcgccagcactccaaggatgccggatgcaccctcgtcgagcatattgagtctcccagctccatctgggttttcgctggcgccccggaccggtgtcctcccacatgcctgtttgtgggcgggatggccgaacttggagctttctttagcattctgcaggatatgagaaataccatcatggcctctaaaacggtgggcacagcggacgagaagctccgcaagaaatccagcttctaccaatcttacctgcggagaacccagagcatggggatccagcttgatcagcgcattatcgtcatgtttatggtggcttggggaaaggaagccgttgacaacttccacctgggcgatgacatggaccctgagctccggtccctggcccaaattctgatcgatcagaaagtgaaggaaatttctaatcaggagcccatgaaactctga

SEQ ID NO: 7300 - RNA, 1290 nt, synthetic construct
  misc_feature 1..1290: note = derived and/or modified CDS sequence (opt5) from SEOV(IR461)__AF329388.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggcattcggatccgctttaaagacgatagctcctacgagaatgttaacggaattagaaagcccaagcatctgtatgtgagcatgcctaatgctcaatcttccatgaaagccgaggaaatcacgcccggccggttccgcaccgctgtctgcgggctctaccctgcccagatcaaggcgggaaacatggtgagcccggttatgtctgtggtcggctttctggcccttgctaaagactggacatccagaattgaggaatggctggataccccctgtaagttcatggtggagagccctatcgccgggtctctctccggaaatcccgtgaaccgggactatattcgccagagacagggcgctctggccgggatggaacctaaagagtttcaagccctgcggcagcacagcaaggatgctggatgcacactcgtcgagcatatcgaatccccctctagcatttgggttttcgcgggcgccccggacagatgtcctcctacctgcctgtttgtgggcgggatggctgagcttggagccttcttttccatcctgcaggatatgcgcaatacgatcatggccagcaaaacagtgggcaccgctgacgaaaagctccggaagaaatcttccttctaccaaagctacctgagacgcacacagtctatggggattcagcttgatcagcggatcattgtcatgtttatggtggcctggggaaaggaggcggttgacaacttccacctgggcgatgacatggaccccgaactcagaagcctggctcaaatcctgattgatcagaaagtgaaggagatctccaatcaggagcccatgaaactctga

SEQ ID NO: 7301 - RNA, 1290 nt, synthetic construct
  misc_feature 1..1290: note = derived and/or modified CDS sequence (opt5) from SEOV(JUN5-14)__DQ217791.1__N
  source 1..1290: mol_type = other RNA
atggccaccatggaggagttccagagagaaatcagcgctcacgaaggccaactggtgattgcccggcagaaggtcaaagacgcggagaagcagtacgaaaaagatcccgacgatctcaacaagcgcgctctgcatgacagagagtccgttgccgcctctatccagagcaaaattgatgagcttaagcggcaactggctgaccgcatcgccgctgggaagaatattggacaggatagagaccctacaggcgtggaaccgggggatcacctcaaagagcggtccgccctgtcttatggaaacacgcttgacctgaatagcctcgatatcgacgaacccaccggccagacagcggattggctgaccatcattgtgtacctgacatcctttgtcgtgcctatcattctcaaggccctgtatatgcttaccacacgcgggagacagacctctaaagacaacaagggaatgcggatccgcttcaaagacgatagctcctacgaggacgttaatggcattagaaagcccaagcatctgtatgtgagcatgcctaacgctcaatcttccatgaaagccgaggaaatcacgcccggccggtttcgcaccgctgtctgcgggctctaccctgcccagattaaggcgagaaatatggtgagcccggttatgtctgtggtcggattcctggcccttgctaaagattggacatcccggatcgaggaatggctgggcgccccctgtaagtttatggctgagagccctatcgccgggtctctctccggaaaccccgtgaatcgcgactatattagacagcggcagggcgccctggctgggatggaacctaaagagttccaagcgctgagacagcacgccaaggatgctggatgcaccctcgtggagcatatcgaaagcccctcctctatttgggtctttgccggcgccccggaccgctgtcctcccacatgcctgttcgttggcgggatggctgagcttggagcctttttcagcatcctgcaggatatgcggaacaccattatggcgtccaaaacggtgggcacagctgacgaaaagctcagaaagaaaagctctttttaccaatcctacctgcgccggacccagagcatggggatccagcttgatcagagaatcattgtgatgttcatggtcgcctggggaaaggaggccgtggacaattttcacctgggcgatgacatggaccctgaactccgctctctggctcaaatcctgattgatcagaaagttaaggagatcagcaaccaggagcccatgaaactctga

SEQ ID NO: 7302 - RNA, 1290 nt, synthetic construct
  misc_feature 1..1290: note = derived and/or modified CDS sequence (opt5) from SEOV(L99)__AF488708.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcacactgcatgacagagagtccgttgctgcctctattcagagcaaaatcgatgagcttaagcggcaactggccgaccgcattgctgccgggaagaatatcggacaggatagagaccctacgggcgtggaaccgggggatcacctcaaagagcggtccgctctgtcttatggaaacacccttgacctgaatagcctcgatatcgacgaacccacaggccagaccgccgattggctgacaattatcgtgtacctgacctccttcgtcgtgcctattatcctcaaggcgctgtatatgcttacaacccgcgggagacagacgtctaaagacaacaagggaatgcggattcgctttaaagacgatagctcctacgaggacgttaatggcatcagaaagcccaagcatctgtatgtgagcatgcctaacgcccaatcttccatgaaagctgaggaaattacccccggccggttccgcacagccgtctgcgggctctaccctgctcagatcaaggccagaaatatggtgagcccggttatgtctgtggtcggatttctggcgcttgccaaagattggacctcccggatcgaggaatggctgggcgctccctgtaagttcatggccgagagccctattgctgggtctctctccggaaaccccgtgaatcgcgactatatcagacagcggcagggcgccctggccgggatggaacctaaagagtttcaagctctgagacagcacgcgaaggatgccggatgcacactcgtggagcatattgaaagcccctcctctatctgggtcttcgctggcgccccggaccgctgtcctcctacctgcctgtttgttggcgggatggccgagcttggagctttctttagcattctgcaggatatgcggaacacgatcatggcctccaaaacagtgggcaccgcggacgaaaagctcagaaagaaaagctctttctaccaatcctacctgcgccggacacagagcatggggatccagcttgatcagagaattatcgtgatgtttatggtcgcttggggaaaggaggccgtggacaatttccacctgggcgatgacatggaccccgaactccgctctctggcccaaattctgatcgatcagaaagttaaggagattagcaaccaggagcccatgaaactctga

SEQ ID NO: 7303 - RNA, 1290 nt, synthetic construct
  misc_feature 1..1290: note = derived and/or modified CDS sequence (opt5) from SEOV(R22)__AF488707.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctgggcgccccctgtaagttcatggctgagagccctattgccgggtctctctccggaaaccccgtgaatcgcgactatatcagacagcggcagggcgccctggctgggatggaacctaaagagtttcaagcgctgagacagcacgccaaggatgctggatgcaccctcgtggagcatattgaaagcccctcctctatctgggtcttcgccggcgccccggaccgctgtcctcccacatgcctgtttgttggccggatggctgagcttggggccttctttagcattctgcaggatatgaaaaacaccatcatggcgtccaagacggtgggaacagctgacgaaaagctccgcaaaaagagctctttctaccaatcctacctgagacggacccagagcatgggcatccagcttgatcagagaattatcgtgatgtttatggtcgcctgggggaaagaggccgtggacaatttccacctgggagatgacatggaccctgaactccgctctctggctcaaattctgatcgatcagaaggttaaagagattagcaaccaggagcccatgaagctctga

SEQ ID NO: 7304 - RNA, 1290 nt, synthetic construct
  misc_feature 1..1290: note = derived and/or modified CDS sequence (opt5) from SEOV(TURCKHEIM/Hu/FRA/2016/2016.00044)__KX064270.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatctcaacaagcgcgctctgcatgacagagagtccgttgccgcctctattcagagcaaaatcgatgagcttaagcggcaactggctgaccgcattgccgctgggaagaatatcggacaggatagagaccctacaggcgtggaaccgggggatcacctcaaagagcggtccgccctgtcttatggaaacacgcttgacctgaatagcctcgatatcgacgaacccaccggccagacagcggattggctgaccattatcgtgtacctgacatccttcgtcgtgcctattatcctcaaggccctgtatatgcttaccacacgcgggagacagacctctaaagacaacaagggaatgcggattcgctttaaagacgatagctcctacgaggacgttaatggcatcagaaagcccaagcatctgtatgtgagcatgcctaacgctcaatcttccatgaaagccgaggaaattacgcccggccggttccgcaccgctgtctgcgggctctaccctgcccagatcaaggcgagaaatatggtgagcccggttatgtctgtggtcggatttctggcccttgctaaagattggacatcccggatcgaggaatggctggacgccccctgtaagttcattgctgagagccctatcgccggctctctctccgggaaccccgtgaatcgcgattatattagacagcggcagggagccctggctggcatggaacctaaagagtttcaagcgctgagacagcacagcaaggacgccgggtgcaccctcgtggagcatatcgaatccccctctagcatttgggtcttcgctggagccccggatcgctgtcctcccacatgcctgtttgttggcggcatggccgagcttggggctttcttttccatcctgcaggacatgcggaacaccatcatggccagcaaaacggtgggaacagcggatgaaaagctcagaaagaaatcttccttctaccaaagctacctgcgccggacccagtctatgggcattcagcttgaccagagaatcattgtgatgtttatggtcgcttgggggaaggaggccgtggataatttccacctgggagacgacatggatcctgaactccgcagcctggcccaaatcctgattgaccagaaagttaaggagatctccaaccaggagcccatgaaactctga

SEQ ID NO: 7305 - RNA, 1290 nt, synthetic construct
  misc_feature 1..1290: note = derived and/or modified CDS sequence (opt5) from SEOV(Z37)__AF187082.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatttcaacaagcgcgctctccatgacagagagtccgttgccgcctctattcagagcaaaatcgatgagctgaagcggcaacttgctgaccgcattgccgctgggaagaatatcggacaggatagagaccctacaggcgtggaaccgggggatcacctgaaagagcggtccgccctctcttatggaaacacgctggaccttaatagcctggatatcgacgaacccaccggccagacagcggattggctcaccattatcgtgtacctgacatcctttgtcgtgcctattatcctgaaggccctctatatgctgaccacacgcgggagacagacctctaaagacaacaagggaatgcggattcgcttcaaagacgatagctcctacgaggacgttaatggcatcagaaagcccaagcatctttatgtgagcatgcctaacgctcaatcttccatgaaagccgaggaaattacgcccggccggtttcgcaccgctgtctgcgggctgtaccctgcccagatcaaggcgagaaatatggtgagcccggttatgtctgtggtcggattcctcgccctggctaaagattggacatcccggatcgaggaatggcttggcgccccctgtaagtttatggctgagagccctattgccgggtctctgtccggaaaccccgtgaatcgcgactatatcagacagcggcagggcgccctcgctgggatggaacctaaagagttccaagcgctgagacagcacgccaaggatgctggatgcaccctggtggagcatattgaaagcccctcctctatctgggtctttgccggcgccccggaccgctgtcctcccacatgcctcttcgttggcgggatggctgagctgggagcctttttcagcattcttcaggatatgcggaacaccatcatggcgtccaaaacggtgggcacagctgacgaaaagctgagaaagaaaagctctttttaccaatcctacctccgccggacccagagcatggggatccagctggatcagagaattatcggaatgttcatggtggcctggggcaaggaggccgtcgacaattttcaccttggggatgacatggaccctgaactgcgctctctcgctcaaattctgatcgatcagaaagtgaaggagattagcaaccaggagcccatgaaactgtga

SEQ ID NO: 7306 - RNA, 1290 nt, synthetic construct
  misc_feature 1..1290: note = derived and/or modified CDS sequence (opt5) from SEOV(Tchoupitoulas (TCH))__AF329389.1__N
  source 1..1290: mol_type = other RNA
atggccaccatggaggaaatccagagagagattagcgctcacgaaggccaactggtgatcgcccggcagaaggtcaaagacgcggagaagcagtacgaaaaagatcccgacgatttctataagcgcgctctccatgacagagagtccgttgccgcctctattcagagcaaaatcgatgagctgaagcggcaacttgctgaccgcattgccgctgggaagaacatcggacaggatagagaccctacaggcgtggaaccgggggatcacctgaaagagcggtccgccctctcttacggaaatacgctggaccttaacagcctggatatcgacgaacccaccggccagacagcggattggctcaccattatcgtgtatctgacatcctttgtcgtgcctattatcctgaaggccctctacatgctgaccacacgcgggagacagacctctaaagacaataagggaatgcggattcgcttcaaagacgatagctcctatgaggacgttaacggcatcagaaagcccaagcatctttacgtgagcatgcctaatgctcaatcttccatgaaagccgaggaaattacgcccggccggtttcgcaccgctgtctgcgggctgtatcctgcccagatcaaggcgagaaacatggtgagcccggttatgtctgtggtcggattcctcgccctggctaaagattggacatcccggatcgaggaatggcttggcgccccctgtaagtttatggctgagagccctattgccgggtctctgtccggaaatcccgtgaaccgcgactacatcagacagcggcagggcgccctcgctgggatggaacctaaagagttccaagcgctgagacagcacagcaaggatgccggatgcaccctggtggagcatattgaatccccctctagcatctgggtctttgctggcgccccggaccgctgtcctcccacatgcctcttcgttggcgggatggccgagctgggagcctttttctccattcttcaggatatgcggaataccatcatggctagcaaaacggtgggcacagcggacgaaaagctgagaaagaaatcttccttttaccaaagctatctccgccggacccagtctatggggatccagctggatcagagaattatcgtgatgttcatggtcgcttggggaaaggaggccgtggacaactttcaccttggcgatgacatggaccctgaactgcgcagcctcgcccaaattctgatcgatcagaaagttaaggagatttccaatcaggagcccatgaaactgtga

SEQ ID NO: 7307 - RNA, 1290 nt, synthetic construct
  misc_feature 1..1290: note = derived and/or modified CDS sequence (opt5) from SEOV__M34881.1__N
  source 1..1290: mol_type = other RNA
atggccaccatggaggaaatccagagagagattagcgctcacgaaggccaactggtgatcgcccggcagaaggtcaaggacgcggagaagcagtacgaaaaagatcccgacgatctcaacaagcgcgctctgcatgacagagagtccgttgccgcctctattcagagcaaaatcgatgagcttaagcggcaactggctgaccgcctccagcaggggagaacatccggacaggatcgggaccctacgggcgtggaaccgggggatcacctgaaggagcgctctgcccttagctatggaaataccctggacctcaactccctggatattgacgaacccacaggccaaaccgctgattggctgacaatcatcgtgtacctcacctctttcgtcgtgcctattatcctgaaagccctttatatgctgacaaccagagggcggcagacgagcaaggacaataaaggaatgcgcattagatttaaggacgattccagctacgaggacgttaacggcatccggaaacccaagcatctctatgtgtctatgcctaatgcgcagtccagcatgaaggccgaggaaattacccccggccgcttcagaacagctgtctgcgggctgtaccctgcccagatcaaagctcggaacatggtgtctccggttatgtccgtggtcggatttcttgccctggcgaaggattggaccagccgcattgaggaatggctcggcgccccctgtaaattcatggctgagtctctgatcgccgggtccctgagcggaaatcctgtgaacagagactatatccggcaaagacagggcgctctcgccgggatggaacccaaggagtttcaggccctgcgccaacactccaaagatgctggatgcacacttgtggagcatattgaatctcctagctccatctgggtcttcgcgggcgcccccgaccggtgtccgcctacctgcctgtttgttggcgggatggctgagctcggagccttctttagcattctgcaggatatgagaaatacgatcatggcctctaagacagtgggcaccgctgacgaaaaacttcgcaagaagtccagcttctaccagtcttacctgcggagaacacagagcatggggattcaactcgatcagcgcatcatcgtgatgtttatggtcgcctggggaaaagaggcggtggacaacttccacctgggcgatgacatggaccccgaactgcggtccctcgctcagattctgatcgatcagaaggttaaagagatttctaatcaagagcctatgaaactttga

SEQ ID NO: 7308 - RNA, 1287 nt, synthetic construct
  misc_feature 1..1287: note = derived and/or modified CDS sequence (opt5) from SNV(H10)__NC_005216.1__N
  source 1..1287: mol_type = other RNA
atgagcaccctgaaggaggtgcaggacaacatcacactccacgaacaacagctggtcacggccagacagaaacttaaggatgctgagcgggccgttgaactggaccccgatgacgtgaataaatccaccctccagtctcgcagagcggctgtgagcgccctggagacaaaacttggcgaactgaagcgggagctcgccgatctgattgctgcccaaaagctggcttccaagcctgtcgacccgaccgggatcgagcccgatgaccatctcaaagaaaagtctagcctgcgctacggaaacgtgcttgatgttaattccattgacctggaggaaccttctggccagacagccgattggaaaagcatcgggctctatattctgtccttcgcgcttcccatcatcctgaaggccctctacatgctgagcaccagaggacggcagacaattaaagagaacaagggcacccgcatcagatttaaggacgattcttcctatgaggaagtgaatgggattcggaaacctcgccacctgtacgtcagcatgcccacggctcagtctaccatgaaggccgacgagatcacacctggaagattccggaccattgcttgcggcctctttccggcccaagtgaaagcgcgcaacatcatttcccccgttatgggcgtgatcgggttcagctttttcgtcaaggactggatggaaagaatcgatgactttctggccgctcggtgtcctttccttcccgagcagaaagatcctcgcgacgccgctctggccacaaatagagcctattttattacccggcagctccaggtggatgaatctaaggtgtccgacatcgaggatctgattgctgacgcgagagccgagagcgctacgatcttcgccgatattgccacaccccattccgtctgggtttttgcttgcgccccggaccgctgtcctcccaccgcgctttacgtggctggaatgcctgaactgggcgccttctttgccatcctccaagatatgcggaacacaatcatggcttctaaaagcgtggggacctccgaggaaaagctgaagaaaaagagcgccttctatcagtcttacctgagacgcacccagtccatgggcattcaactcgaccagaaaatcattatcctgtacatgagccactggggacgggaggctgtcaatcatttccaccttggggacgatatggaccccgaactgagagagctcgcccagacactggtggatattaaggttcgcgagatctctaaccaggaaccccttaaactgtga

SEQ ID NO: 7309 - RNA, 1287 nt, synthetic construct
  misc_feature 1..1287: note = derived and/or modified CDS sequence (opt5) from SNV(2)__JQ690282.1__N
  source 1..1287: mol_type = other RNA
atgagcaccctgaaggaggtgcaggacaacatcacactccacgaacaacagctggtcacggccagacagaaacttaaggatgctgagcgggccgttgaactggaccccgatgacgtgaataaatccaccctccagtctcgcagagcggctgtgagcgccctggagacaaaacttggcgaactgaagcgggagctcgccgatctgattgctgcccaaaagctggcttccaagcctgtcgacccgaccgggatcgagcccgatgaccatctcaaagaaaagtctagcctgcgctacggaaacgtgcttgatgttaattccattgacctggaggaaccttctggccagacagccgattggaaaagcatcgggctctatattctgtccttcgcgcttcccatcatcctgaaggccctctacatgctgagcaccagaggacggcagacaattaaagagaacaagggcacccgcatcagatttaaggacgattcttcctatgaggaagtgaatgggattcggaaacctcgccacctgtacgtcagcatgcccacggctcagtctaccatgaaggccgacgagatcacacctggaagattccggaccattgcttgcggcctctttccggcccaagtgaaagcgcgcaacatcatttcccccgttatgggcgtgatcgggttcagctttttcgtcaaggactggatggaaagaatcgatgactttctggccgctcggtgtcctttccttcccgagcagaaagatcctcgcgacgccgctctggccacaaatagagcctattttattacccggcagatgcaagtggatgaatctaaggtgtccgacatcgaggatctcattgctgacgcgagagccgagagcgctacgatcttcgccgatattgccacaccccattccgtctgggtttttgcttgcgccccggaccgctgtcctcccaccgcgctgtacgtggctggaatgcctgaacttggcgccttctttgccatcctgcaggatatgcggaacacaatcatggcttctaaaagcgtggggacctccgaggaaaagctcaagaaaaagagcgccttctatcagtcttacctgagacgcacccagtccatgggcattcaactggaccagaaaatcattatcctctacatgagccactggggacgggaggctgtcaatcatttccacctgggggacgatatggaccccgaacttagagagctggcccagacactcgtggatattaaggttcgcgagatctctaaccaggaacccctgaaactttga

SEQ ID NO: 7310 - RNA, 1287 nt, synthetic construct
  misc_feature 1..1287: note = derived and/or modified CDS sequence (opt5) from SNV(3)__JQ690278.1__N
  source 1..1287: mol_type = other RNA
atgagcaccctgaaggaggtgcaggacaacatcacactccacgaacaacagctggtcacggccagacagaaacttaaggatgctgagcgggccgttgaactggaccccgatgacgtgaataaatccaccctccagtctcgcagagcggctgtgagcgccctggagacaaaacttggcgaactgaagcgggagctcgccgatctgattgctgcccaaaagctggcttccaagcctgtcgacccgaccgggatcgagcccgatgaccatctcaaagaaaagtctagcctgcgctacggaaacgtgcttgatgttaattccattgacctggaggaaccttctggccagacagccgattggaaaagcatcgggctctatattctgtccttcgcgcttcccatcatcctgaaggccctctacatgctgagcaccagaggacggcagacaattaaagagaacaagggcacccgcatcagatttaaggacgattcttcctatgaggaagtgaatgggattcggaaacctcgccacctgtacgtcagcatgcccacggctcagtctaccatgaaggccgacgagatcacacctggaagattccggaccattgcttgcggcctctttccggcccaagtgaaagcgcgcaacatcatttcccccgttatgggcgtgatcgggttcagctttttcgtcaaggactggatggaaagaatcgatgactttctggccgctcggtgtcctttccttcccgagcagaaagatcctcgcgacgccgctctggccacaaatagagcctattttattacccggcagctccaggtggatgaatctaaggtgtccgacatcgaggatctgattgctgacgcgagagccgagagcgctacgatcttcgccgatattgccacaccccattccgtctgggtttttgcttgcgccccggaccgctgtcctcccaccgcgctttacgtggctggaatgcctgaactgggcgccttctttgccatcctccaagatatgcggaacacaatcatggcttctaaaagcgtggggacctccgaggaaaagctgaagaaaaagagcgccttctatcagtcttacctgagacgcacccagtccatgggcattcaacccgaccagaaaatcattatcctctacatgagccactggggacgggaggctgtcaatcatttccacctgggggacgatatggaccccgaacttagagagctggcccagacactcgtggatattaaggttcgcgagatctctaaccaggaacctctgaaactttga

SEQ ID NO: 7311 - RNA, 1287 nt, synthetic construct
  misc_feature 1..1287: note = derived and/or modified CDS sequence (opt5) from SNV(CC107/POR)__KT885046.1__N
  source 1..1287: mol_type = other RNA
atgagcaccctgaaggaggtgcaggacaacatcacactccacgaacaacagctggtcacgaccagacagaaacttaaggatgccgagcgggctgttgaactggaccccgatgacgtgaataaatccacactccagtctcgcagagccgcggtgagcgctctggagaccaaacttggcgaactgaagcgggagctcgccgatctgattgccgctcaaaagctggcctccaagcctgtcgacccgacagggatcgagcccgatgaccatctcaaagaaaagtctagcctgcgctacggaaacgtgcttgatgttaattccattgacctggaggaaccttctggccagaccgctgattggaaaagcatcgggctctatattctgtccttcgcccttcccatcatcctgaaggcgctctacatgctgagcacaagaggacggcagaccattaaagagaacaagggcacgcgcatcagatttaaggacgattcttcctatgaggaagtgaatgggattcggaaacctcgccacctgtacgtcagcatgcccaccgcccagtctacaatgaaggctgacgagatcacccctggaagattccggacaattgcctgcggcctctttccggctcaagtgaaagcccgcaacatcatttcccccgttatgggcgtgatcgggttcagctttttcgtcaaggactggatggaaagaatcgatgagtttctggcggcccggtgtcctttccttcccgaacagaaagaccctcgcgatgctgccctggctaccaatagagcctattttattacgcggcagatgcaagtggacgagtctaaggtgtccgatatcgaggacctcattgccgatgctagagcggaaagcgccacaatcttcgctgacattgccacaccccattccgtctgggtttttgcctgcgctccggatcgctgtcctcccaccgccctgtacgtggcgggaatgcctgagcttggcgctttctttgccatcctgcaggacatgcggaacaccatcatggcctctaaaagcgtggggacctccgaagagaagctcaagaaaaagagcgctttctatcagtcttacctgagacgcacacagtccatgggcattcaactggatcagaaaatcattatcctctacatgagccactggggacgggaagccgtcaatcatttccacctgggggacgacatggatcccgagcttagagagctggctcagacgctcgtggacattaaggttcgcgaaatctctaaccaggagcccctgaaactttga

SEQ ID NO: 7312 - RNA, 1287 nt, synthetic construct
  misc_feature 1..1287: note = derived and/or modified CDS sequence (opt5) from HPS(Convict Creek 107)__L33683.1__N
  source 1..1287: mol_type = other RNA
atgagcaccctgaaggaggtgcaggacaacatcacactccacgaacaacagctggtcacgaccagacagaaacttaaggatgccgagcgggctgttgaactggaccccgatgacgtgaataaatccacactccagtctcgcagagccgcggtgagcgctctggagaccaaacttggcgaactgaagcgggagctcgccgatctgattgccgctcaaaagctggcctccaagcctgtcgacccgacagggatcgagcccgatgaccatctcaaagaaaagtctagcctgcgctacggaaacgtgcttgatgttaattccattgacctggaggaaccttctggccagaccgctgattggaaaagcatcgggctctatattctgtccttcgcccttcccatcatcctgaaggcgctctacatgctgagcacaagaggacggcagaccattaaagagaacaagggcacgcgcatcagatttaaggacgattcttcctatgaggaagtgaatgggattcggaaacctcgccacctgtacgtcagcatgcccaccgcccagtctacaatgaaggctgacgagatcacccctggaagattccggacaattgcctgcggcctctttccggctcaagtgaaagcccgcaacatcatttcccccgttatgggcgtgatcgggttcagctttttcgtcaaggactggatggaaagaatcgatgagtttctggcggcccggtgtcctttccttcccgaacagaaagaccctcgcgatgctgccctggctaccaatagagcctattttattacgcggcagatgcaagtggacgagtctaaggtgtccgatatcgaggacctcattgccgatgctagagcggaaagcgccacaatcttcgctgacattgccacaccccattccgtctgggtttttgcctgcgctccggatcgctgtcctcccaccgccctgtacgtggcgggaatgcctgagcttggcgctttctttgggatcctgcaggacatgcggaacaccatcatggcctctaaaagcgtgggaacctccgaagagaagctcaagaaaaagagcgccttctatcagtcttacctgagacgcacacagtccatgggcattcaactggatcagaaaatcattatcctctacatgagccactgggggcgggaagctgtcaatcatttccacctgggagacgacatggatcccgagcttagagagctggcccagacgctcgtggacattaaggttcgcgaaatctctaaccaggagcccctgaaactttga

SEQ ID NO: 7313 - RNA, 1287 nt, synthetic construct
  misc_feature 1..1287: note = derived and/or modified CDS sequence (opt5) from HPS(Convict Creek 74)__L33816.1__N
  source 1..1287: mol_type = other RNA
atgagcaccctgaaggaggtgcaggacaacatcacactccacgaacaacagctggtcacgtccagacagaaacttaaggatgccgagcgggctgttgaactggaccccgatgacgtgaataaatctaccctccagagccgcagagccgcggtgtccgctctggagacaaagctgggcgaactgaaacgggagctcgccgatcatattgccgctcaaaagctggcctctaagcctgtcgacccgaccgggatcgagcccgatgaccacctgaaagaaaagagctccctccgctacggaaacgtgctggatgttaattctattgaccttgaggaacctaacggccagacagctgattggaaaagcatcgggctgtatattctctccttcgccctgcccatcatccttaaggcgctgtacatgctcagcaccagaggacggcagacaattaaagagaataagggcacccgcatcagatttaaggacgattcttcctatgaggaagtgaacgggattcggaaacctcgccatctgtacgtcagcatgcccacggcccagtctaccatgaaggctgacgagatcacacctggaagattccggaccattgcctgcggcctgtttccggctcaagtgaaagcccgcaatatcatttcccccgttatgggcgtgatcgggttcagctttttcgtcaaggactggatggaaagaatcgatgagtttctcgcggcccggtgtcctttcctgcccgaacagaaagaccctcgcgatgctgcccttgctacaaacagagcctattttattacccggcagcttcaggtggacgagtctaaggtgtccgatatcgaggacctcattgccgatgctagagcggaaagcgccacgatcttcgctgacattgccacaccccactccgtctgggtttttgcctgcgctccggatcgctgtcctcccaccgccctgtacgtggcgggaatgcctgagcttggcgctttctttgggatcctgcaagacatgcggaatacaatcatggcctctaaaagcgtgggaacctccgaagagaagctcaagaaaaagagcgccttctatcagtcttacctgagacgcacccagtccatgggcattcaactggatcagaaaatcattatcctctacatgagccattgggggcgggaagctgtcaaccacttccacctgggagacgacatggatcccgagcttagagagctggcccagacactcgtggacattaaggttcgcgaaatctctaatcaggagcccctgaaactttga

SEQ ID NO: 7314 - RNA, 1287 nt, synthetic construct
  misc_feature 1..1287: note = derived and/or modified CDS sequence (opt5) from HPS(H-NY1)__U47135.1__N
  source 1..1287: mol_type = other RNA
atgagcaccctgaaggaggtgcaggacaacatcacactccacgaacaacagctggtcacggccagacagaaacttaaggatgctgagaaagccgttgaagtggaccccgatgacgtgaataagtccaccctgcagggccggcgcgcggctgtctctgccctcgagacaaaactgggggaacttaagagacaactggccgatctcattgctgcccagaagctggctagcaaacctatcgacccgaccggaattgagcccgatgaccatctgaaggagaaatcctctctccggtacggcaacgtgctggatgttaatagcatcgaccttgaagaaccttccgggcagacagccgattggaaggcgattggaatgtatatcctgtctttcgccatccccattatcctcaaagctctgtacatgcttagcacccgcggcagacagacagtgaaggaaaacaaggggacccggattcgctttaaagacgattccagctatgaggaggtcaatggaatcagaaagcctcggcacctgtacgtgtctatgcccacggcccaatccaccatgaaagctgacgaaattacacctggccgcttcagaaccatcgcctgcggcctctttccggcgcaggttaaggcccggaacattatcagccccgtgatgggggtcatcggattcaactttttcgtgaaagactggatggatcgcattgacgattttctggctgagagatgtcctttcctgcccgaacctcgggaccccaaggatgccgctctcggcacaaatcgcgcctattttatcaccagacaggcccaggtggacgagtctaaagtcgttgatattgaggagctgatcgtggacgctcgggcggagtccgccacgcttttcacagatattgctaccccgcatagcgtgtgggtctttgcctgcgcccctgacagatgtccccctacagctctgtacgtggccgggatgcccgaactcggagcgttctttgctatcctgcaagatatgcgcaataccatcatggcctctaagtccgttggcaccgccgaggaaaaacttaagaagaaaagcgctttctatcagtcctacctgcggagaacacagtctatggggattcaactcgaccagaagatcattatcctgtacatgattcactggggaaaagaggccgtgaaccatttccacctgggcgacgatatggaccccgaactccgcgagctggctcaggcccttgtcgatgcgaaggtgaaggagatcagcaatcaggaacctctgaaactctga

SEQ ID NO: 7315 - RNA, 1290 nt, synthetic construct
  misc_feature 1..1290: note = derived and/or modified CDS sequence (opt5) from THAIV(Nakhon Ratchasima/Bi0017/2004)__AM397664.1__N
  source 1..1290: mol_type = other RNA
atggccaccatggaggaactgcagagagagatcaacgctcacgaaggccaactcgtggtcgcccggcagaaggttaaagacgcggagaagcagtacgaaaaagatcccgacgatctgaatcgcagagcccttcatgaccgggagagcgtggctgcctccattcagtctaagatcgatgagctgaaacgccaactcgctgacagaattgccagcgggcggacaatcggacaggatcgcgaccctacgggcgtggaaccgggggatcacctgagagagcggtccatgctttcttatggaaacgtcctggacctcaataacctggatattgaggaacccaccggccagacagctgactggctgaccatcatcgtgtacctcaccagcttcgttattcctatcattctgaaggccctttatatgctgaccacacgcgggagacagaccacgaaggataataaaggaatgcggatccgctttaaggacgactcctcttacgaggatgtgaacggcattagaaaacccaagcatctctatatcagcatgcctaatgcgcaatccagcatgaaagccgaagagattacccccggccggttccgcacagctgtctgcgggctgtaccctgcccaggtgaaggctagaaacatggtttctccggtgatgtccgtcatcggatttatggcccttgcgaaggactggaccgatcggatccaggactggctgggcgccccctgtaaattcctccctgatctgagcacacagtctctgcacgcttcccctcccaccaatgccgactatattgctcaaagacaggggctcctggccggaatggaaacgaaggagagcaaaggcatccgcgatcatgcccgggacgctgggtgcacacttgtggatcacctggactctccctccagcatttgggtgtttgcgggagccccggatagatgtcctcccacatgcctcttcatcgctggcatggccgaactgggcgcctttttctccattcttcaggacatgcgcaacacaatcatggcttctaagaccgtcgggaccagcgaggagaaactgaagaaaaagtccagcttttaccaatcttacctccggagaacacagtccatgggaatccagctggaccagcgcattatcgttatgttcatggtggcctggggcaaggaagcggtggataattttcacctgggggacgatatggaccctgagctccggaacctggctcaacttctgattgatcagaaagtcaaggaaatcagcaatcaggagcccctcaaactgtga

SEQ ID NO: 7316 - RNA, 1290 nt, synthetic construct
  misc_feature 1..1290: note = derived and/or modified CDS sequence (opt5) from TULV(Tula/Moravia/5302Ma/94)__NC_005227.2__N
  source 1..1290: mol_type = other RNA
atgagccagctgaaggagatccaagaagagattaccagacacgaacagcagatcgtgattgcccggcagaaactcaaggacgctgagaaaacagtcgaagccgatcccgacgatgttaacaagtccacgctgcaatctcgcagagcggctgtgagcgcccttgaggacaaactggccgatttcaagcggcagctcgctgacctggtgtcctctcagaagatgggcgagaaacctgtcgatccgaccgggcttgaacccgacgatcatctgaaggagcgcagctccctcagatacggaaatgtgctggacgttaacgccatcgatattgacgaaccttctggccagacagctgattggtttagcatcgggcaatatatcaccggattcgccctggcgattatcctcaaagccctgtacatgctttccacacggggccgccagaccattaaggagaataaagggacaagaatccggtttaaggacgacagctcttatgaggaaattaacggaatccgcagacccaagcacctgtacgtgtccatgcctaccgctcagagcacgatgaaagccgatgagctcacccccggccggttccgcacaattgtctgcggcctgtttcctgctcagatcatgcatagaaatatcatttctccggtgatgggggttatcggattctcctttttcgtgaaggactggcccgaaaagattgaggaatttcttatcaagccttgtcccttcctgaaaaagagcggcccttctaaagaggaggattttctcgtctccaacgacgcctatctgctggggcgggaaaaggcgctccgcgagagccacctggccgaaattgatgaccttatcgatctggctgcctccggagaccccaccccgcctgattctatcaagagcccccaagctccttgggtgttcgcctgcagacccgaccggtgtccccctacatgcatttacatcgccggcatggctgagctcggggcgtttttctccattctgcaggatatgagaaataccatcatggccagcaaaacggtgggaacagctgaagagaaacttaaaaagaaatcttccttctatcagagctacctgcgccggacccaatctatgggcattcagctcgaccagagaatcatcctgctgtttatgacagagtggggcagcgacattgtcaaccatttccacctcggggatgacatggatccggaactgcgcacccttgcccagtccctgatcgaccaaaaggttaaggagatttctaatcaggaacccctcaaaatctga

SEQ ID NO: 7317 - RNA, 1293 nt, synthetic construct
  misc_feature 1..1293: note = derived and/or modified CDS sequence (opt5) from TULV(D17-98)__AF289820.1__N
  source 1..1293: mol_type = other RNA
atgagccagctgaaggagatccaagaagagattaccagacacgaacagcagatcgtgattgcccggcagaaactcaaggacgctgagaaaacagtcgaagccgatcccgacgatgttaacaagtccacgctgcaatctcgcagagcggctgtgagcgcccttgaggacaaactggccgatttcaagcggcagctcgctgacctggtgtcctctcagaagatgggcgagaaacctgtcgatccgaccgggcttgaacccgacgatcatctgaaggagcgcagctccctcagatacggaaatgtgctggacgttaacgccatcgatattgacgaaccttctggccagacagctgattggtttagcatcgggcaatatatcattggattcgccctggcgatcgtgctcaaagccctgtacatgctttccacccggggccgccagacaattaaggagaataaagggaccagaatccggtttaaggacgacagctcttatgaggaaattaacggaatccgcagacccaagcacctgtacgtctccatgcctacagctcagagcaccatgaaagccgatgagctcacgcccggccggttccgcaccattgtgtgcggcctgtttcctgctcagatcatgcatagaaatatcatttctccggttatgggggtgatcggattctcctttttcgtcaaggactggcccgataaaattgaagagtttcttatcaagccttgtcccttcctgaaaaagcaaggcgggcctaacaaagacgaagagtttctcgtgagctatgatgcctacctgctgggacgggagaaggcgctccgcgaatctcacctggccgagattgacgatcttatcgacctggctgcctccggcgatcccacaccgcctgacagcatcaagtctccccaggggccttgggtgttcgcttgcgcccccgatagatgtccccctacctgcatttatgtcgccggaatggctgaactcggcgcgtttttctccatcctgcaggacatgcggaatacaattatggccagcaaaaccgttggcacggctgaggaaaaacttaagaagaaatccagcttctaccaatcttacctgagacgcacacagtccatggggatccagctcgaccagcggattatcctgctgtttatgatggagtggggaagcgatatcgtgaaccatttccacctcggcgacgatatggacccggagctgagaacccttgcccaatctctgattgatcagaaggtgaaggaaatcagcaatcaggagcccctcaaaatttga

SEQ ID NO: 7318 - RNA, 1293 nt, synthetic construct
  misc_feature 1..1293: note = derived and/or modified CDS sequence (opt5) from TULV(D5-98)__AF289819.1__N
  source 1..1293: mol_type = other RNA
atgagccagctgaaggagatccaagaagagattaccagacacgaacagcagatcgtgattgcccggcagaaactcaaggacgctgagaaaacagtcgaagccgatcccgacgatgttaacaagtccacgctgcaatctcgcagagcggctgtgagcgcccttgaggacaaactggccgatttcaagcggcagctcgctgacctggtgtcctctcagaagatgggcgagaaacctgtcgatccgaccgggcttgaacccgacgatcatctgaaggagcgcagctccctcagatacggaaatgtgctggacgttaacgccatcgatattgacgaaccttctggccagacagctgattggtttagcatcgggcaatatatcattggattcgccctggcgatcgtgctcaaagccctgtacatgctttccacccggggccgccagacaattaaggagaataaagggaccagaatccggtttaaggacgacagctcttatgaggaaattaacggaatccgcagacccaagcacctgtacgtctccatgcctacagctcagagcaccatgaaagccgatgagctcacgcccggccggttccgcaccattgtgtgcggcctgtttcctgctcagatcatgcatagaaatatcatttctccggttatgggggtgatcggattctcctttttcgtcaaggactggcccgataaaattgaagagtttcttatcaagccttgtcccttcctgaaaaagcaaggcgggcctaacaaagacgaagagtttctcgtgagctatgatgcctacctgctgggacgggagaaggcgctccgcgaatctcacctggccgagattgacgatcttatcgacctggctgcctccggcgatcccacaccgcctgacagcatcaagtctccccaggctccttgggtgttcgcctgcgcccccgatagatgtccccctacctgcatttatgtcgctgggatggcggaactcggagcctttttctccatcctgcaggacatgcggaatacaattatggctagcaaaaccgttggcacggccgaggaaaaacttaagaagaaatccagcttctaccaatcttacctgagacgcacacagtccatgggcatccagctcgaccagcggattatcctgctgtttatgatggagtgggggagcgatatcgtgaaccatttccacctcggagacgatatggacccggagctgagaacccttgcccaatctctgattgatcagaaggtgaaggaaatcagcaatcaggagcccctcaaaatttga

SEQ ID NO: 7319 - RNA, 1293 nt, synthetic construct
  misc_feature 1..1293: note = derived and/or modified CDS sequence (opt5) from TULV(D63-98)__AF289821.1__N
  source 1..1293: mol_type = other RNA
atgagccagctgaaggagatccaagaagagattaccagacacgaacagcagatcgtgattgcccggcagaaactcaaggacgctgagaaaacagtcgaagccgatcccgacgatgttaacaagtccacgctgcaatctcgcagagcggctgtgagcgcccttgaggacaaactggccgatttcaagcggcagctcgctgacctggtgtcctctcagaagatgggcgagaaacctgtcgatccgaccgggcttgaacccgacgatcatctgaaggagcgcagctccctcagatacggaaatgtgctggacgttaacgccatcgatattgacgaaccttctggccagacagctgattggtttagcatcgggcaatatatcattggattcgccctggcgatcgtgctcaaagccctgtacatgctttccacccggggccgccagacaattaaggagaataaagggaccagaatccggtttaaggacgacagctcttatgaggaaattaacggaatccgcagacccaagcacctgtacgtctccatgcctacagctcagagcaccatgaaagccgatgagctcacgcccggccggttccgcaccattgtgtgcggcctgtttcctgctcagatcatgcatagaaatatcatttctccggttatgggggtgatcggattctcctttttcgtcaaggactggcccgataaaaaggaagagtttcttattaaaccttgtcccttcctgaagaaacaaggcgggcctaacaaggacgaagagtttctcgtgagcaatgatgcctatctgctgggacgggagaaggcgctccgcgaatctcacctggccgagatcgacgatcttattgacctggctgcctccggcgatcccacaccgcctgacagcatcaaatctccccaggggccttgggtgttcgcttgcgcccccgatagatgtccccctacctgcatctacgtcgccggaatggctgaactcggcgcgtttttctccattctgcaggacatgcggaacacaatcatggccagcaagaccgttggcacggctgaggaaaaacttaagaaaaagtccagcttctatcaatcttacctgagacgcacacagtccatggggattcagctcgaccagcggatcattctgctgtttatgatggagtggggaagcgatatcgtgaatcatttccacctcggcgacgatatggacccggagctgagaacccttgcccaatctctgatcgatcagaaggtgaaagaaattagcaaccaggagcccctcaagatctga

SEQ ID NO: 7320 - RNA, 1290 nt, synthetic construct
  misc_feature 1..1290: note = derived and/or modified CDS sequence (opt5) from TULV(MG23/Omsk)__AF442621.1__N
  source 1..1290: mol_type = other RNA
atgagcaccctgaaggagatccaggaagagattacaagacacgaacaacagatcgtgattgcccggcagaaactcaaggacgctgagaaaacggtcgaagccgatcccgacgatgttaacaagaataccctgcagtcccgcagagcggctgtgtctacacttgaggacaaactggccgagttcaagcggcaactcgccgatctggtgagctcccagaagatgggcgaaaaacctgtcgacccgaccgggcttgagcccgatgaccatctgaaggaacgctctagcctcagatacggaaacgtgctggatgttaatgctacagacatcgatgagccttccggccagaccgccgactggttttctattgggcagtatatcatgggattcgctctggccatcgtgctcaaagcgctgtacatgcttagcacacggggccgccaaaccattaaggagaacaaagggacgagaatcaagtttaaggatgactccagcattgaagagatcaatggcattcggcgccccaaacacctgtatgtctctatgcctaccgcccagtccacaatgaaggctgacgaactcacccccggaagattccggacaatcgtgtgcggcctgtttcctgcccagattatgcatcgcaacatcatcagcccggttatgggggtgattggattctcctttttcgtcaaagattggcccgacaagatcgaggaatttcttattaaaccttgtcccttcctgaagaaacagggctctaccaaggaggaggaatttctcgtgagcaatgatgcttacatgctggggagagagaaggccctgcgggaatctcacctcgcggagatcgacgaactgattgatcttgccgactccggagatcctacgcccccggacagcatcaaatcccctcaagctccctgggtgttcgcctgcgctcctgatcgctgtcctcccacatgcatctatattgccggcatggccgagctgggggcgtttttctctatcctccaggacatgagaaacaccattatggctagcaagacagtcggaaccgccgaggaaaaactgaagaaaaagtccagcttctaccagtcttatcttcggagaacccaatccatgggcatccagctggatcagcgcattatcctcctgtttatgatggagtggggcagcgacatcgttaatcatttccacctgggggacgatatggaccccgaactccggacactggctcagtctcttattgatcaaaaggtgaaagagatcagcaaccaggaaccgctgaagatttga

SEQ ID NO: 7321 - RNA, 1290 nt, synthetic construct
  misc_feature 1..1290: note = derived and/or modified CDS sequence (opt5) from TULV(c109-s)__AF164094.1__N
  source 1..1290: mol_type = other RNA
atgagccagctgaaggagatccaagaagagattaccagacacgaacagcagatcgtgattgcccggcagaaactcaaggacgctgagaaaacagtcgaagccgatcccgacgatgttaacaagtccacgctgcaatctcgcagagcggctgtgagcgcccttgaggacaaactggccgatttcaagcggcagctcgctgacctggtgtcctctcagaagatgggcgagaaacctgtcgatccgaccgggcttgaacccgacgatcatctgaaggagcgcagctccctcagatacggaaatgtgctggacgttaacgccatcgatattgacgaaccttctggccagacagctgattggtttagcatcgggcaatatatcaccggattcgccctggcgattatcctcaaagccctgtacatgctttccacacggggccgccagaccattaaggagaataaagggacaagaatccggtttaaggacgacagctcttatgaggaaattaacggaatccgcagacccaagcacctgtacgtgtccatgcctaccgctcagagcacgatgaaagccgatgagctcacccccggccggttccgcacaattgtctgcggcctgtttcctgctcagatcatgcatagaaatatcatttctccggtgatgggggttatcggattctcctttttcgtgaaggactggcccgaaaagattgaggaatttcttatcaagccttgtcccttcctgaaaaagagcggcccttctaaagaggaggattttctcgtctccaacgacgcctatctgctggggcgggaaaaggcgctccgcgagagccacctggccgaaattgatgaccttatcgatctggctgcctccggagaccccaccccgcctgattctatcaagagcccccaagctccttgggtgttcgcctgcgcccccgacagatgtccccctacatgcatttacatcgctggcatggcggagctcggggcctttttctccattctgcaggatatgcggaataccatcatggctagcaaaacggtgggaacatctgaagagaaacttaaaaagaaatccagcttctatcagtcttacctgagacgcacccaaagcatgggcattcagctcgaccagcggatcatcctgctgtttatgacagagtggggctccgacattgtcaaccatttccacctcggggatgacatggatccggaactgagaacccttgcccagtctctgatcgaccaaaaggttaaggagattagcaatcaggaacccctcaaaatctga

SEQ ID NO: 7322 - RNA, 1290 nt, synthetic construct
  misc_feature 1..1290: note = derived and/or modified CDS sequence (opt5) from TULV(CHEVRU/Hu/FRA/2015/15.00453)__KT946591.1__N
  source 1..1290: mol_type = other RNA
atgagccagctgaaggagatccaagaagagattaccagacacgaacagcagatcgtgattgcccggcagaaactcaaggacgctgagaaaacagtcgaagccgatcccgacgatgttaacaagtccacgctgcaatctcgccaggcggctgtgagcgcccttgaggacaaactggccgatttcaagagaaagctcgctgacctggtgtcctctcagaaaatgggcgagaagcctgtcgatccgaccgggcttgaacccgacgatcatctgaaagagcggagctccctccgctacggaaatgtgctggacgttaacgccatcgatattgacgaaccttctggccagacagctgattggtttagcatcgggcaatatgtgatgggattcgccctggcgatcattctcaaggccctgtacatgctttccaccagaggccggcagacaatcaaagagaataaggggacccgcattagatttaaggacgacagctcttatgaggaaatcaacggcattcggcgccccaaacacctgtacgtctccatgcctacagctcagagcaccatgaaggccgatgagctcacgcccggaagattccggaccatcgtgtgcggcctgtttcctgctcagattatgcatcgcaatatcatctctccggttatgggggtgattggattctcctttttcgtcaaagactggcccgaaaagatcgaggaatttcttattaaaccttgtcccttcctgaagaaaagcggcccttctaaggaggaggattttctcgtgtccaacgacgcctatctgctggggagagaaaaggcgctccgggatagccacctggccgagatcgacgatcttattgacctggctgaatccggagatcccacaccgcctgactctatcaaaagcccccaagccccttgggtgttcgcttgcgcccccgatcgctgtccccctacctgcatctacattgccggcatggctgagctcggggcgtttttctccatcctgcaggacatgagaaatacaattatggccagcaagaccgtcggaacggctgaagagaaacttaagaaaaagtcttccttctatcagagctacctgcggagaacacaatctatgggcatccagctcgaccagcgcattatcctgctgtttatgatcgagtggggcagcgatattgttaaccatttccacctcggggacgatatggacccggaactgcggacccttgcccagtccctgatcgatcaaaaggtgaaagagatttctaatcaggaacccctcaagatctga

SEQ ID NO: 7323 - RNA, 1290 nt, synthetic construct
  misc_feature 1..1290: note = derived and/or modified CDS sequence (opt5) from TULV(g20-s)__AF164093.1__N
  source 1..1290: mol_type = other RNA
atgagccagctgaaggagatccaagaagagattaccagacacgaacagcagatcgtgattgcccggcagaaactcaaggacgctgagaaaacagtcgaagccgatcccgacgatgttaacaagtccacgctgcaatctcgccaggcggctgtgagcgcccttgaggacaaactggccgatttcaagagaaagctcgctgacctggtgtcctctcagaaaatgggcgagaagcctgtcgatccgaccgggcttgaacccgacgatcatctgaaagagcggagctccctccgctacggaaatgtgctggacgttaacgccatcgatattgacgaaccttctggccagacagctgattggtttagcatcgggcaatatgtgatgggattcgccctggcgatcattctcaaggccctgtacatgctttccaccagaggccggcagacaatcaaagagaataaggggacccgcattagatttaaggacgacagctcttatgaggaaatcaacggcattcggcgccccaaacacctgtacgtctccatgcctacagctcagagcaccatgaaggccgatgagctcacgcccggaagattccggaccatcgtgtgcggcctgtttcctgctcagattatgcatcgcaatatcatctctccggttatgggggtgattggattctcctttttcgtcaaagactggcccgaaaagatcgaggaatttcttattaaaccttgtcccttcctgaagaaaagcggcccttctaaggaggaggattttctcgtgtccaacgacgcctatctgctggggagagaaaaggcgctccgggatagccacctggccgagatcgacgatcttattgacctggctgaatccggagatcccacaccgcctgactctatcaaaagcccccaagccccttgggtgttcgcttgcgcccccgatcgctgtccccctacctgcatctacattgccggcatggctgagctcggggcgtttttctccatcctgcaggacatgagaaatacaattatggccagcaagaccgtcggaacggctgaagagaaacttaagaaaaagtcttccttctatcagagctacctgcggagaacacaatctatgggcatccagctcgaccagcgcattatcctgctgtttatgaccgagtggggcagcgatatcgttaaccatttccacctcggggacgatatggacccggaactgcggacacttgcccagtccctgattgatcaaaaggtgaaagagatctctaatcaggaacccctcaagatttga

SEQ ID NO: 7324 - RNA, 1293 nt, synthetic construct
  misc_feature 1..1293: note = derived and/or modified CDS sequence (opt5) from TULV(Sennickerode Sen05/174)__EU439948.1__N
  source 1..1293: mol_type = other RNA
atgagccagctgaaggagatccaagaagagattaccagacacgaacagcagatcgtgattgcccggcagaaactcaaggacgctgagaaaacagtcgaagccgatcccgacgatgttaacaagtccacgctgcaatctcgcagagcggctgtgagcgcccttgaggacaaactggccgatttcaagcggcagctcgctgacctggtgtcctctcagaagatgggcgagaaacctgtcgatccgaccgggcttgaacccgacgatcatctgaaggagcgcagctccctcagatacggaaatgtgctggacgttaacgccatcgatattgacgaaccttctggccagacagctgattggtttagcatcgggcaatatatcattggattcgccctggcgatcgtgctcaaagccctgtacatgctttccacccggggccgccagacaattaaggagaataaagggaccagaatccggtttaaggacgacagctctttcgaggaaattaacggaatccgcagacccaagcacctgtatgtctccatgcctacagctcagagcaccatgaaagccgatgagctcacgcccggccggtttcgcaccattgtgtgcggcctgttccctgctcagatcatgcatagaaatatcatttctccggttatgggggtgatcggattttccttctttgtcaaggactggcccgataaaattgaagagttccttatcaagccttgtccctttctgaaaaagcaaggcgggcctaacaaagacgaagatttcctcgtgagcaatgacgcctactttctgggacgggagaaggcgctgcgcgagtctcacctcaacgaaattgatgacctgatcgagcttgccgcttccggcgatcccacaccgcctgacagcatcaagtctccccaggccccttgggtgttcgcttgcgcccccgatagatgtccccctacctgcatttatgtcgccgggatggctgaactgggagcgttcttttccatcctccaggacatgcggaatacaattatggccagcaaaaccgttggcacggctgaggaaaagctgaaaaagaaatccagcttctaccaatcttatcttagacgcacacagtccatgggcatccagctggaccagcggattatcctcctgtttatgatggagtgggggagcgatatcgtgaaccatttccacctgggagacgatatggacccggagctcagaaccctggcccaatctcttattgatcagaaggtgaaggaaatcagcaatcaggagcccctgaaaatttga

SEQ ID NO: 7325 - RNA, 1293 nt, synthetic construct
  misc_feature 1..1293: note = derived and/or modified CDS sequence (opt5) from TULV(Sennickerode Sen05/175)__EU439949.1__N
  source 1..1293: mol_type = other RNA
atgagccagctgaaggagatccaagaagagattaccagacacgaacagcagatcgtgattgcccggcagaaactcaaggacgctgagaaaacagtcgaagccgatcccgacgatgttaacaagtccacgctgcaatctcgcagagcggctgtgagcgcccttgaggacaaactggccgatttcaagcggcagctcgctgacctggtgtcctctcagaagatgggcgagaaacctgtcgatccgaccgggcttgaacccgacgatcatctgaaggagcgcagctccctcagatacggaaatgtgctggacgttaacgccatcgatattgacgaaccttctggccagacagctgattggtttagcatcgggcaatatatcattggattcgccctggcgatcgtgctcaaagccctgtacatgctttccacccggggccgccagacaattaaggagaataaagggaccagaatccggtttaaggacgacagctctttcgaggaaattaacggaatccgcagacccaagcacctgtatgtctccatgcctacagctcagagcaccatgaaagccgatgagctcacgcccggccggtttcgcaccattgtgtgcggcctgttccctgctcagatcatgcatagaaatatcatttctccggttatgggggtgatcggattttccttctttgtcaaggactggcccgataaaattgaagagttccttatcaagccttgtccctttctgaaaaagcaaggcgggcctaacaaagacgaagatttcctcgtgagcaatgacgcctactttctgggacgggagaaggcgctgcgcgagtctcacctcaacgaaattgatgacctgatcgagcttgccgcttccggcgatcccacaccgcctgacagcatcaagtctccccaggccccttgggtgttcgcttgcgcccccgatagatgtccccctacctgcatttatgtcgccgggatggctgaactgggagcgttcttttccatcctccaggacatgcggaaaagcattatggcctccaagacagttggcaccgctgaggaaaaactgaagaaaaagagctctttctaccaatcctatcttagacgcacgcagagcatgggcatccagctggaccagcggattatcctcctgtttatgatggagtgggggtctgatatcgtgaatcatttccacctgggagacgatatggacccggagctcagaacactggcccaaagccttattgatcagaaggtgaaagaaatctccaaccaggagcccctgaagatttga

SEQ ID NO: 7326 - RNA, 1293 nt, synthetic construct
  misc_feature 1..1293: note = derived and/or modified CDS sequence (opt5) from TULV(TUL/Karatal/Ma322/2003)__AM945877.1__N
  source 1..1293: mol_type = other RNA
atgagccagctgaaggagatccaagaagagattaccagacacgaacagcagatcgtgattgcccggcagaaactcaaggacgctgagaaaacagtcgaagccgatcccgacgatgttaacaagaatacgctgcaatcccgcagagcggctgtgtctgcccttgaggacaaactggccgagttcaagcggcagctcgctgatctggtgagctcccagaagatgggcgaaaaacctgtcgacccgaccgggcttgagcccgatgaccatctgaaggaacgctctagcctcagatacggaaacgtgctggatgttaatgccatcgacattgatgagccttccggccagacagctgactggttttctatcgggcaatatgtgatgggattcgccctggcgatcgtcctcaaagccctgtacatgcttagcacccggggccgccagacaattaaggagaacaaagggaccagaatccggtttaaggatgactccagcttcgaagagattaatggaatccgcagacccaagcacctgtatgtgtctatgcctacagctcagtccaccatgaaagccgacgaactcacgcccggccggtttcgcaccattgtttgcggcctgttccctgctcagatcatgcatagaaacattatcagcccggtgatgggggtcatcggattttctttctttgtgaaggattggcccgagaaaattgaagagttccttatcaagccttgtccctttctgaaaaagcaaggctccagcgggaaagaggaagagttcctcgtgtctaatgacgcctacctgattggacgggaaaagacactgcaggagtcccacctcaccgaaatcgatgacctgattgatcttgcggacagcggcgatcctacacccccggactccatcaagtctcctcaggccccctgggtctttgcttgcgcccctgatcgctgtccccctacctgcatctatattgctgggatggccgagctgggagccttcttcagcatcctccaagacatgagaaacacgattatggcttccaaaacagttggcaccgcggaggaaaagctgaaaaagaaaagctctttttaccagtcctatcttcggagaacacagagcatgggcatccagctggatcaacgcattatcctcctgttcatgatggagtgggggtctgacatcgtgaatcattttcacctgggagacgatatggaccccgaactccggaccctggcccagagccttattgatcagaaggtgaaggagatctccaaccaggaaccgctgaaaatttga

SEQ ID NO: 7327 - RNA, 1293 nt, synthetic construct
  misc_feature 1..1293: note = derived and/or modified CDS sequence (opt5) from TULV(Tula/Kosice144/Ma/95)__Y13979.1__N
  source 1..1293: mol_type = other RNA
atgagccagctgaaggagatccaagaagagattaccagacacgaacagcagatcgtgattgcccggcagaaactcaaggacgctgagaaaacagtcgaagccgatcccgacgatgttaacaagtccacgctgcaatctcgcagagcggctgtgagcgcccttgaggacaaactggccgatttcaagcggcagctcgctgacctggtgtcctctcagaagatgggcgagaaacctgtcgatccgaccgggcttgaacccgacgatcatctgaaggagcgcagctccctcagatacggaaatgtgctggacgttaacgccatcgatattgacgaaccttctggccagacagctgattggtttagcatcgggcaatatatcattggattcgccctggcgatcgtgctcaaagccctgtacatgctttccacccggggccgccagacaattaaggagaataaagggaccagaatccggtttaaggacgacagctctttcgaggaaattaacggaatccgcagacccaagcacctgtatgtctccatgcctacagctcagagcaccatgaaagccgatgagctcacgcccggccggtttcgcaccattgtgtgcggcctgttccctgctcagatcatgcatagaaatatcatttctccggttatgggggtgatcggattttccttctttgtcaaggactggcccgaaaagattgaggagttccttatcaagccttgtccctttctgaaaaagcaaggcgcccctgggaaagaagaggatttcctcgtgagcaacgacgcgtacctgctgggacgggaaaaggccctccgcgagtctcacctggctgaaattgatgaccttatcgatctggccgcttccggcgaccccacaccgcctgatagcatcaagtctccccaggccccttgggtgtttgcctgcgctcccgacagatgtccccctacctgcatttatatcgcggggatggccgagctcggagctttcttctccattctgcaggatatgcggaatacaatcatggccagcaaaaccgtcggcacggccgaagagaaacttaaaaagaaatccagcttttaccaatcttatctgagacgcacacagtccatgggcattcagctcgaccagcggatcatcctgctgttcatgaccgagtgggggagcgacattgttaaccattttcacctcggagatgacatggatccggaactgagaacacttgctcaatctctgatcgaccagaaggtgaaggagattagcaatcaggaacccctcaaaatctga

SEQ ID NO: 7328 - RNA, 1293 nt, synthetic construct
  misc_feature 1..1293: note = derived and/or modified CDS sequence (opt5) from TULV(Tula/Kosice667/Ma/95)__Y13980.1__N
  source 1..1293: mol_type = other RNA
atgagccagctgaaggagatccaagaagagattaccagacacgaacagcagatcgtgattgcccggcagaaactcaaggacgctgagaaaacagtcgaagccgatcccgacgatgttaacaagtccacgctgcaatctcgcagagcggctgtgagcgcccttgaggacaaactggccgatttcaagcggcagctcgctgacctggtgtcctctcagaagatgggcgagaaacctgtcgatccgaccgggcttgaacccgacgatcatctgaaggagcgcagctccctcagatacggaaatgtgctggacgttaacgccatcgatattgacgaaccttctggccagacagctgattggtttagcatcgggcaatatatcattggattcgccctggcgatcgtgctcaaagccctgtacatgctttccacccggggccgccagacaattaaggagaataaagggaccagaatccggtttaaggacgacagctctttcgaggaaattaacggaatccgcagacccaagcacctgtatgtctccatgcctacagctcagagcaccatgaaagccgatgagctcacgcccggccggtttcgcaccattgtgtgcggcctgttccctgctcagatcatgcatagaaatatcatttctccggttatgggggtgatcggattttccttctttgtcaaggactggcccgaaaagattgaggagttccttatcaagccttgtccctttctgaaaaagcaaggcgcccctgggaaagaagaggatttcctcgtgagcaacgacgcgtacctgctgggacgggaaaaggccctccgcgagtctcacctggctgaaattgatgaccttatcgatctggccgcttccggcgaccccacaccgcctgatagcatcaagtctccccaggccccttgggtgtttgcctgcgctcccgacagatgtccccctacctgcatttatatcgcggggatggccgagctcggagctttcttctccattctgcaggatatgcgggacacaatcatggccagcaaaaccgtcggcacggccgaagagaaacttaaaaagaaatccagcttttaccaatcttatctgagacgcacacagtccatgggcattcagctcgaccagcggatcatcctgctgttcatgaccgagtgggggagcgatattgttaatcattttcacctcggagacgatatggacccggaactgagaacacttgctcaatctctgatcgatcagaaggtgaaggagattagcaaccaggaacccctcaaaatctga

SEQ ID NO: 7329 - RNA, 1290 nt, synthetic construct
  misc_feature 1..1290: note = derived and/or modified CDS sequence (opt5) from TULV(Tula/Koziky/5247Ma/94)__AJ223600.1__N
  source 1..1290: mol_type = other RNA
atgagccagctgaaggagatccaagaagagattaccagacacgaacagcagatcgtgattgcccggcagaaactcaaggacgctgagaaaacagtcgaagccgatcccgacgatgttaacaagtccacgctgcaatctcgcagagcggctgtgagcgcccttgaggacaaactggccgatttcaagcggcagctcgctgacctggtgtcctctcagaagatgggcgagaaacctgtcgatccgaccgggcttgaacccgacgatcatctgaaggagcgcagctccctcagatacggaaatgtgctggacgttaacgccatcgatattgacgaaccttctggccagacagctgattggtttagcatcgggcaatatatcaccggattcgccctggcgattatcctcaaagccctgtacatgctttccacacggggccgccagaccattaaggagaataaagggacaagaatccggtttaaggacgacagctcttatgaggaaattaacggaatccgcagacccaagcacctgtacgtgtccatgcctaccgctcagagcacgatgaaagccgatgagctcacccccggccggttccgcacaattgtctgcggcctgtttcctgctcagatcatgcatagaaatatcatttctccggtgatgggggttatcggattctcctttttcgtgaaggactggcccgaaaagattgaggaatttcttatcaagccttgtcccttcctgaaaaagaacggccctagcaaagaggaggattttctcgtctctaatgacgcctatctgctggggcgggaaaaggcgctccgcgagtcccacctggccgaaattgatgaccttatcgatctggctgccagcgaggaccccaccccgcctgattccatcaagtctccccaagctccttgggtgttcgcctgcagacccgaccggtgtccccctacatgcatttacatcgccggaatggctgaactcggcgcgtttttcagcattctgcaggatatgagaaacaccatcatggcctccaaaacggtggggacagctgaggagaaacttaaaaagaaaagctctttctatcagtcctacctgcgccggacccaaagcatgggcattcagctcgaccagagaatcatcctgctgtttatgacagaatggggatctgacattgtcaatcatttccacctcggcgatgacatgagcccggagctgcgcacccttgcccagtccctgatcgatcaaaaggttaaggaaatttctaaccaggagcccctcaaaatctga

SEQ ID NO: 7330 - RNA, 1290 nt, synthetic construct
  misc_feature 1..1290: note = derived and/or modified CDS sequence (opt5) from TULV(Tula/Moravia/5302v/95)__Z69991.1__N
  source 1..1290: mol_type = other RNA
atgagccagctgaaggagatccaagaagagattaccagacacgaacagcagatcgtgattgcccggcagaaactcaaggacgtcgagaaaacagttgaagctgatcccgacgatgtgaacaagtccacgctgcaatctcgcagagccgcggtgagcgctcttgaggacaaactggccgatttcaagcggcagctcgccgacctggtctcctctcagaagatgggcgagaaacctgtggatccgaccgggcttgaacccgacgatcatctgaaggagcgcagctccctcagatacggaaatgttctggacgtgaacgctatcgatattgacgaaccttctggccagacagccgattggtttagcatcgggcaatatatcaccggattcgctctggccattatcctcaaagcgctgtacatgctttccacacggggccgccagaccattaaggagaataaagggacaagaatccggtttaaggacgacagctcttatgaggaaattaacggaatccgcagacccaagcacctgtacgtctccatgcctaccgcccagagcacgatgaaagctgatgagctcacccccggccggttccgcacaattgtgtgcggcctgtttcctgcccagatcatgtatagaaatatcatttctccggttatgggggtgatcggattctcctttttcgtcaaggactggcccgaaaagattgaggaatttcttatcaagccttgtcccttcctgaaaaagagcggcccttctaaagaggaggattttctcgtgtccaacgacgcttacctgctggggcgggaaaaggccctccgcgagagccatctggcggaaattgatgaccttatcgatctggccgcttccggagaccccaccccgcctgattctatcaagagcccccaagccccttgggtgttcgcttgcagacccgaccggtgtccccctacatgcatttatatcgccggcatggccgagctcggggcgtttttctccattctgcaggatatgagaaataccatcatggctagcaaaacggtcggaacagccgaagagaaacttaaaaagaaatcttccttctaccagagctacctgcgccggacccaatctatgggcattcagctcgaccagagaatcatcctgctgtttatgacagagtggggcagcgacattgttaaccacttccatctcggggatgacatggatccggaactgcgcacccttgctcagtccctgatcgaccaaaaggtgaaggagatttctaatcaggaacccctcaaaatctga

SEQ ID NO: 7331 - RNA, 1293 nt, synthetic construct
  misc_feature 1..1293: note = derived and/or modified CDS sequence (opt5) from TULV__AF017659.1__N
  source 1..1293: mol_type = other RNA
atgagccagctgaaggagatccaagaagagattaccagacacgaacagcagatcgtgattgcccggcagaaactcaaggacgctgagaaaacagtcgaagccgatcccgacgatgttaacaagtccacgctgcaatctcgcagagcggctgtgagcgcccttgaggacaaactggccgatttcaagcggcagctcgctgacctggtgtcctctcagaagatgggcgagaaacctgtcgatccgaccgggcttgaacccgacgatcatctgaaggagcgcagctccctcagatacggaaatgtgctggacgttaacgccatcgatattgacgaaccttctggccagacagctgattggtttagcatcgggcaatatatcattggattcgccctggcgatcgtgctcaaagccctgtacatgctttccacccggggccgccagacaattaaggagaataaagggaccagaatccggtttaaggacgacagctctttcgaggaaattaacggaatccgcagacccaagcacctgtatgtctccatgcctacagctcagagcaccatgaaagccgatgagctcacgcccggccggtttcgcaccattgtgtgcggcctgttccctgctcagatcatgcatagaaatatcatttctccggttatgggggtgatcggattttccttctttgtcaaggactggcccgaaaagattgaggagttccttatcaagccttgtccctttctgaaaaagcaaggcgcccctgggaaagaagaggatttcctcgtgagcaacgacgcgtacctgctgggacgggaaaaggccctccgcgagtctcacctggctgaaattgatgaccttatcgatctggccgcttccggcgaccccacaccgcctgatagcatcaagtctccccaggccccttgggtgtttgcctgcgctcccgacagatgtccccctacctgcatttatgtcgcggggatggccgagctcggagctttcttctccatcctgcaggatatgcggaatacaattatggccagcaaaaccgttggcacggccgaagagaaacttaaaaagaaatccagcttttaccaatcttatctgagacgcacacagtccatgggcatccagctcgaccagcggattatcctgctgttcatgaccgagtgggggagcgacatcgtgaaccattttcacctcggagatgacatggatccggaactgagaacacttgctcaatctctgattgaccagaaggtgaaggagatcagcaatcaggaacccctcaaaatttga

SEQ ID NO: 7332 - RNA, 1293 nt, synthetic construct
  misc_feature 1..1293: note = derived and/or modified CDS sequence (opt5) from TULV(Lodz-1)__AF063892.1__N
  source 1..1293: mol_type = other RNA
atgaccgagctgaaggaaatccaggaggaaattacaagacacgagcaacagatcgtgattgcccggcagaaactcaaggacgctgaaaagacggtcgaggccgatcccgacgatgttaacaagagcaccctgcagtcccgcagagcggctgtgtctgcccttgaggacaaactggccgatttcaagcggcaactcgctgacctggtgagctcccagaagatgggcgaaaaacctgtcgatccgacagggcttgagcccgacgatcatctgaaggaacgctctagcctcagatacggaaatgtgctggacgttaacgccatcgatattgacgagccttccggccagaccgctgattggttttctatcgggcagtatatcatgggattcgccctggcgattgtgctcaaagccctgtacatgcttagcacacggggccgccaaaccatcaaggagaataaagggacacgcattcggtttaaggacgactccagctatgaagagatcaacggaattagaagacccaagcacctgtacgtctctatgcctaccgctcagtccacgatgaaagccgatgaactcacccccggccggttccgcacaatcgtgtgcggcctgtttcctgctcagattatgcatagaaatatcatcagcccggttatgggggtgattggattctcctttttcgtcaaggactggcccgataaaatcgaggaatttcttattaagccttgtcccttcctgaaaaagcagggcgggcctaacaaagacgaggagtttctcgtgtctaatgatgcctatctgctgggacgggaaaaggcgctccgcgagagccacctggccgaaatcgacgatcttattgacctggctgcctctggcgatcccaccccgcctgactccatcaagagcccccaagctccttgggtgttcgcctgcgcccccgatagatgtccccctacatgcatctacgtcgctgggatggcggagctcggagcctttttctccattctgcaggacatgcggaacaccatcatggcttctaaaacggttggcacagccgaagagaaacttaaaaagaaaagctccttctatcagagctacctgagacgcacccaatctatgggcattcagctcgaccagcggatcattctgctgtttatgatggagtgggggtccgatatcgtgaatcatttccacctcggagacgatatggacccggaactgagaacacttgcccagagcctgatcgatcaaaaggtgaaggagatttctaaccaggaacccctcaaaatctga

SEQ ID NO: 7333 - RNA, 1293 nt, synthetic construct
  misc_feature 1..1293: note = derived and/or modified CDS sequence (opt5) from TULV(Lodz-2)__AF063897.1__N
  source 1..1293: mol_type = other RNA
atgaccgagctgaaggaaatccaggaggaaattacaagacacgagcaacagatcgtgattgcccggcagaaactcaaggacgctgaaaagacggtcgaggccgatcccgacgatgttaacaagagcaccctgcagtcccgctgggcggctgtgtctgcccttgaggacaaactggccgatttcaagagacaactcgctgacctggtgagctcccagaagatgggcgaaaaacctgtcgatccgacagggcttgagcccgacgatcatctgaaggaacggtctagcctccgctacggaaatgtgctggacgttaacgccatcgatattgacgagccttccggccagaccgctgattggttttctatcgggcagtatatcatgggattcgccctggcgattgtgctcaaagccctgtacatgcttagcacaagaggccggcaaaccatcaaggagaataaagggacacgcattagatttaaggacgactccagctatgaagagatcaacggcattcggcgccccaagcacctgtacgtctctatgcctaccgctcagtccacgatgaaagccgatgaactcacccccggaagattccggacaatcgtgtgcggcctgtttcctgctcagattatgcatcgcaatatcatcagcccggttatgggggtgattggattctcctttttcgtcaaggactggcccgataaaatcgaggaatttcttattaagccttgtcccttcctgaaaaagcagggcgggcctaacaaagacgaggagtttctcgtgtctaatgatgcctatctgctgggaagagaaaaggcgctccgggagagccacctggccgaaatcgacgatcttattgacctggctgcctctggcgatcccaccccgcctgactccatcaagagcccccaagctccttgggtgttcgcctgcgcccccgatcgctgtccccctacatgcatctacgtcgctgggatggcggagctcggagcctttttctccattctgcaggacatgagaaacaccatcatggcttctaaaacggttggcacagccgaagagaaacttaaaaagaaaagctccttctatcagagctacctgcggagaacccaatctatgggcattcagctcgaccagcgcatcattctgctgtttatgatggagtgggggtccgatatcgtgaatcatttccacctcggagacgatatggacccggaactgcggacacttgcccagagcctgatcgatcaaaaggtgaaggagatttctaaccaggaacccctcaaaatctga

SEQ ID NO: 7334 - RNA, 1449 nt, synthetic construct
  misc_feature 1..1449: note = derived and/or modified CDS sequence (opt5) from CCHFV(IbAr10200)__NC_005302.1/U88410.1__N
  source 1..1449: mol_type = other RNA
atggagaacaagatcgaagtgaataacaaagacgagatgaatagatggttcgaagagtttaagaaaggcaacgggctggtcgataccttcacaaatagctactccttttgcgaatctgttcccaacctcgaccggttcgtgtttcagatggccagcgctacggatgacgcccaaaaggattccatttatgcgtctgctctggtggaggccaccaaattctgtgcccctatctacgagtgcgcttgggtcagctccacaggaattgtgaagaagggccttgaatggtttgagaaaaatgccgggaccatcaagtcttgggacgaaagctatacagagctgaaagttgatgtgccgaagattgagcagctcaccggataccagcaggctgccctgaaatggcgcaaggacatcggcttcagagtcaacgcgaatacagccgctctttccaacaaggtgctggccgaatataaagttcccggggagatcgtgatgagcgtcaaggaaatgctctctgatatgattcggcgcagaaatctgatcctgaaccggggaggcgacgagaatcctcgcggccccgtgtcccacgaacacgtggattggtgtagagagtttgtcaaagggaagtacattatggctttcaaccctccctggggagacatcaataaaagcggccggtctgggattgccctcgttgcgaccggactggccaaacttgctgagacggaaggcaaagggatctttgatgaggccaagaagaccgtggaagctctgaacggatatctcgacaaacacaaggacgaggtggatcgcgcctccgccgacagcatgattacaaacctgcttaaacatatcgctaaggcgcaagaactgtacaaaaattcttccgccctcagagctcagagcgcccagatcgataccgccttctcctcttactattggctgtacaaggctggcgtcacacctgagacctttccgacggtgagccagttcctgttcgagctcggcaagcaaccccgggggacaaagaagatgaaaaaggccctgctttccacccctatgaaatggggaaagaagctgtatgaactctttgcggacgatagcttccagcagaaccgcatttacatgcaccccgctgttctgacagccggcagaatctctgagatgggggtgtgctttggaaccattcctgtcgccaatcccgacgatgctgcccagggctccgggcataccaaaagcatccttaacctgcggacaaatacggaaaccaacaatccgtgtgctaagacaattgtgaaactcttcgaggttcaaaagaccggatttaacatccaggacatggatatcgtggcctctgaacatctgctgcaccagagcctcgtcggcaaacaatcccctttccagaatgcgtataacgtgaagggcaatgccacatctgctaacattatctga

SEQ ID NO: 7335 - RNA, 1449 nt, synthetic construct
  misc_feature 1..1449: note = derived and/or modified CDS sequence (opt5) from CCHFV(Turkey-Kelkit06)__GQ337053.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaagactctgggaccatcaagagctgggatgaaaattatgccgagctgaaagtggacgttccgaagattgagcagctcgctaactaccagcaggccgcgctgaagtggagaaaagatatcggattccgggtgaatgccaacacagctgccctttccaataaggtcctggctgaatataaagtgcccggcgagatcgttatgagcgtgaaggaaatgctctctgacatgattcgcagacggaacctgatcctgaatcgcgggggagatgagaaccctagaggccccgtctcccgggaacacgtggagtggtgtcgcgagtttgtgaaaggcaagtacattatggccttcaatcctccctggggagacatcaacaaaagcgggagatctggcattgcgctcgtcgccaccgggctggctaaacttgccgaaacagagggaaagggcgtttttgatgaagctaagaagaccgtggaggccctgaacgggtatctcgacaaacatcgggacgaagtggataaggcctccgctgacagcatgatcacgaatctgcctaaacacattgcgaaggcccaagagctttacaagaactcttccgctctgcgcgcccagggagcccagatcgataccccgttcagctccttttactggctctataaagctggcgtcacacccgagaccttccctacaatctctcagttcctgtttgaactgggcgagcaacccagagggaccaagaaaatgaagaaagccctcctgagcacgcctatgaagtggggaaagaaactttacgaactgttcgcggacgattcctttcagcagaatcggatttatatgcatcccgctgtgctcacagccggccgcatcagcgagatgggggtttgcttcggaaccattccggtggccaaccctgacgatgctgcccagggctctgggcacacaaagtccatcctgaatcttagaaccagcaccgaaacaaacaatccctgtgctaaaacgattgtcaagctgtttgagatccaagagaccggattcaacatccaggacatggatattgtggcctctgaacatctcctgcaccagagcatcgttggcaaacaatccccttttcagaatgcgtacaacgtgaagggcaatgccacatctgctaacattatctga

SEQ ID NO: 7336 - RNA, 1449 nt, synthetic construct
  misc_feature 1..1449: note = derived and/or modified CDS sequence (opt5) from CCHFV(Baghdad 12)__AJ538196.1__N
  source 1..1449: mol_type = other RNA
atggagaacaagatcgaagtgaatagcaaagacgagatgaacaagtggttcgaagagtttaaaaagggcaatgggctggtcgatacctacacaaactcctattctttctgcgaaagcgttcccaatctcgacagatttgtgttccagatggccggagctacggatgacgcccaaaaagattccatttacgcgtctgctctggtggaggccaccaagttttgtgcccctatctatgagtgcgcttgggccagctccacaggcattgtcaagaaagggcttgaatggttcgagaagaacaccggaacaatcaaatcttgggacgaaagctacaccgagctgaaggtggaggttccgaaaattgaacagctctttaattatcagcaggctgccctgaagtggcggaaggatatcggcttccgcgtgaacgcgaatacagccgctctttccaacaaagtcctggccgagtacaaggtgcccggggaaatcgttatgagcgtgaaagagatgctctctgacatgattagacggcgcaatctgatcctgaacagaggaggcgatgaaaatcctcggggccccgtctcccgcgagcacgtggagtggtgtagagaatttgtgaaggggaaatatattatggctttcaaccctccctggggagacatcaataagagcggccggtctgggattgccctcgtcgcgaccggactggccaaacttgctgagacggaaggcaagggggtttttgatgaggccaagaaaaccgtggaagctctgaacggatacctcgacaagcataaagatgaggtggacaaggcctccgccgacaacatggtcacaaatctgcttaaacacgtggctaaggcgcaagagctgtacaagaacagctctgccctccgcgctcagggcgcccagatcgataccgttttctccagctattactggctgtataaagccggcgtgacacctgaaacctttccgacggtctcccagttcctgttcgagctcgggaagcatcccagaggaaccaaaaagatgaaaaaggctctgctttctacacctatgaagtggggcaaaaagctgtacgaactctttgccgacgatagcttccaacagaatcggatttatatgcaccccgcggtgctgacagctgggcgcatctccgagatgggagtttgctttggcaccatccctgtggccaaccccgacgatgccgctcttgggagcggacataccaaatctattctgaatctcagaacaaacacggaaaccaataacccgtgtgcccggacaatcgtcaagctgttcgagattcagaaaaccggctttaatatccagcacatggacattgtggcttccgagcatctgctccaccaaagcctggtcggcaagcagtctcctttccagaacgcctacaatgtgaaggggaacgcgacaagcgccaatatcatctga

SEQ ID NO: 7337 - RNA, 1449 nt, synthetic construct
  misc_feature 1..1449: note = derived and/or modified CDS sequence (opt5) from CCHFV(SR3)__AJ538198.1__N
  source 1..1449: mol_type = other RNA
atggagaacaagatcgaagtgaatagcaaagacgagatgaacaagtggttcgaagagtttaaaaagggcaatgggctggtcgataccttcacaaactcctactctttttgcgaaagcgttcccaatctcgacagattcgtgtttcagatggcctccgctacggatgacgcccaaaaagattctatttatgcgagcgctctggtggaggccaccaagttctgtgcccctatctacgagtgcgcttgggcctcctctacaggaattgtcaagaaaggccttgaatggtttgagaagaacgctgggaccatcaaaagctgggacgaatcctatacagagctgaaggtggaggttccgaaaattgaacagctcagcaattaccagcaggccgcgctgaagtggcggaaggatatcggattccgcgtgaacgccaataccgctgccctttctaacaaagtcctggctgagtataaggtgcccggcgaaatcgttatgtccgtgaaagagatgctcagcgacatgattagacggcgcaatctgatcctgaacagagggggagatgaaaatcctcggggccccgtctctcgcgagcacgtggagtggtgtagagaatttgtgaagggcaaatacattatggccttcaaccctccctggggagacatcaataagtccggacggagcggcattgcgctcgtcgccacagggctggctaaacttgccgagaccgaaggaaagggcgtttttgatgaggctaagaaaacggtggaagccctgaacgggtatctcgacaagcataaagatgaggtggacaaggcctctgctgactccatgatcaccaacctgcttaaacacattgcgaaggcccaagagctgtacaagaatagctccgctctccgcgcccagggagcccagatcgatacagtcttctctagctactattggctgtacaaagctggcgtgacccctgacacatttccggccgtttcccagttcctgttcgaactcggcaagcaacccagagggaccaaaaagatgaaaaaggcgctgcttagcacgcctatgaagtgggggaaaaagctgtatgagctctttgctgatgactctttccagcagaaccggatctacatgcatcccgccgtgctgacagccggccgcatttccgaaatgggggtctgctttggaaccatccctgtggctaatcccgatgacgccgctcttggcagcgggcacacaaaatctattctgaacctcagaaccaataccgagacaaacaatccgtgtgccaagacgatcgttaaactgttcgaaattcagaagaccggatttaacatccaagatatggacatcgtggcgagcgagcatctgctccaccagtccctggtcggcaagcagtctcctttccaaaatgcctataacgtgaaaggcaatgctacaagcgccaacattatctga

SEQ ID NO: 7338 - RNA, 1449 nt, synthetic construct
  misc_feature 1..1449: note = derived and/or modified CDS sequence (opt5) from CCHFV(Gaib)__KX013446.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagaaaggccttgaatggtttgagaagaatgccgggaccatcaaatcttgggacgaaagctatacagagctgaaggttgaggtgccgaaaattgaacagctcgctaactaccagcaggccgcgctgaagtggcggaaggatatcggattccgcgtcaatgccaacaccgctgccctttcccacaaagtgctggctgagtataaggttcccggcgaaatcgtgatgagcgtcaaagagatgctctctgacatgattagacggcgcaatctgatcctgaacagagggggagatgaaaatcctcggggccccgtgtcccgcgagcacgtggagtggtgtagagaatttgtcaagggcaaatacattatggccttcaaccctccctggggagacatcaataagagcggacggtctggcattgcgctcgttgccacagggctggctaaacttgccgagaccgaaggaaagggcgtgtttgatgaggctaagaaaacggtggaagccctgaacgggtatctcgacaagcacaaagatgaggtcgacaaggcctccgctgacaacatgatcaccaatctgcttaaacatattgcgaaggcccaagagctgtacaagaacagctctgctctccgcgcccagggagcccagatcgatacagctttctccagctactattggctgtacaaagccggcgtgacccctgaaacatttccgaccgtttcccagttcctgttcgagctcggcaagcaacccagagggacgaaaaagatgaaaaaggcgctgctttctacacctatgaagtgggggaaaaagctgtatgaactctttgctgacgatagcttccagcagaatcggatctacatgcaccccgccgtgctgaccgccggccgcatttccgagatgggggtctgctttggaacaatccctgtggctaaccccgacgatgccgctcagggcagcgggcataccaaatctattcttaatctgagaaccaacacagaaacgaataacccgtgtgccaagaccatcgttaaactcttcgagattcaaaagacaggatttaatatccaggacatggatatcgtggcgtccgagcatctgctgcaccagagcctcgtcggcaagcaatctcctttccagaacgcctataatgtgaaaggcaacgctaccagcgccaatattatctga

SEQ ID NO: 7339 - RNA, 1449 nt, synthetic construct
  misc_feature 1..1449: note = derived and/or modified CDS sequence (opt5) from CCHFV(Hodzha)__KX013449.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagaaaggccttgaatggtttgagaagaatgccgggaccatcaaatcttgggacgaaagctatacagagctgaaggttgaggtgccgaaaattgaacagctcgctaactaccagcaggccgcgctgaagtggcggaaggatatcggattctgtgtcaatgccaacaccgctgccctttcccaaaaagtgctgagcgagtataaggttcccggcgaaatcgtgatgtctgtcaaagagatgctctccgacatgattcgcagacggaatctgatcctgaaccgcgggggagatgaaaatcctagaggccccgtgagccgggagcacgtggagtggtgccgcgaatttgtcaagggcaaatacattatggctttcaaccctccctggggagacatcaataagtctggaagatccggcattgccctcgttgcgacagggctggccaaacttgctgagaccgaaggaaagggcgtgtttgatgaggccaagaaaacggtggaagctctgaacgggtatctcgacaagcataaagatgaggtcgacaaggccagcgccgacaacatgaccacaaatctgcttaaacacatcgctaaggcgcaggagctgtacaagaactcttccgccctccgggctcagggagcccagattgataccgccttcagctcctactattggctgtacaaagctggcgtgacacctgaaacctttccgacggtttctcaattcctgttcgagctcggcaagcagccccgcgggaccaaaaagatgaaaaaggccctgcttagcacacctatgaagtgggggaaaaagctgtatgaactctttgcggacgattccttccagcagaatagaatctacatgcatcccgctgtgctgacaaccggccggatcagcgagatgggggtctgttttggaaccgtgcctgttgccgaccccgatgacgccgctcaaggctctgggcacacaaaatccattcttaacctgcgcacgaataccgaaacaaacaatccgtgcgccaagaccatcgtgaaactcttcgagattcagaagacaggatttaacatccaggatatggacattgtcgctagcgagcatctgctgcaccaatctctcgtgggcaagcagagccctttccagaatgcctataacgtcaaaggcaatgcgacctccgccaacatcatctga

SEQ ID NO: 7340 - RNA, 1449 nt, synthetic construct
  misc_feature 1..1449: note = derived and/or modified CDS sequence (opt5) from CCHFV(IbAn7620)__KX013452.1__N
  source 1..1449: mol_type = other RNA
atggagaacaagatcgaagtgaataacaaagacgagatgaatagatggttcgaagagtttaagaaagaaaacggcctggtcgataccttcacaaatagccactccttttgcgagtctgttcccaacctcgacaagttcgtgtttcagatggccagcgctacggatgacgcccaaaaagattccatttacgcggctgccctggtggaggccaccaagttctgtgctcctatctatgaatgcgcctgggtctctagcacagggattgtgaagaaaggacttgagtggtttgaaaagaatgctggcaccatcaaatcctgggacgagtcttacacagagctgaaggttgaagtgccgaaaattgagcagctcagcaactatcagcaggccgcgctgaagtggcggaaggatatcgggttccgcgtcaatgccaacaccgctacactttcccataaagtgctggccgaatacaaggttcccggagagatcgtgatgagcgtcaaagaaatgctctctgacatgattagacggcgcaatctgatcctgaacagaggcggggatgagaatcctcggggacccgtgtcccgcgagcacgtggaatggtgtagagagtttgtcaagggcaaatatattatggctttcaaccctccctggggcgacatcaataagagcgggcggtctggaattgccctcgttgcgaccggcctggccaaacttgctgaagccgaggggaagggagtgtttgatgaagctaagaaaacggtggaggccctgaacggctacctcgacaagcataaagatgaggtcgacaagtccagcgccgactctatgatcaccaacctgcttaaacacattgctaaggcgcaagaactgtataaaaattccagcgccctccgcgctcagggggcccagatcgatacagccttctcctcttactactggctgtataaggctggagtgacccctgagacatttccgaccgttagccagttcctgttcgaactcggcaagcaacccagaggcacgaaaaagatgaaaaaggccctgctttccacacctatgaagtgggggaaaaagctgtacgagctctttgcggacgatagcttccagcagaaccggatctatatgcatcccgctgtgctgaccgccggacgcatttctgaaatgggcgtctgctttgggacaatccctgtggccaatcccgacgatgctgcccttggatccggccacaccaaaagcattctgaacctcagaacctctacagaggctaataacccgtgtgccaagacgatcgttaaactgttcgagattcagaagaaggggtttgtgatcaaagacatggatatcgtcgcgagcgaacatctgctccaccaatccctggtgggaaagcagtctcctttccagaatgcctacaacgtcaaaggcaatgctaccagcgccaacattatctga

SEQ ID NO: 7341 - RNA, 1449 nt, synthetic construct
  misc_feature 1..1449: note = derived and/or modified CDS sequence (opt5) from CCHFV(K128_76)__KX013455.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccagcctcgacagattcgtgtttcagatggcctccgctacggatgacgcccaaaaagattctatttatgcgagcgctctggtggaggccaccaagttctgtgcccctatctacgagtgcgcttgggtctcctctacaggaattgtgaagaaaggccttgaatggtttgagaagaacgccgggaccatcaaaagctgggacgaatcctatacagagctgaaggttgaggtgccgaaaattgaacagctcgctaattaccagcaggccgcgctgaagtggcggaaggatatcggattccgcgtcaacgccaataccgctgcccttagccacaaagtgctggctgagtataaggttcccggcgaaatcgtgatgtctgtcaaagagatgctctccgacatgattagacggcgcaacctgatcctgaatagagggggagatgaaaaccctcggggccccgtgagccgcgagcacgtggagtggtgtagagaatttgtcaagggcaaatacattatggccttcaatcctccctggggagacatcaacaagtctggacggtccggcattgcgctcgttgccacagggctggctaaacttgccgagaccgaaggaaagggcgtgtttgatgaggctaagaaaacggtggaagccctgaatgggtatctcgacaagcacaaagatgaggtcgacaaggccagcgctgacaacatgatcaccaacctgcttaaacatattgcgaaggcccaagagctgtacaaaaattcttccgctctccgcgcccagggagcccagatcgatacagctttcagctcctactattggctgtacaaggccggcgtgacccctgaaacatttccgaccgtttctcagttcctgttcgagctcggcaagcaacccagagggacgaaaaagatgaaaaaggcgctgcttagcacacctatgaagtgggggaaaaagctgtatgaactctttgctgacgattccttccagcagaaccggatctacatgcaccccgccgtgctgaccgccggccgcattagcgagatgggggtctgctttggaacaatccctgtggctaatcccgacgatgccgctcagggctctgggcataccaaatccattcttaacctgagaaccaatacagaaacgaacaatccgtgtgccaagaccatcgttaaactcttcgagattcaaaagacaggatttaacatccaggacatggatatcgtggcgagcgagcatctgctgcaccagtctctcgtcggcaagcaaagccctttccagaatgcctataacgtgaaaggcaatgctacctccgccaacattatctga

SEQ ID NO: 7342 - RNA, 1449 nt, synthetic construct
  misc_feature 1..1449: note = derived and/or modified CDS sequence (opt5) from CCHFV(K168_125)__KX013461.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagaaaggccttgaatggtttgagaagaatgccgggaccatcaaatcttgggacgaaagctatacagagctgaaggttgaggtgccgaaaattgaacagctcgctaactaccagcaggccgcgctgaagtggcggaaggatatcggattccgcgtcaatgccaacaccgctgccctttcccacaaagtgctggctgagtataaggttcccggcgacatcgtgatgagcgtcaaagaaatgctctctgatatgattagacggcgcaatctgatcctgaacagagggggagacgagaatcctcggggccccgtgtcccgcgaacacgtggagtggtgtagagagtttgtcaagggcaaatacattatggccttcaaccctccctggggagatatcaataagagcggacggtctggcattgcgctcgttgccacagggctggctaaacttgccgaaaccgagggaaagggcgtgtttgacgaagctaagaaaacggtggaggccctgaacgggtatctcgataagcacaaagacgaagtcgacaaggcctccgctgataacatgatcaccaatctgcttaaacatattgcgaaggcccaagagctgtacaagaacagctctgctctccgcgcccagggagcccagatcgacacagctttctccagctactattggctgtacaaagccggcgtgacctccgagacatttcctaccgtttctcagttcctgttcgaactcggcaagcaaccgagagggacgaaaaagatgaaaaaggcgctgcttagcacacccatgaagtgggggaaaaagctgtatgagctctttgctgatgactccttccagcagaatcggatctacatgcaccctgccgtgctgaccgccggccgcattagcgaaatgggggtctgctttggaacaatccccgtggctaaccctgatgacgccgctcagggctctgggcataccaaatccattcttaatctgagaaccaacacagagacgaataacccctgtgccaagaccatcgttaaactcttcgaaattcaaaagacaggatttaatatccaggatatggacatcgtggcgagcgagcatctgctgcaccagtctctcgtcggcaagcaaagcccgttccagaacgcctataatgtgaaaggcaacgctacctccgccaatattatctga

SEQ ID NO: 7343 - RNA, 1449 nt, synthetic construct
  misc_feature 1..1449: note = derived and/or modified CDS sequence (opt5) from CCHFV(K168_40)__KX013458.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagaaaggccttgaatggtttgagaagaatgccgggaccatcaaatcttgggacgaaagctatacagagctgaaggttgaggtgccgaaaattgaacagctcgctaactaccagcaggccgcgctgaagtggcggaaggatatcggattccgcgtcaatgccaacaccgctgccctttcccacaaagtgctggctgagtataaggttcccggcgacatcgtgatgagcgtcaaagaaatgctctctgatatgattagacggcgcaatctgatcctgaacagagggggagacgagaatcctcggggccccgtgtcccgcgaacatgtggagtggtgtagagagtttgtcaagggcaactacattatggccttcaatcctccctggggagatatcaacaaaagcgggcggtctggcattgcgctcgttgccacagggctggctaagctggccgaaaccgagggaaaaggcgtgtttgacgaagctaagaagacggtggaggccctgaacgggtatctcgataaacacaaggacgaagtcgacaaagcctccgctgataatatgatcaccaacctgcttaagcatattgcgaaagcccaagagctgtacaagaatagctctgctctccgcgcccagggagcccagatcgacacagctttctccagctactattggctgtacaaggccggcgtgacctccgagacatttcctaccgtttctcagttcctgttcgaactcggcaaacaaccgagagggacgaagaaaatgaagaaagcgctgcttagcacacccatgaagtggggaaagaaactgtatgagctctttgctgatgactccttccagcagaaccggatctacatgcaccctgccgtgctgaccgccggccgcattagcgaaatgggggtctgctttggaacaatccccgtggctaatcctgatgacgccgctcagggctctgggcataccaagtccattcttaacctgagaaccaatacagagacgaacaatccctgtgccaaaaccatcgttaaactcttcgaaattcaaaagacaggatttaacatccaggatatggacatcgtggcgagcgagcaccttctgcaccagtctctcgtcggcaagcaaagcccgttccagaatgcctataacgtgaagggcaatgctacctccgccaacattatctga

SEQ ID NO: 7344 - RNA, 1449 nt, synthetic construct
  misc_feature 1..1449: note = derived and/or modified CDS sequence (opt5) from CCHFV(K323_27)__KX013473.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaaaattctgggaccatcaagagctgggacgaaaactatgccgagctgaaagtggatgttccgaagattgagcagctcgctaattaccagcaggccgcgctgaagtggagaaaagacatcggattccgggtgaacgccaatacagctgccctttccaacaaggtcctggctgaatataaagtgcccggcgagatcgttatgagcgtgaaggaaatgctctctgatatgattcgcagacggaatctgatcctgaaccgcgggggagacgagaatcctagaggccccgtctcccgggaacacgtggagtggtgtcgcgagtttgtgaaaggcaagtacattatggccttcaaccctccctggggagatatcaacaaaagcggaagatctggcattgcgctcgtcgccaccgggctggctaagctcgccgaaacagagggaaagggcgtttttgacgaagctaaaaagaccgtggaggccctgaatgggtatctcgataaacatcgggacgaagtggacaaggcctccgctgatagcatgatcacgaacctgcttaaacacattgcgaaggcccaagagctgtacaaaaattcttccgctctccgcgcccagggagcccagatcgacacccctttcagctccttttactggctgtataaggctggcgtcacaccggagaccttccccacaatctctcagttcctgtttgaactcggcaagcaacctagagggaccaaaaagatgaaaaaggccctgcttagcacgcccatgaagtgggggaaaaagctgtacgagcttttcgcggatgactcctttcagcagaaccggatttatatgcatcctgctgtgctgacagccggccgcatcagcgaaatgggggtttgcttcggaaccattcccgtggccaatccggatgacgctgcccagggctctgggcacacaaaatccatccttaacctgagaaccagcaccgagacaaataacccttgtgctaagacgattgtcaaactctttgaaatccaaaagaccggattcaatatccaggatatggacattgtggcctctgagcatctgctgcaccagagcctcgttggcaagcaatccccctttcagaacgcgttcaatgtgaaaggcaacgccacatctgctaatatcatttga

SEQ ID NO: 7345 - RNA, 1449 nt, synthetic construct
  misc_feature 1..1449: note = derived and/or modified CDS sequence (opt5) from CCHFV(Min)__KX013482.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaaaattctgggaccatcaagagctgggacgaaaactatgccgagctgaaagtggatgttccgaagattgagcagctcgctaattaccagcaggccgcgctgaagtggagaaaagacatcggattccgggtgaacgccaatacagctgccctttccaacaaggtcctggctgaatataaagtgcccggcgagatcgttatgagcgtgaaggaaatgctctctgatatgattcgcagacggaatctgatcctgaaccgcgggggagacgagaatcctagaggccccgtctcccgggaacacgtggagtggtgtcgcgagtttgtgaaaggcaagtacattatggccttcaaccctccctggggagatatcaacaaactcggaagaagcggcattgcgctggtcgccaccgggcttgctaagctggccgaaacagagggaaagggcgtttttgacgaagctaaaaagaccgtggaggccctcaatgggtatctggataaacatcgggacgaagtggacaaggcctctgctgattccatgatcacgaaccttctgaaacacattgcgaaggcccaagagctctacaagaatagctctgctctgcgcgcccagggagcccagatcgacacccctttctccagcttttactggctgtataaagctggcgtcacaccggagaccttccccacaatctcccagttcctctttgaactgggcaagcaacctagagggaccaaaaagatgaaaaaggcccttctgtctacgcccatgaagtgggggaaaaagctctacgagctgttcgcggatgacagctttcagcagaaccggatttatatgcatcctgctgtgcttacagccggccgcatctccgaaatgggggtttgcttcggaaccattcccgtggccaatccggatgacgctgcccagggcagcgggcacacaaaatctatcctgaacctcagaacctccaccgagacaaataacccttgtgctaagacgattgtcaaactgtttgaaatccaaaagaccggattcaatatccaggatatggacattgtggccagcgagcatctgctccaccagtctctggttggcaagcaaagcccctttcagaacgcgtacaatgtgaaaggcaacgccacatccgctaatatcatttga

SEQ ID NO: 7346 - RNA, 1449 nt, synthetic construct
  misc_feature 1..1449: note = derived and/or modified CDS sequence (opt5) from CCHFV(Saf)__KX013488.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaaaattctgggaccatcaagagctgggacgaaaactatgccgagctgaaagtggatgttccgaagattgagcagctcgctaattaccagcaggccgcgctgaagtggagaaaagacatcggattccgggtgaacgccaatacagctgccctttccaacaaggtcctggctgaatataaagtgcccggcgagatcgttatgagcgtgaaggaaatgctctctgatatgattcgcagacggaatctgatcctgaaccgcgggggagacgagaatcctagaggccccgtctcccgggaacacgtggagtggtgtcgcgagtttgtgaaaggcaagtacattatggccttcaaccctccctggggagatatcaacaaaagcggaagatctggcattgcgctcgtcgccaccgggctggctaagctcgccgaaacagagggaaagggcgtttttgacgaagctaaaaagaccgtggaggccctgaatgggtatctcgataaacatcgggacgaagtggacaaggcctccgctgatagcatgatcacgaacctgcttaaacacattgcgaaggcccaagagctgtacaaaaattcttccgctctccgcgcccagggagcccagatcgacacccctttcagctccttttactggctgtataaagctggcgtcacaccggagaccttccccacaatctctcagttcctgtttgaactcggcaagcaacctagagggaccaaaaagatgaaaaaggccctgcttagcacgcccatgaagtgggggaaaaagctgtacgagcttttcgcggatgactcctttcagcagaaccggatttatatgcatcctgctgtgctgacagccggccgcatcagcgaaatgggggtttgcttcggaaccattcccgtggccgatccggacgatgctgcccagggctctgggcacacaaaatccatccttaatctgagaaccagcaccgagacaaacaatccttgtgctcggacgattgtcaagctctttgaaatccaaaagaccggattcaacatccaggacatggatattgtggcctctgagcatctgctgcaccagagcctcgttggcaagcaatccccctttcagaatgcgtacaacgtgaagggcaatgccacatctgctaacatcatttga

SEQ ID NO: 7347 - RNA, 1449 nt, synthetic construct
  misc_feature 1..1449: note = derived and/or modified CDS sequence (opt5) from CCHFV(UCCR4459)__KY484031.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagaaaggccttgaatggtttgagaagaatgccgggaccatcaaatcttgggacgaaagctatacagagctgaaggttgaggtgccgaaaattgaacagctcgctggataccagcaggccgcgctgaagtggcggaaggatatcggcttccgcgtcaacgccaataccgctgccctttcccacaaagtgctggctgagtataaggttcccggggaaatcgtgatgagcgtcaaagagatgctctctgacatgattagacggcgcaacctgatcctgaatagaggaggcgatgaaaaccctcggggccccgtgtcccgcgagcacgtggagtggtgtagagaatttgtcaaggggaaatacattatggccttcaatcctccctggggagacatcaacaagctcggccggagcgggattgcgctggttgccacaggacttgctaaactggccgagaccgaaggcaagggggtgtttgatgaggctaagaaaacggtggaagccctcaatggatatctggacaagcacaaagatgaggtcgacaaggcctctgctgacaacatgatcaccaaccttctgaaacatattgcgaaggcccaagagctctacaaaaattccagcgctctgcgcgcccagggcgcccagatcgatacagctttctcttcctactattggctgtacaaggccggcgtgacccctgaaacatttccgaccgttagccagttcctcttcgagctggggaagcaacccagaggaacgaaaaagatgaaaaaggcgcttctgtccacacctatgaagtggggcaaaaagctctatgaactgtttgctgacgattctttccagcagaaccggatctacatgcaccccgccgtgcttaccgccgggcgcattagcgagatgggagtctgctttggcacaatccctgtggctaatcccgacgatgccgctcaggggtccggacataccaaaagcattctgaacctcagaaccaatacagaaacgaacaatccgtgtgccaagaccatcgttaaactgttcgagattcaaaagacaggctttaacatccaggacatggatatcgtggcgtctgagcatctgctccaccagtccctggtcggcaagcaaagccctttccagaatgcctataacgtgaaagggaatgctacctctgccaacattatctga

SEQ ID NO: 7348 - RNA, 1449 nt, synthetic construct
  misc_feature 1..1449: note = derived and/or modified CDS sequence (opt5) from CCHFV(YL16070)__KY354080.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagaaaggccttgaatggtttgagaagaatgccgggaccatcaaatcttgggacgaaagctatacagagctgaaggttgaggtgccgaaaattgaacagctcgctgattaccagcaggccgcgctgaagtggcggaaggacatcggattccgcgtcaacgccaataccacagctctttcccacaaagtgctggccgagtataaggttcccggcgaaatcgtgatgagcgtcaaagagatgctctctgatatgattagacggcgcaacctgatcctgaatagagggggagacgaaaaccctcggggccccgtgtcccgcgagcacgtggagtggtgtagagaatttgtcaagggcaaatacattatggctttcaatcctccctggggagatatcaacaagagcgggcggtctggcattgccctcgttgcgaccgggctggccaaacttgctgagacggaaggaaagggcgtgtttgacgaggccaagaaaaccgtggaagctctgaatgggtatctcaacaagcacaaagatgaggtcgacaaggcctccgccgacagcatgatcacaaacctgcttaaacatattgctaaggcgcaagagctgtacaaaaattcttccgccctccgcgctcagggagcccagatcgataccgccttcagctcctactattggctgtacaaagctggcgtgacacctgaaacctttccgacggtttctcagttcctgttcgagctcggcaagcaacccagagggacaaagaagatgaaaaaggccctgcttagcacccctctgaagtggggaaaacggctctatgaactgtttgcggacgattccttccagcagaaccgcatctacatgcaccccgctgtgcttacagccggcagaattagcgagatgggggtctgctttggaaccatccctgtggccaatcccgacgatgctgcccagggctctgggcataccaagtccattctgaacctccggacaaatacggaaaccaacaatccgtgtgctaaaacaatcgttaagctgttcgagattcagaaaaccggatttaacatccaagacatggatatcgtggccagcgagcatctgctccaccagtctctggtcggcaagcaaagccctttccagaatgcgtataacgtgaagggcaatgccacatccgctaacattatctga

SEQ ID NO: 7349 - RNA, 1449 nt, synthetic construct
  misc_feature 1..1449: note = derived and/or modified CDS sequence (opt5) from CCHFV(66019)__AJ010648.1__N
  source 1..1449: mol_type = other RNA
atggagaacaagatcgaagtgaataacaaggacgagatgaatagatggttcgaagagtttaagaaaggcaacgggctggtcgataccttcacaaatagctactccttttgcgaatctgttcccaacctcgaccggttcgtgtttcagatggccagcgctacggatgacgcccaaaaggattccatttatgcgtctgctctggtggaggccaccaaattctgtgcccctatctacgagtgcgcttgggtcagctccacaggaattgtgaagaagggccttgaatggtttgagaaaaatgccgggaccatcaagtcttgggacgaaagctatacagagctgaaagttgaggtgccgaagattgaacagctcgcttcctaccagcaggccgcgctgaaatggcgcaaggatatcggattcagagtcaacgccaataccgctgcccttagccacaaggtgctggctgagtataaagttcccggcgaaatcgtgatgtctgtcaaggagatgctctccgacatgattcggcgcagaaacctgatcctgaatcgcgggggagatgaaaaccctcggggccccgtgagcagagagcatgtggagtggtgtcgggaatttgtcaaaggcaagtacattatggccttcaatcctccctggggagacatcaacaaatctgggcgctccggcattgcgctcgttgccacagggctggctaagctggccgagaccgaaggaaaaggcgtgtttgatgaggctaagaagacggtggaagccctgaatgggtatctcgacaaacacaaggatgaggtcgacaaagccagcgctgacaacatgaccacaaacctgcttaagcatatcgcgaaagcccaagagctgtacaaaaattcttccgctctcagagcccagggagcccagattgataccgctttcagctcctactattggctgtacaaggccggcgtgacacctgaaacctttccgacggtttctcagttcctgttcgagctcggcaaacaaccccgggggacaaagaaaatgaagaaagcgctgcttagcacccctatgaagtggggaaagaaactgtatgaactctttgctgacgattccttccagcagaaccgcatctacatgcaccccgccgtgctgacagccggcagaatcagcgagatgggggtctgctttggaaccattcctgtggctgaccccgatgacgccgctcagggctctgggcataccaagtccatccttaatctgcggacaaacacggaaaccaataacccgtgtgccaaaacaattgttaaactcttcgagatccaaaagaccggatttaatattcaggatatggacatcgtggcgagcgagcaccttctgcaccagtctctcgtcggcaagcaaagccctttccagaacgcctataatgtgaagggcaacgctacatccgccaatatcatttga

SEQ ID NO: 7350 - RNA, 1449 nt, synthetic construct
  misc_feature 1..1449: note = derived and/or modified CDS sequence (opt5) from CCHFV(8402)__AJ010649.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgagagattcgtgtttcagatggccagcgctacggacgatgcccaaaaagactccatttatgcgtctgctctggtggaggccaccaagttctgtgcccctatctacgaatgcgcttgggtcagctccacaggaattgtgaagaaaggccttgagtggtttgaaaagaatgccgggaccatcaaatcttgggatgagagctatacagagctgaaggttgaagtgccgaaaattgagcagctcgctaactaccagcaggccgcgctgaagtggcggaaggacatcggattccgcgtcaatgccaacaccgctgccctttcccacaaagtgctggctgaatataaggttcccggcgagatcgtgatgagcgtcaaagaaatgctctctgatatgattagacggcgcaatctgatcctgaacagagggggagacgagaatcctcggggccccgtgtcccgcgagcatgtggaatggtgtagagagtttgtcaagggcaaatacattatggccttcaaccctccctggggagatatcaataagagcgggcggtctggcattgcgctcgttgccacagggctggctaaacttgccgaaaccgagggaaagggcgtgtttgacgaagctaagaaaacggtggaggccctgaacgggtatctcgataagcacaaagacgaggtcgataaggcctccgctgacaacatgatcaccaatctgttcaaacatattgcgaaggcccaagaactttacaagaacctgagcgctctcggagcccagggcgcccagatcgacacagctttttcttcctactattggctgtacaaagccggcgtgacccctgagacattcccgaccgttagccagttcctgtttgaactcgggaagcaaccccgcggaacgaaaaagatgaaaaaggcgctgctttccacacctatgaagtggggcaaaaagctgtatgagctgttcgctgatgactcttttcagcagaatagaatctacatgcaccccgccgtgctgaccgccgggcggattagcgaaatgggagtctgcttcggcacaatccctgtggctaaccccgatgacgccgctcaggggtccggacataccaaaagcattcttaatctgcgcaccaacacagagacgaataacccgtgtgccaagaccatcgttaaactctttgagattcaaaagacaggcttcaatatccaggatatggacatcgtggcgtctgaacacctcctgcaccagtccctcgtcggcaagcaaagcccttttcagaacgcctataatgtgaaagggaacgctacctctgccaatattatctga

SEQ ID NO: 7351 - RNA, 1449 nt, synthetic construct
  misc_feature 1..1449: note = derived and/or modified CDS sequence (opt5) from CCHFV(Bul/HU517)__AY277676.2__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaaaattctggggccatcaagagctgggacgaaaactatgtggagctgaaagttgatgtgccgaagattgagcagctcgctaattaccagcaggccgcgctgaagtggagaaaagacatcggattccgggtcaacgccaataccgctgccctttccaacaaggtgctggctgaatataaagttcccggcgagatcgtgatgagcgtcaaggaaatgctctctgatatgattcgcagacggaatctgatcctgaaccgcgggtccgacgagaatcctagaggacccgtgagccacgaacacgtggagtggtgtcgggagtttgtcaaaggcaagtacattatggccttcaaccctccctggggcgatatcaacaaatctgggcgctccggaattgcgctcgttgccacaggcctggctaagctcgccgaaaccgaggggaagggagtgtttgacgaagctaaaaagacagtggaggccctgaatggctatctcgataaacacagagacgaagtcgacaaggccagcgctgattctatgatcaccaacctgcttaaacatattgcgaaggcccaagagctgtacaaaaattccagcgctctccgggcccagggggcccagatcgacacgcctttctcctctttttactggctgtataaagctggagtgaccccggagacattccccaccatcagccagttcctgtttgaactcggcaagcaacctcgcggcacaaagaagatgaaaaaggccctgctttccacccccatgaagtgggggaaaaagctgtacgagcttttcgcggatgacagctttcagcagaacagaatttatatgcaccctgctgttctgacggccggacggatctctgaaatgggcgtgtgcttcgggacaattcccgtcgccaatccggatgacgctgcccagggatccggccataccaaaagcatccttaacctgcgcacatctaccgagaccaataacccttgtgctaagacaattgtgaaactctttgaaatccaaaagacggggttcaatatccaggatatggacattgttgccagcgagcatctgctgcaccagtccctcgtgggaaagcaatctccctttcagaacgcgtacaatgtcaaaggcaacgccaccagcgctaatatcatttga

SEQ ID NO: 7352 - RNA, 1449 nt, synthetic construct
  misc_feature 1..1449: note = derived and/or modified CDS sequence (opt5) from CCHFV(V46/13)__KR011837.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaaaattctgggaccatcaagagctgggacgaaaactatgccgagctgaaagtggatgttccgaagattgagcagctcgctaattaccagcaggccgcgctgaagtggagaaaagacatcggattccgggtgaacgccaatacagctgccctttccaacaaggtcctggctgaatataaagtgcccggcgagatcgttatgagcgtgaaggaaatgctctctgatatgattcgcagacggaatctgatcctgaaccgcgggtccgacgagaatcctagaggacccgtcagccgggaacacgtggagtggtgtcgcgagtttgtgaaaggcaagtacattatggccttcaaccctccctggggcgatatcaacaaatctgggagatccggaattgcgctcgtcgccaccggcctggctaagctcgccgaaacagaggggaagggagtttttgacgaagctaaaaaggccgtggaggccctgaatggctatctcgataaacatcgggacgaagtggtcaaggctagcgcggactctatgatcaccaacctgcttaaacacattgccaaggctcaagagctgtacaaaaattccagcgccctccgcgcccagggggctcagatcgatacgcctttctcctctttttactggctgtataaagccggagtgaccccggagacattccccaccatcagccagttcctgtttgaactcggcaagcaacctagaggcacaaagaagatgaaaaaggcgctgctttccacccccatgaagtgggggaaaaagctgtacgagcttttcgctgacgatagctttcagcagaaccggatttatatgcatcctgccgttctgacggccggacgcatctctgaaatgggcgtgtgcttcgggacaattcccgtcgctaatccggacgatgccgctcagggatccggccacaccaaaagcatccttaacctgagaacatctaccgagaccaataacccttgtgccaagacaattgtgaaactctttgaaatccaaaagacggggttcaatatccaggacatggatattgttgcgagcgagcatctgctgcaccagtccctcgtgggaaagcaatctccctttcagaacgcctacaatgtcaaaggcaacgctaccagcgccaatatcatttga

SEQ ID NO: 7353 - RNA, 1449 nt, synthetic construct
  misc_feature 1..1449: note = derived and/or modified CDS sequence (opt5) from CCHFV(1231-CR/TI-2015)__KU161587.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaaaattctgggaccatcaagagctgggacgaaaactatgccgagctgaaagtggatgttccgaagattgagcagctcgctaattaccagcaggccgcgctgaagtggagaaaagacatcggattccgggtgaacgccaatacagctgccctttccaacaaggtcctggctgaatataaagtgcccggcgagatcgttatgagcgtgaaggaaatgctctctgatatgattcgcagacggaatctgatcctgaaccgcgggggagacgagaatcctagaggccccgtctcccgggaacacgtggagtggtgtcgcgagtttgtgaaaggcaagtacattatggccttcaaccctccctggggagatatcaacaaaagcggaagatctggcattgcgctcgtcgccaccgggctggctaagctcgccgaaacagagggaaagggcgtttttgacgaagctaaaaagaccgtggaggccctgaatgggtatctcgataaacatcgggacgaagtggacaaggcctccgctgatagcatgatcacgaacctgcttaaacacattgcgaaggcccaagagctgtacaaaaattcttccgctctccgcgcccagggagcccagatcgacacccctttcagctccttttactggctgtataaggctggcgtcacaccggagaccttccccacaatctctcagttcctgtttgaactcggcaagcaacctagagggaccaaaaagatgaaaaaggccctgcttagcacgcccatgaagtgggggaaaaagctgtacgagcttttcgcggatgactcctttcagcagaaccggatttatatgcatcctgctgtgctgacagccggccgcatcagcgaaatgggggtttgcttcggaaccattcccgtggccaatccggatgacgctgcccagggctctgggcacacaaaatccatccttaacctgagaaccagcaccgagacaaataacccttgtgctaagacgattgtcaaactctttgaaatccaaaagaccggattcaatatccaggatatggacattgtggcctctgagcatctgctgcaccagagcctcgttggcaagcaatccccctttcagaacgcgtacaatgtgaaaggcaacgccacatctgctaatatcatttga

SEQ ID NO: 7354 - RNA, 1449 nt, synthetic construct
  misc_feature 1..1449: note = derived and/or modified CDS sequence (opt5) from CCHFV(AP92)__U04958.1__N
  source 1..1449: mol_type = other RNA
atggagaacaagatcgaagtgaatagcaaagacgatctgaacaagtggttcgaggaatttaaaaagggcaatgggctcgtcgacaccttcacaaactcctactctttttgcgagaatgttcccaacctggatagattcgtgtatcagatggccagcgctacggacgatgcccaaaaagactccatttacgcgtctgctcttgtggaagccaccaagtattgtgcccctatctacgagtgcgcttgggtcagctccacaggaattgtgaagaaaggcctggagtggtttgaaaagaatacctctacaatcaaaagctgggatgagtcctataccgaactcaaggttgacattccgaaaatcgagcagctgagctcttaccagcaggccgctcttaagtggcggaaggatatcgggttccgcattaacgccaatacaaccgcgctgtccaacaaagtgctcgccgagtataaggtccccggagaaatcctggtgcctgttaaagagatgctgagcgacatgattagacggcgcaatatcattctcaacagaggctctgatgaaaatccccgggggcctgtgtcccacgagcatatcgaatggtgtcgcgagtttattaagggaaaatacatcatggctttcaatcccccttggggcgacatcaacaagagcggcagatctgggattgccctggtcgctacgggacttgccaaactggcggagaccgaaggcaagggggtgtttgaggaagccaagaaaacagtggaggctctcaaggattacctggacaaacaccgggacgaagtcgataagacctccgccgacaacatggttacaagccttctgaaacatatcgctaaggcccaagagctctataagaactcctctgccctgcgcgctcagggagcgcagattgataccccgttcagctccttttactggctgtataaagccggcgtgacgcccgagacattccctaccgtgagccagtttctcttcgaactggggaagcaacccagaggaaccaaaaagatgaaaaaggctctcctgtctacacctatgaagtggggcaaaaagcactacgagcttttcgccgacgattcctttcagcagaatcggatctatatgcatcccgccgtcctgaccgctggccgcattagcgaaatgggggtgtgcttcggaacaatcccggttgccaaccctgacgatgcggctcagggctctgggcacacgaaaagcatccttaatctgagaaccaacacagagtccaataacccctgtgcccggaccattgtgaagctctttgaaatccagaaaacaggattcgacattaaggatatggacatcgtcgcctctgagcatctgctgcaccaaagcctcgtgggcaagcagtccccttttcaaaatgcttacaacgttaaagggaatgccaccagcgctaacattatctga

SEQ ID NO: 7355 - RNA, 1449 nt, synthetic construct
  misc_feature 1..1449: note = derived and/or modified CDS sequence (opt5) from CCHFV(C68031)__M86625.1__N
  source 1..1449: mol_type = other RNA
atggagaacaagatcgaagtgaataacaaagacgagatgaataagtggttcgaagagtttaaaaagggcaacgggctggtcgataccttcacaaatccctacagcttttgcgaatccgttcctaacctcgagagattcgtgtttcagatggcctctgctacggacgatgcccaaaaagacagcatttatgcgtccgctctggtggaggccaccaagttctgtgccccgatctacgaatgcgcttgggtctctagcacaggaattgtgaagaaaggccttgagtggtttgaaaagaatgccgggaccatcaaatcctgggatgagtcttatattgagctgaaggttgaagtgcccaaaatcgagcagctcgctaactaccagcaggccgcgctgaagtggcggaaggacatcggattccgcgtcaatgccaacacagctgcccttagccacaaagtgctggctgaatataaggttcctggcgagattgtgatgtccgtcaaagaaatgctcagcgatatgatcagacggcgcaatctgattctgaacagagggggagacgagaatccccggggccctgtgtctcgcgagcacgtggaatggtgtagagagtttgtcaagggcaaatacatcatggccttcaatcccccttggggagatattaacaagtccggacggagcggcatcgcgctcgttgccaccgggctggctaaacttgccgaaacagagggaaagggcgtgtttgacgaagctaagaaaaccgtggaggccctgaacgggtatctcgataagcacaaagacgaggtcgataaggcctctgctgacaacatgattacgaatctgcttaaacatatcgcgaaggcccaagaactgtacaagaactccagcgctctccgcgcccagggagcccagatcgacaccgctttctcttcctactattggctgtacaaagccggcgtgacaccggagacctttcccacagttagccagttcctgttcgaactcggcaagcaacctagagggaccaaaaagatgaaaaaggcgctgctttccacgcccatgaagtgggggaaaaagctgtatgagctctttgctgatgactctttccagcagaatcggatttacatgcaccctgccgtgctgacagccggccgcatcagcgaaatgggggtctgctttggaaccattcccgtggctaacccggatgacgccgctcagggctccgggcatacaaaaagcatccttaatctgagaaccaacaccgagacaaataacccttgtgccaagacgattgttaaactcttcgagatccaaaagaccggatttaatatccaggatatggacattgtggcgtctgaacatctgctgcaccagtccctcgtcggcaagcaaagccccttccagaacgcctataatgtgaaaggcaacgctacatctgccaatatcatttga

SEQ ID NO: 7356 - RNA, 1449 nt, synthetic construct
  misc_feature 1..1449: note = derived and/or modified CDS sequence (opt5) from CCHFV(1-CR/HU-2015)__KU161586.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttatcagatggccagcgctacggatgacgcccaaaaggattccatttacgcgtctgctctggtggaggccaccaagttttgtgcccctatctatgagtgcgcttgggtgagctccacaggaattgtcaaaaagggccttgaatggttcgagaaaaattctgggaccatcaagagctgggacgaaaactacgccgagctgaaagtggatgttccgaagattgagcagctcgctaattatcagcaggccgcgctgaagtggagaaaagacatcggatttcgggtgaacgccaatacagctgccctttccaacaaggtcctggctgaatacaaagtgcccggcgagatcgttatgagcgtgaaggaaatgctctctgatatgattcgcagacggaatctgatcctgaaccgcgggggagacgagaatcctagaggccccgtctcccgggaacacgtggagtggtgtcgcgagttcgtgaaaggcaagtatattatggcctttaaccctccctggggagatatcaacaaaagcggaagatctggcattgcgctcgtcgccaccgggctggctaaacttgccgaaacagagggaaagggcgttttcgacgaagctaagaagaccgtggaggccctgaatgggtacctcgataaacatcgggacgaagtggacaaggcctccgctgatagcatgacgaccaacctgcttaaacacatcgcgaaggcccaagagctgtacaaaaattcttccgctctccgcgcccagggagcccagattgacacaccttttagctccttctattggctgtacaaggctggcgtcaccccggagacatttcccaccatctctcagttcctgttcgaactcggcaagcaacctagagggacgaaaaagatgaaaaaggccctgcttagcacacccatgaagtgggggaaaaagctgtatgagctctttgcggatgactccttccagcagaaccggatctacatgcatcctgctgtgctgaccgccggccgcattagcgaaatgggggtttgctttggaacaatccccgtggccaatccggatgacgctgcccagggctctgggcacaccaaatccattcttaacctgagaaccagcacagagacgaataacccttgtgctaagaccatcgtcaaactcttcgaaattcaaaagacaggatttaatatccaggatatggacatcgtggcctctgagcatctgctgcaccagagcctcgttggcaagcaatcccccttccagaacgcgtataatgtgaaaggcaacgccacctctgctaatattatctga

SEQ ID NO: 7357 - RNA, 1449 nt, synthetic construct
  misc_feature 1..1449: note = derived and/or modified CDS sequence (opt5) from CCHFV(36-ST-2014)__KR814838.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaaaataccgggacaatcaagtcttgggacgataactatgccgaactgaaagtggacgttccgaagattgagcagctcgctaattaccagcaggccgcgctgaagtggagaaaagatatcggattccgggtgaacgccaataccgctgcccttagcaacaaggtcctggctgagtataaagtgcccggcgaaatcgttatgtccgtgaaggagatgctcagcgacatgattcgcagacggaatctgatcctgaaccgcgggggagatggcaatcctagaggccccgtctctcacgaacatgtggagtggtgtcgggaatttgtgaaagggaagtacattatggccttcaaccctccctggggagacatcaacaaatccggccgcagcgggattgcgctcgtcgccacaggactggctaaacttgccgagaccgagggcaagggggtttttgatgaagctaaaagaacggtggaggccctgaatggatatctcgacaagcaccgggacgaagtggataaagcctctgctgactccatgatcaccaacctgcttaagcatattgcgaaagcccaagagctgtacaagaatagctctgctctccgcgcccagggcgcccagatcgatacacctttctccagcttttactggctgtataaggctggcgtcaccccggaaacattccccaccatctcccagttcctgtttgagctcgggaaacaacctagaggaacgaagaaaatgaagaaagccctgctttctacacccatgaagtggggcaagaaactgtacgagctgttcgcggacgatagctttcagcagaaccggatttatatgcaccctgctgtgctgaccgccgggcgcatctccgaaatgggagtttgcttcggcacaattcccgtggccaatccggacgatgctgcccaggggagcggacataccaagtctatccttaacctgagaacctccacagagacgaataacccttgtgctaaaaccattgtcaagctctttgaaatccaaaagacaggcttcaatatccaggacatggatattgtggccagcgagcacctcctgcaccagtctctcgttggcaagcaaagcccctttcagaacgcgtacaatgtgaaggggaacgccacctccgctaatatcatttga

SEQ ID NO: 7358 - RNA, 1449 nt, synthetic construct
  misc_feature 1..1449: note = derived and/or modified CDS sequence (opt5) from CCHFV(37-ST-2009)__KR814835.1__N
  source 1..1449: mol_type = other RNA
atggagaacaagatcgtggtcaatagcaaagacgaaatgaacaagtggttcgaggaatttaaaaaggttaatggcctggtggataccttcacaaactcctactctttttgcgagaatgtgcccaacctcgacaaattcgtctttcagatggccagcgctacggatgacgcccaaaaggattccatttatgcgtctgctctggtggaagccaccaagttctgtgcccctatctacgagtgcgcttgggttagctccacagggattgtgaaaaagggacttgagtggtttgaaaagaatgccggcaccatcaagtcttgggacgagagctatacagaactgaaagtcgatgtgccgaagattgagcagctcgcttcctaccagcaggccgcgctgaagtggagaaaagacatcgggttccgggttaacgccaataccgctgcccttagctctaaggtgctgtccgagtataaagtccccggagaagtggtgatgcctgtcaaggagatgctcagcgatatgatccgcagacggaacctgattctgaatcgcggctctgacgaaaaccccagagggcctgtttcccgggagcacgtggaatggtgtcgcgagtttgtgaaaggaaagtacatcatggctttcaatcccccttggggcgatattaacaaaagcggcagatctgggatcgccctcgtcgcgacaggactggccaaacttgctgagaccgaaggcaaggggatttttgaggaagcccggaaaacggtggacgctctgaaggattatctcgaccgccataaagaggaagttgacaagaccaatgccgataacatggtgacaaacctgttcaaacacatcgccaaggctcaagagctttacaaaaattccagcgcgctgagagcccagggagctcagattgacaccccgttttcctctttctactggctctataaggccggcgtcacacccgagaccttccctacggtgagccagtttctgttcgaactggggaagcaaccccggggaacacgcaaaatgaagaaagccctcctgtccacccctatgaagtggggcaagaaactttacgagctgtttgctgatgacagcttccagcagaacagaatctatatgcatcccgccgttctcacagcgggccgggtgtctgaaatgggggtctgctttggaaccatcccggtggataatcctgacgatgctgcccagggctccgggcacaccaagagcattctgaaccttcgcacatctgccgagacgaataacccctgtgctagaaccatcgtcaaactgttcgaaattcaaaaggccggatttaatatccaggagatggacattgtggctagcgagcatctcctgcaccagtccctggttggcaaacaatctcctttccagaacgcctacaatgtgaaggggaacgcgacaagcgccaatatcatctga

SEQ ID NO: 7359 - RNA, 1449 nt, synthetic construct
  misc_feature 1..1449: note = derived and/or modified CDS sequence (opt5) from CCHFV(59-TK-2012)__KR814833.1__N
  source 1..1449: mol_type = other RNA
atggagaacaagatcgtggtcaatagcaaagacgaaatgaacaagtggttcgaggaatttaaaaaggttaatggcctggtggataccttcacaaactcctactctttttgcgagaatgtgcccaacctcgacaaattcgtctttcagatggccagcgctacggatgacgcccaaaaggattccatttatgcgtctgctctggtggaagccaccaagttctgtgcccctatctacgagtgcgcttgggttagctccacagggattgtgaaaaagggacttgagtggtttgaaaagaataccggcacaatcaagtcttgggacgagagctataccgaactgaaagtcgatgtgccgaagattgagcagctcgcctcctaccagcaggctgccctgaagtggagaaaagacatcgggttccgggttaacgcgaatacagccgctcttagctctaaggtgctgtccgagtataaagtccccggagaaatcgtgatgcctgtgaaggagatgctcagcgatatgattcgcagacggaacctgatcctgaatcgcggctctgacgaaaaccccagagggcctgtctcccgggagcacgttgaatggtgtcgcgagtttgtgaaaggaaagtacattatggccttcaatcccccttggggcgatatcaacaaaagcggcagatctgggattgctctcgtggccaccggactggcgaaacttgccgagacggaaggcaaggggatctttgaggaagctcggaaaaccgtcgacgccctgaaggattatctcgaccgccataaagaggaagtggacaagacaaatgctgataacatggttaccaacctgttcaaacacattgccaaggcccaagagctttacaaaaattccagcgctctgagagcgcagggagcccagatcgacacaccgttttcctctttctactggctctataaggctggcgtgacccccgagacgttccctacagtcagccagtttctgttcgaactggggaagcaaccccggggaacccgcaaaatgaagaaagccctcctgtccacacctatgaagtggggcaagaaactttacgagctgtttgccgatgacagcttccagcagaacagaatctatatgcatcccgctgtgctcaccgccggccggatttctgaaatgggggtttgctttggaaccatcccggtggataatcctgacgatgcggctcagggctccgggcacacaaagagcattctgaaccttcgcacgtctgccgagaccaataacccctgtgccaaaacaatcgtcaagctgttcgaaattcaaaaagctggatttaatatccaggagatggacatcgtggccagcgagcatctcctgcaccagtccctggtcggcaagcaatctcctttccagaacgcttacaatgtgaaggggaacgccaccagcgcgaatattatctga

SEQ ID NO: 7360 - RNA, 1449 nt, synthetic construct
  misc_feature 1..1449: note = derived and/or modified CDS sequence (opt5) from CCHFV(73-ST-2013)__KR814836.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggccagcgctacggatgacgcccaaaaggattccatttatgcgtctgctctggtggaggccaccaagttctgtgcccctatctacgagtgcgcttgggtcagctccacaggaattgtgaaaaagggccttgaatggtttgagaaaaatgccgggaccatcaagtcttgggacgaaagctatacagagctgaaagttgatgtgccgaagattgagcagctcgctaactaccagcaggccgcgctgaagtggagaaaagacatcggattccgggtcaatgccaacaccgctgccctttccaataaggtgctggctgaatataaagttcccggcgagatcgtgatgagcgtcaaggaaatgctctctgatatgattcgcagacggaaccaaatcctgaatcgcgggggagacgagaaccctagaggccccgtgtcccgggaacacgtggattggtgtcgcgagtttgtcaaaggcaagtacattatggccttcaatcctccctggggagacatcaacaaaagcgggagatctggcattgcgctggttgccacagggctcgctaagctggccgagaccgaaggaaagggcgtgtttgatgaggctaaaaagacggtggaagcccttaacgggtatctggacaaacataaggacgaggtcgatcgggcctccgctgacagcatgatcaccaatctcctgaaacacattgcgaaggcccaggaactttacaagaactcttccgctctgcgcgcccagggagcccagatcgatacagctttcagctcctactattggctctacaaagccggcgtgacccctgagacatttccgaccgtttctcaattcctgttcgagctgggcaagcagcccagagggacgaaaaagatgaaaaaggcgctcctgagcacacctatgaagtggggaaagaaactttatgaactgtttgctgacgattccttccagcagaatcggatctacatgcatcccgccgtgctcaccgccggccgcattagcgagatgggggtctgctttggaacaatccctgtggctaaccccgacgatgccgctcaaggctctgggcacaccaaatccattctgaatcttagaaccaacacagaaacgaataacccgtgtgcccggaccatcgttaagctgttcgagattcagaaaacaggatttaatatccaggacatggatatcgtggcgagcgaacatctcctgcaccaatctctggtcggcaagcagagccctttccagaacgcctataatgtgaagggcaacgctacctccgccaatattatctga

SEQ ID NO: 7361 - RNA, 1449 nt, synthetic construct
  misc_feature 1..1449: note = derived and/or modified CDS sequence (opt5) from CCHFV(75-ST-2010)__KR814845.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaaaattctgggaccatcaagagctgggacgaaaactatgccgagctgaaagtggatgttccgaagattgagcagctcgctaattaccagcaggccgcgctgaagtggagaaaagacatcggattccgggtgaacgccaatacagctgccctttccaacaaggtcctggctgaatataaagtgcccggcgagatcgttatgagcgtgaaggaaatgctctctgatatgattcgcagacggaatctgatcctgaaccgcgggtccgacgagaatcctagaggacccgtcagccgggaacacgtggagtggtgtcgcgagtttgtgaaaggcaagtacattatggccttcaaccctccctggggcgatatcaacaaatctgggagatccggaattgcgctcgtcgccaccggcctggctaagctcgccgaaacagaggggaagggagtttttgacgaagctaaaaagaccgtggaggccctgaatggctatctcgataaacatcgggacgaagtggacaaggccagcgctgattctatgatcacgaacctgcttaaacacattgcgaaggcccaagagctgtacaaaaattccagcgctctccgcgcccagggggcccagatcgacacccctttctcctctttttactggctgtataaggctggagtcacaccggagaccttccccacaatcagccagttcctgtttgaactcggcaagcaacctagaggcaccaaaaagatgaaaaaggccctgctttccacgcccatgaagtgggggaaaaagctgtacgagcttttcgcggatgacagctttcagcagaaccggatttatatgcatcctgctgtgctgacagccggacgcatctctgaaatgggcgtttgcttcgggaccattcccgtggccaatccggatgacgctgcccagggatccggccacacaaaaagcatccttaacctgagaacctctaccgagacaaataacccttgtgctaagacgattgtcaaactctttgaaatccaaaagaccgggttcaatatccaggatatggacattgtggccagcgagcatctgctgcaccagtccctcgttggaaagcaatctccctttcagaacgcgtacaatgtgaaaggcaacgccacaagcgctaatatcatttga

SEQ ID NO: 7362 - RNA, 1449 nt, synthetic construct
  misc_feature 1..1449: note = derived and/or modified CDS sequence (opt5) from CCHFV(CHH)__KU707898.1__N
  source 1..1449: mol_type = other RNA
atggagaacaagatcgaagtgaatagcaaagacgagatgaacaagtggttcgaagagtttaaaaagggcaatgggctggtcgataccttcacaaactcctactctttttgcgaaagcgttcccaatctcgacagattcgtgtttcagatggcctccgctacggatgacgcccaaaaagattctatttatgcgagcgctctggtggaggccaccaagttctgtgcccctatctacgagtgcgcttgggcctcctctacaggaattgtcaagaaaggccttgaatggtttgagaagaacgctgggaccatcaaaagctgggacgaatcctatacagagctgaaggtggaggttccgaaaattgaacagctcagcaattaccagcaggccgcgctgaagtggcggaaggatatcggattccgcgtgaacgccaataccgctgccctttctaacaaagtcctggctgagtataaggtgcccggcgaaatcgttatgtccgtgaaagagatgctcagcgacatgattagacggcgcaatctgatcctgaacagagggggagatgaaaatcctcggggccccgtctctcgcgagcacgtggagtggtgtagagaatttgtgaagggcaaatacattatggccttcaaccctccctggggagacatcaataagtccggacggagcggcattgcgctcgtcgccacagggctggctaaacttgccgagaccgaaggaaagggcgtttttgatgaggctaagaaaacggtggaagccctgaacgggtatctcgacaagcataaagatgaggtggacaaggcctctgctgactccatgatcaccaacctgcttaaacacattgcgaaggcccaagagctgtacaagaatagctccgctctccgcgcccagggagcccagatcgatacagtcttctctagctactattggctgtacaaagctggcgtgacccctgacacatttccgaccgtttcccagttcctgttcgaactcggcaagcaacccagagggacgaaaaagatgaaaaaggccctgcttagcacacctatgaagtgggggaaaaagctgtatgagctctttgcggatgactctttccagcagaaccggatctacatgcatcccgctgtgctgaccgccggccgcatttccgaaatgggggtctgctttggaacaatccctgtggccaatcccgatgacgctgcccttggcagcgggcacaccaaatctattctgaacctcagaaccaatacagagacgaacaatccgtgtgctaagaccatcgttaaactgttcgaaattcagaagacaggatttaacatccaagatatggacatcgtggccagcgagcatctgctccaccagtccctggtcggcaagcagtctcctttccaaaatgcgtataacgtgaaaggcaatgccaccagcgctaacattatctga

SEQ ID NO: 7363 - RNA, 1449 nt, synthetic construct
  misc_feature 1..1449: note = derived and/or modified CDS sequence (opt5) from CCHFV(CJH)__KU707899.1__N
  source 1..1449: mol_type = other RNA
atggagaacaagatcgaagtgaaaaataagcacgagaaaaacaagtggttcgaagagtttaaaaagggcaatgggctggtcgacaccttcacaaacagctactccttttgcgaaaatgttcccaacctcgatagattcgtgtttcagatggccggagctacggacgatgcccaaaaggactctatttatgcgagcgctctggtggaggccaccaaattctgtgcccctatctacgagtgcgcttgggcctcctctacaggcattgtcaagaaagggcttgaatggtttgagaagaatgctggaaccatcaaaagctgggatgaatcctatacagagctgaaggtggaggttccgaagattgaacagctctctaactaccagcaggccgcgctgaaatggcggaaggacatcggcttccgcgggaatgccaacaccgctgcccttagcaataaagtgctggctgagtataaggtccccggagaaatcgtgatgtccgttaaagagatgctcagcgatatgattagacggcgcaacctgatcctgaatagaggcggcgacgaaaaccctcgggggcccgtgtctcgcgagcatgtcgagtggtgtagagaatttgtgaagggaaaatacattatggccttcaatcctccctggggcgatatcaacaagtccgggcggagcggaattgcgctcgtggccacaggcctggctaagctggccgagaccgaagggaaaggagtctttgacgaggctaagaaaacggttgaagccctgaacggctatctcgataagcacaaagacgaggtggataaggcctctgctgactccatgatcaccaatctgcttaagcatattgcgaaagcccaagagctgtacaagaacagctctgctctccgcgcccagggcgcccagatcgacacagtgttctccagctactattggctgtacaaagctggggtcacccctgaaacatttccgaccgtgtcccagttcctgttcgagctcggaaagcaacccagaggcacgaaaaagatgaagaaagccctgctttctacacctatgaagtgggggaaaaagctgtatgaactctttgcggatgacagcttccagcagaatcggatctacatgcaccccgctgttctgaccgccggacgcatttccgagatgggcgtgtgctttgggacaatccctgtcgccaaccccgatgacgctgcccttggaagcggccataccaaatctattctgaatctcagaaccaacacagaaacgaataacccgtgtgctaagaccatcgtgaagctgttcgagattcagaaaacaggctttaatatccaagatatggacatcgttgcctccgagcaccttctccaccagagcctggtggggaagcagtctcctttccaaaacgcgtataatgtcaaaggaaacgccaccagcgctaatattatctga

SEQ ID NO: 7364 - RNA, 1449 nt, synthetic construct
  misc_feature 1..1449: note = derived and/or modified CDS sequence (opt5) from CCHFV(CLT/TI05146)__DQ227496.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagaaaggccttgaatggtttgagaagaatgccgggaccatcaaatcttgggacgaaagctatacagagctgaaggttgaggtgccgaaaattgaacagctcgctgattaccagcaggccgcgctgaagtggcggaaggacatcggattccgcgtcaacgccaataccacagctctttcccacaaagtgctggccgagtataaggttcccggcgaaatcgtgatgagcgtcaaagagatgctctctgatatgattagacggcgcaacctgatcctgaatagagggggagacgaaaaccctcggggccccgtgtcccgcgagcacgtggagtggtgtagagaatttgtcaagggcaaatacattatggctttcaatcctccctggggagatatcaacaagagcggacggtctggcattgccctcgttgcgaccgggctggccaaacttgctgagacggaaggaaagggcgtgtttgacgaggccaagaaaaccgtggaagctctgaatgggtatctcaacaagcacaaagatgaggtcgacaaggcctccgccgacagcatgatcacaaacctgcttaaacatattgctaaggcgcaagagctgtacaaaaattcttccgccctccgcgctcagggagcccagatcgataccgccttcagctcctactattggctgtacaaagctggcgtgacacctgaaacctttccgacggtttctcagttcctgttcgagctcggcaagcaacccagagggacaaagaagatgaaaaaggccctgcttagcacccctctgaagtgggggaaaaagctctatgaactgtttgcggacgattccttccagcagaaccggatctacatgcaccccgctgtgcttacagccggccgcattagcgagatgggggtctgctttggaaccatccctgtggccaatcccgacgatgctgcccagggctctgggcataccaaatccattctgaacctcagaacaaatacggaaaccaacaatccgtgtgctaagacaatcgttaaactgttcgagattcaaaagaccggatttaacatccaggacatggatatcgtggccagcgagcatctgctccaccagtctctggtcggcaagcaaagccctttccagaatgcgtataacgtgaaaggcaatgccacatccgctaacattatctga

SEQ ID NO: 7365 - RNA, 1449 nt, synthetic construct
  misc_feature 1..1449: note = derived and/or modified CDS sequence (opt5) from CCHFV(CYT/TI05099)__DQ227495.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagaaaggccttgaatggtttgagaagaatgccgggaccatcaaatcttgggacgaaagctatacagagctgaaggttgaggtgccgaaaattgaacagctcgctgattaccagcaggccgcgctgaagtggcggaaggacatcggattccgcgtcaacgccaataccacagctctttcccacaaagtgctggccgagtataaggttcccggcgaaatcgtgatgagcgtcaaagagatgctctctgatatgattagacggcgcaacctgatcctgaatagagggggagacgaaaaccctcggggccccgtgtcccgcgagcacgtggagtggtgtagagaatttgtcaagggcaaatacattatggctttcaatcctccctggggagatatcaacaagagcggacggtctggcattgccctcgttgcgaccgggctggccaaacttgctgagacggaaggaaagggcgtgtttgacgaggccaagaaaaccgtggaagctctgaatgggtatctcaacaagcacaaagatgaggtcgacaaggcctccgccgacagcatgatcacaaacctgcttaaacatattgctaaggcgcaagagctgtacaaaaattcttccgccctccgcgctcagggagcccagatcgataccgccttcagctcctactattggctgtacaaagctggcgtgacacctgaaacctttccgacggtttctcagttcctgttcgagctcggcaagcaacccagagggacaaagaagatgaaaaaggccctgcttagcacccctctgaagtgggggaaaaagctctatgaactgtttgcggacgattccttccagcagaaccggatctacatgcaccccgctgtgcttacagccggccgcattagcgagatgggggtctgctttggaaccatccctgtggccaatcccgacgatgctgcccagggctctgggcataccaaatccattccgaacctgagaacaaatacggaaaccaacaatccttgtgctaagacaatcgttaaactcttcgagattcaaaagaccggatttaacatccaggacatggatatcgtggccagcgagcatctgctgcaccagtctctcgtcggcaagcaaagccccttccagaatgcgtataacgtgaaaggcaatgccacatccgctaacattatctga

SEQ ID NO: 7366 - RNA, 1449 nt, synthetic construct
  misc_feature 1..1449: note = derived and/or modified CDS sequence (opt5) from CCHFV(Dubai 616)__JN108025.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccggagctacggatgacgcccaaaaagatagcatttatgcgtccgctctggtggaggccaccaagttctgtgcccctatctacgagtgcgcttgggtctctagcacaggcattgtgaagaaagggcttgaatggtttgagaagaatgccggaaccatcaaatcctgggacgaatcttatacagagctgaaggttgaggtgccgaaaattgaacagctcgctaactaccagcaggccgcgctgaagtggcggaaggatatcggcttccgcgtcaatgccaacaccgctgcccttagccacaaagtgctggctgagtataaggttcccggggaaatcgtgatgtccgtcaaagagatgctcagcgacatgattagacggcgcaatctgatcctgaacagaggaggcgatgaaaatcctcggggccccgtgtctcgcgagcacgtggagtggtgtagagaatttgtcaaggggaaatacattatggccttcaaccctccctggggagacatcaataagtccggccggagcgggattgcgctcgttgccacaggactggctaaacttgccgagaccgaaggcaagggggtgtttgatgaggctaagaaaacggtggaagccctgaacggatatctcgacaagcacaaagatgaggtcgacaaggcctctgctgacaacatgatcaccaatctgcttaaacatattgcgaaggcccaagagctgtacaagaactccagcgctctccgcgcccagggcgcccagatcgatacagctttctcttcctactattggctgtacaaagccggcgtgacccctgaaacatttccgaccgttagccagttcctgttcgagctcgggaagcaacccagaggaacgaaaaagatgaaaaaggcgctgctttccacacctatgaagtggggcaaaaagctgtatgaactctttgctgacgattctttccagcagaatcggatctacatgcaccccgccgtgctgaccgccgggcgcattagcgagatgggagtctgctttggcacaatccctgtggctaaccccgacgatgccgctcaggggtccggacataccaaaagcattcttaatctgagaaccaacacagaaacgaataacccgtgtgccaagaccatcgttaaactcttcgagattcaaaagacaggctttaatatccaggacatggatatcgtggcgtctgagcatctgctgcaccagtccctcgtcggcaagcaaagccctttccagaacgcctataatgtgaaagggaacgctacctctgccaatattatctga

SEQ ID NO: 7367 - RNA, 1449 nt, synthetic construct
  misc_feature 1..1449: note = derived and/or modified CDS sequence (opt5) from CCHFV(GRH)__KU707900.1__N
  source 1..1449: mol_type = other RNA
atggagaacaagatcgaagtgaatagcaaagacgagatgaacaagtggttcgaagagtttaaaaagggcaatgggctggtcgataccttcacaaactcctactctttttgcgaaagcgttcccaatctcgacagattcgtgtttcagatggcctccgctacggatgacgcccaaaaagattctatttatgcgagcgctctggtggaggccaccaagttctgtgcccctatctacgagtgcgcttgggcctcctctacaggaattgtcaagaaaggccttgaatggtttgagaagaacgctgggaccatcaaaagctgggacgaatcctatacagagctgaaggtggaggttccgaaaattgaacagctcagcaattaccagcaggccgcgctgaagtggcggaaggatatcggattccgcgtgaacgccaataccgctgccctttctaacaaagtcctggctgagtataaggtgcccggcgaaatcgttatgtccgtgaaagagatgctcagcgacatgattagacggcgcaatctgatcctgaacagagggggagatgaaaatcctcggggccccgtctctcgcgagcacgtggagtggtgtagagaatttgtgaagggcatgtacattatggccttcaaccctccctggggagacatcaataaatccgggcggagcggcattgcgctcgtcgccacagggctggctaaacttgccgagaccgaaggaaagggcgtttttgatgaggctaagaagacggtggaagccctgaacgggtatctcgacaaacataaggatgaggtggacaaagcctctgctgactccatgatcaccaacctgcttaagcacattgcgaaagcccaagagctgtacaagaatagctccgctctccgcgcccagggagcccagatcgatacagtcttctctagctactattggctgtacaaggctggcgtgacccctgacacatttccgaccgtttcccagttcctgttcgaactcggcaaacaacccagagggacgaagaaaatgaagaaagccctgcttagcacacctatgaagtggggaaagaaactgtatgagctctttgcggatgactctttccagcagaaccggatctacatgcatcccgctgtgctgaccgccggccgcatttccgaaatgggggtctgctttggaacaatccctgtggccaatcccgatgacgctgcccttggcagcgggcacaccaagtctattctgaacctcagaaccaatacagagacgaacaatccgtgtgctaaaaccatcgttaagctgttcgaaattcagaaaacaggatttaacatccaagatatggacatcgtggccagcgagcatctgctccaccagtccctggtcggcaagcagtctcctttccaaaatgcgtataacgtgaagggcaatgccaccagcgctaacattatctga

SEQ ID NO: 7368 - RNA, 1449 nt, synthetic construct
  misc_feature 1..1449: note = derived and/or modified CDS sequence (opt5) from CCHFV(Iran-Gilan69)__KJ027521.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaaaattctgggaccatcaagagctgggacgaaaactatgccgagctgaaagtggatgttccgaagattgagcagctcgcttcctaccagcaggccgcgctgaagtggagaaaagacatcggattccgggtgaatgccaacacagctgcccttagcaataaggtcctggctgaatataaagtgcccggcgagatcgttatgtctgtgaaggaaatgctctccgatatgattcgcagacggaacctgatcctgaatcgcgggggagacgagaaccctagaggccccgtcagccgggaacacgtggagtggtgtcgcgagtttgtgaaaggcaagtacattatggccttcaatcctccctggggagatatcaacaaatctggaagatccggcattgcgctcgtcgccaccgggctggctaagctcgccgaaacagagggaaagggcgtttttgacgaagctaaaaagaccgtggaggccctgaacgggtatctcgataaacatcgggacgaagtggacaaggccagcgctgattctatgatcacgaatctgcttaaacacattgcgaaggcccaagagctgtacaagaactccagcgctctccgcgcccagggagcccagatcgacacccctttctcctctttttactggctgtataaagctggcgtcacaccggagaccttccccacaatcagccagttcctgtttgaactcggcaagcaacctagagggaccaaaaagatgaaaaaggccctgctttccacgcccatgaagtgggggaaaaagctgtacgagcttttcgcggatgacagctttcagcagaatcggatttatatgcatcctgctgtgctgacagccggccgcatctctgaaatgggggtttgcttcggaaccattcccgtggccaacccggatgacgctgcccagggctccgggcacacaaaaagcatccttaatctgagaacctctaccgagacaaacaatccttgtgctaagacgattgtcaaactctttgaaatccaaaagaccggattcaacatccaggatatggacattgtggccagcgagcatctgctgcaccagtccctcgttggcaagcaatctccctttcagaatgcgtacaacgtgaaaggcaatgccacaagcgctaacatcatttga

SEQ ID NO: 7369 - RNA, 1449 nt, synthetic construct
  misc_feature 1..1449: note = derived and/or modified CDS sequence (opt5) from CCHFV(Iran-Isfahan78)__KJ027522.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaaaattctgggaccatcaagagctgggacgaaaactatgccgagctgaaagtggatgttccgaagattgagcagctcgctaattaccagcaggccgcgctgaagtggagaaaagacatcggattccgggtgaacgccaatacagctgccctttccaacaaggtcctggctgaatataaagtgcccggcgagatcgttatgagcgtgaaggaaatgctctctgatatgattcgcagacggaatctgatcctgaaccgcgggggagacgagaatcctagaggccccgtctcccgggaacacgtggagtggtgtcgcgagtttgtgaaaggcaagtacattatggccttcaaccctccctggggagatatcaacaaaagcggaagatctggcattgcgctcgtcgccaccgggctggctaagctcgccgaaacagagggaaagggcgtttttgacgaagctaaaaagaccgtggaggccctgaatgggtatctcgataaacatcgggacgaagtggacaaggcctccgctgatagcatgatcacgaacctgcttaaacacattgcgaaggcccaagagctgtacaaaaattcttccgctctccgcgcccagggagcccagatcgacacccctttcagctccttttactggctgtataaggctggcgtcacaccggagaccttccccacagtgtctcagttcctgtttgaactcggcaagcaacctagagggaccaaaaagatgaaaaaggccctgcttagcacgcccatgaagtgggggaaaaagctgtacgagcttttcgcggatgactcctttcagcagaaccggatctatatgcatcctgctgttctgacagccggccgcattagcgaaatgggggtgtgcttcggaaccatccccgtcgccaatccggatgacgctgcccagggctctgggcacacaaaatccattcttaacctgagaaccagcaccgagacaaataacccttgtgctaagacgatcgtgaaactctttgaaattcaaaagaccggattcaatatccaggatatggacatcgttgcctctgagcatctgctgcaccagagcctcgtgggcaagcaatccccctttcagaacgcgtacaatgtcaaaggcaacgccacatctgctaatattatctga

SEQ ID NO: 7370 - RNA, 1449 nt, synthetic construct
  misc_feature 1..1449: note = derived and/or modified CDS sequence (opt5) from CCHFV(Iran-KhRazavi72)__KJ485700.1__N
  source 1..1449: mol_type = other RNA
atggagaacaagatcgaagtgaaaaataagcacgagaaaaacaagtggttcgaagagtttaaaaagggcaatgggctggtcgacaccttccccaacagctactccttttgcgaaaatgttcctaacctcgatagattcgtgtttcagatggccggagctacagacgatgcccaaaaggactctatttatgcgagcgctctggtggaggccacgaaattctgtgccccgatctacgagtgcgcttgggcctcctctaccggcattgtcaagaaagggcttgaatggtttgagaagaatgctggaacaatcaaaagctgggatgaatcctataccgagctgaaggtggaggttcccaagattgaacagctctctaactaccagcaggccgcgctgaaatggcggaaggacatcggcttccgcgggaatgccaacacagctgcccttagcaataaagtgctggctgagtataaggtccctggagaaatcgtgatgtccgttaaagagatgctcagcgatatgattagacggcgcaacctgatcctgaatagaggcggcgacgaaaacccccgggggcctgtgtctcgcgagcatgtcgagtggtgtagagaatttattaagggaaaatacatcatggccttcaatcccccttggggcgatattaacaagtccgggcggagcggaatcgcgctcgtggccaccggcctggctaagctggccgagacagaagggaaaggagtgtttgacgaggctaagaaaaccgtcgaagccctgaacggctatctcgataagcacaaagacgaggttgataaggcctctgctgactccatgattacgaatctgcttaagcatatcgcgaaagcccaagagctgtacaagaacagctctgctctccgcgcccagggcgcccagatcgacaccgtgttctccagctactattggctgtacaaagctggggtgacaccggaaacctttcccacagtctcccagttcctgttcgagctcggaaagcaacctagaggcaccaaaaagatgaagaaagccctgctttctacgcccatgaagtgggggaaaaagctgtatgaactctttgcggatgacagcttccagcagaatcggatttacatgcaccctgctgtgctgacagccggacgcatctccgagatgggcgtttgctttgggaccattcccgtggccaacccggatgacgctgcccttggaagcggccatacaaaatctatcctgaatctcagaaccaacaccgaaacaaataacccttgtgctaagacgattgtcaagctgttcgagatccagaaaaccggctttaatatccaagatatggacattgtggcctccgagcaccttctccaccagagcctggttgggaagcagtctcccttccaaaacgcgtataatgtgaaaggaaacgccacaagcgctaatatcatttga

SEQ ID NO: 7371 - RNA, 1449 nt, synthetic construct
  misc_feature 1..1449: note = derived and/or modified CDS sequence (opt5) from CCHFV(Iran-Zahedan19)__KJ676542.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccggagctacggatgacgcccaaaaagatagcatttatgcgtccgctctggtggaggccaccaagttctgtgcccctatctacgagtgcgcttgggtctctagcacaggcattgtgaagaaagggcttgaatggtttgagaagaatgccggaaccatcaaatcctgggacgaatcttatacagagctgaaggttgaggtgccgaaaattgaacagctcgctaactaccagcaggccgcgctgaagtggcggaaggatatcggcttccgcgtcaatgccaacaccgctgcccttagccacaaagtgctggctgagtataaggttcccggggaaatcgtgatgtccgtcaaagagatgctcagcgacatgattagacggcgcaatctgatcctgaacagaggaggcgatgaaaatcctcggggccccgtgtctcgcgagcacgtggagtggtgtagagaatttgtcaaggggaaatacattatggccttcaaccctccctggggagacatcaataagtccggccggagcgggattgcgctcatcgccacaggactggctaaacttgccgagaccgaaggcaagggggtttttgatgaggctaagaaaacggtggaagccctgaacggatatctcgacaagcacaaagatgaggtggacaaggcctctgctgacaacatgattaccaatctgcttaaacatatcgcgaaggcccaagagctgtacaagaactccagcgctctccgcgcccagggcgcccagatcgatacagctttctcttcctactattggctgtacaaagccggcgtcacccctgaaacatttccgaccgtgagccagttcctgttcgagctcgggaagcaacccagaggaacgaaaaagatgaaaaaggcgctgctttccacacctatgcggtggggcaagaaactgtatgaactctttgctgacgattctttccagcagaatcgcatttacatgcaccccgccgttctgaccgccgggagaatcagcgagatgggagtgtgctttggcacaattcctgtcgctaaccccgacgatgccgctcaggggtccggacataccaagagcatccttaatctgcggaccaacacagaaacgaataacccgtgtgccaaaaccattgtgaaactcttcgagatccaaaagacaggctttaatatccaggacatggatattgttgcgtctgagcatctgctgcaccagtccctcgtgggcaagcaaagccctttccagaacgcctataatgtcaaggggaacgctacctctgccaatatcatttga

SEQ ID NO: 7372 - RNA, 1449 nt, synthetic construct
  misc_feature 1..1449: note = derived and/or modified CDS sequence (opt5) from CCHFV(NIV 112143)__JN572089.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagaaaggccttgaatggtttgagaagaatgccgggaccatcaaatcttgggacgaaagctatacagagctgaaggttgaggtgccgaaaattgaacagctcgctaactaccagcaggccgcgctgaagtggcggaaggatatcggattccgcgtcaatgccaacaccgctgccctttcccacaaagtgctggctgagtataaggttcccggcgaaatcgtgatgagcgtcaaagagatgctctctgacatgattagacggcgcaatctgatcctgaacagagggggagatgaaaatcctcggggccccgtgtcccgcgagcacgtggagtggtgtagagaatttgtcaagggcaaatacattatggccttcaaccctccctggggagacatcaataagagcgggcggtctggcattgcgctcatcgccacagggctggctaaacttgccgagaccgaaggaaagggcgtttttgatgaggctaagaaaacggtggaagccctgaacgggtatctcgacaagcacaaagatgaggtggacaaggcctccgctgacaacatgattaccaatctgcttaaacatatcgcgaaggcccaagagctgtacaagaacagctctgctctccgcgcccagggagcccagatcgatacagctttctccagctactattggctgtacaaagccggcgtcacccctgaaacatttccgaccgtgtcccagttcctgttcgagctcggcaagcaacccagagggacgaaaaagatgaaaaaggcgctgctttctacacctatgcggtggggaaagaaactgtatgaactctttgctgacgatagcttccagcagaatcgcatttacatgcaccccgccgttctgaccgccggcagaatctccgagatgggggtgtgctttggaacaattcctgtcgctaaccccgacgatgccgctcagggcagcgggcataccaagtctatccttaatctgcggaccaacacagaaacgaataacccgtgtgccaaaaccattgtgaaactcttcgagatccaaaagacaggatttaatatccaggacatggatattgttgcgtccgagcatctgctgcaccagagcctcgtgggcaagcaatctcctttccagaacgcctataatgtcaagggcaacgctaccagcgccaatatcatttga

SEQ ID NO: 7373 - RNA, 1449 nt, synthetic construct
  misc_feature 1..1449: note = derived and/or modified CDS sequence (opt5) from CCHFV(NIVA 118595)__JN572088.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagaaaggccttgaatggtttgagaagaatgccgggaccatcaaatcttgggacgaaagctatacagagctgaaggttgaggtgccgaaaattgaacagctcgctaactaccagcaggccgcgctgaagtggcggaaggatatcggattccgcgtcaatgccaacaccgctgccctttcccacaaagtgctggctgagtataaggttcccggcgaaatcgtgatgagcgtcaaagagatgctctctgacatgattagacggcgcaatctgatcctgaacagagggggagatgaaaatcctcggggccccgtgtcccgcgagcacgtggagtggtgtagagaatttgtcaagggcaaatacattatggccttcaaccctccctggggagacatcaataagagcgggcggtctggcattgcgctcgttgccacagggctggctaaacttgccgagaccgaaggaaagggcgtgtttgatgaggctaagaaaacggtggaagccctgaacgggtatctcgacaagcacaaagatgaggtcgacaaggcctccgctgacaacatgatcaccaatctgcttaaacatattgcgaaggcccaagagctgtacaagaacagctctgctctccgcgcccagggagcccagatcgatacagctttctccagctactattggctgtacaaagccggcgtgacccctgaaacatttccgaccgtttcccagttcctgttcgagctcggcaagcaacccagagggacgaaaaagatgaaaaaggcgctgctttctacacctatgcggtggggaaagaaactgtatgaactctttgctgacgatagcttccagcagaatcgcatctacatgcaccccgccgtgctgaccgccggcagaatttccgagatgggggtctgctttggaacaatccctgtggctaaccccgacgatgccgctcagggcagcgggcataccaagtctattcttaatctgcggaccaacacagaaacgaataacccgtgtgccaaaaccatcgttaaactcttcgagattcaaaagacaggatttaatatccaggacatggatatcgtggcgtccgagcatctgctgcaccagagcctcgtcggcaagcaatctcctttccagaacgcctataatgtgaagggcaacgctaccagcgccaatattatctga

SEQ ID NO: 7374 - RNA, 1449 nt, synthetic construct
  misc_feature 1..1449: note = derived and/or modified CDS sequence (opt5) from CCHFV(SPU 130/89)__KJ682821.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggccagcgctacggatgacgcccaaaaggattccatttatgcgtctgctctggtggaggccaccaagttctgtgcccctatctacgagtgcgcttgggtcagctccacaggaattgtgaaaagaggccttgaatggtttgagaagaatgccgggaccatcaaatcttgggacgaaagctatacagagctgaaggttgatgtgccgaaaattgagcagctcgctaactaccagcaggccgcgctgaagtggcggaaggacatcggattccgcgtcaatgccaacaccgctgccctttccaataaagtgctggctgaatataaggttcccggcgagatcgtgatgagcgtcaaagaaatgctctctgatatgattagacggcgcaaccaaatcctgaatagagggggagacgagaaccctcggggccccgtgtcccgcgaacacgtggattggtgtagagagtttgtcaagggcaaatacattatggccttcaatcctccctggggagacatcaacaagagcgggcggtctggcattgcgctggttgccacagggctcgctaaactggccgagaccgaaggaaagggcgtgtttgatgaggctaagaaaacggtggaagcccttaacgggtatctggacaagcataaagacgaggtcgatcgcgcctccgctgacagcatgatcaccaatctcctgaagcacattgcgaaagcccaggaactttacaagaactcttccgctctgagagcccagggagcccagatcgatacagctttcagctcctactattggctctacaaggccggcgtgacccctgagacatttccgaccgtttctcaattcctgttcgagctgggcaaacagccccgggggacgaagaaaatgaagaaagcgctcctgagcacacctatgaagtggggaaagaaactttatgaactgtttgctgacgattccttccagcagaatcgcatctacatgcatcccgccgtgctcaccgccggcagaattagcgagatgggggtctgctttggaacaatccctgtggctaaccccgacgatgccgctcaaggctctgggcacaccaagtccattctgaatcttcggaccaacacagaaacgaataacccgtgtgcccgcaccatcgttaaactgttcgagattcagaagacaggatttaatatccaggacatggatatcgtggcgagcgaacatctcctgcaccaatctctggtcggcaaacagagccctttccagaacgcctataatgtgaagggcaacgctacctccgccaatattgtctga

SEQ ID NO: 7375 - RNA, 1449 nt, synthetic construct
  misc_feature 1..1449: note = derived and/or modified CDS sequence (opt5) from CCHFV(SPU 18/88)__KJ682818.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggccagcgctacggatgacgcccaaaaggattccatttatgcgtctgctctggtggaggccaccaagttctgtgcccctatctacgagtgcgcttgggtcagctccacaggaattgtgaaaagaggccttgaatggtttgagaagaatgccgggaccatcaaatcttgggacgaaagctatacagagctgaaggttgatgtgccgaaaattgagcagctcgctaactaccagcaggccgcgctgaagtggcggaaggacatcggattccgcgtcaatgccaacaccgctgccctttccaataaagtgctggctgaatataaggttcccggcgagatcgtgatgagcgtcaaagaaatgctctctgatatgattagacggcgcaaccaaatcctgaatagagggggagacgagaaccctcggggccccgtgtcccgcgaacacgtggattggtgtagagagtttgtcaagggcaaatacattatggccttcaatcctccctggggagacatcaacaagagcgggcggtctggcattgcgctggttgccacagggctcgctaaactggccgagaccgaaggaaagggcgtgtttgatgaggctaagaaaacggtggaagcccttaacgggtatctggacaagcataaagacgaggtcgatcgcgcctccgctgacagcatggtgaccaatctcctgaagcacatcgcgaaagcccaggaactttacaagaactcttccgctctgagagcccagggagcccagattgatacagctttcagctcctactattggctctacaaggccggcgttacccctgagacatttccgaccgtgtctcaattcctgttcgagctgggcaaacagccccgggggacgaagaaaatgaagaaagcgctcctgagcacacctatgaagtggggaaagaaactttatgaactgtttgctgacgattccttccagcagaatcgcatctacatgcatcccgccgtcctcaccgccggcagaatcagcgagatgggggtgtgctttggaacaattcctgttgctaaccccgacgatgccgctcaaggctctgggcacaccaagtccatcctgaatcttcggaccaacacagaaacgaataacccgtgtgcccgcaccattgtgaaactgttcgagatccagaagacaggatttaatattcaggacatggatatcgtcgcgagcgaacatctcctgcaccaatctctggtgggcaaacagagccctttccagaacgcctataatgtcaagggcaacgctacctccgccaatatcatttga

SEQ ID NO: 7376 - RNA, 1449 nt, synthetic construct
  misc_feature 1..1449: note = derived and/or modified CDS sequence (opt5) from CCHFV(SPU 187/90)__KJ682823.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggccagcgctacggatgacgcccaaaaggattccatttatgcgtctgctctggtggaggccaccaagttctgtgcccctatctacgagtgcgcttgggtcagctccacaggaattgtgaaaagaggccttgaatggtttgagaagaatgccgggaccatcaaatcttgggacgaaagctatacagagctgaaggttgatgtgccgaaaattgagcagctcgctaactaccagcaggccgcgctgaagtggcggaaggacatcggattccgcgtcaatgccaacaccgctgccctttccaataaagtgctggctgaatataaggttcccggcgagatcgtgatgagcgtcaaagaaatgctctctgatatgattagacggcgcaaccaaatcctgaatagagggggagacgagaaccctcggggccccgtgtcccgcgaacacgtggattggtgtagagagtttgtcaagggcaaatacattatggccttcaatcctccctggggagacatcaacaagagcgggcggtctggcattgcgctggttgccacagggctcgctaaactggccgagaccgaaggaaagggcgtgtttgatgaggctaagaaaacggtggaagcccttaacgggtatctggacaagcataaagacgaggtcgatcgcgcctccgctgacagcatgatcaccaatctcctgaagcacattgcgaaagcccaggaactttacaagaactcttccgctctgagagcccagggagcccagatcgatacagctttcagctcctactattggctctacaaggccggcgtgacccctgagacatttccgaccgtttctcaattcctgttcgagctgggcaaacagccccgggggacgaagaaaatgaagaaagcgctcctgagcacacctatgaagtggggaaagaaactttatgaactgtttgctgacgattccttccagcagaatcgcatctacatgcatcccgccgtgctcaccgccggcagaattagcgagatgggggtctgctttggaacaatccctgtggctaaccccgacgatgccgctcaaggctctgggcacaccaagtccattctgaatcttcagaccaacacagaaacgaataacccgtgtgcccggaccatcgttaaactgttcgagattcagaagacaggatttaatatccaagacatggatatcgtggcgagcgaacatctcctgcaccagtctctggtcggcaaacagagccctttccagaacgcctataatgtgaagggcaacgctacctccgccaatattatctga

SEQ ID NO: 7377 - RNA, 1449 nt, synthetic construct
  misc_feature 1..1449: note = derived and/or modified CDS sequence (opt5) from CCHFV(SPU 383/87)__KJ682816.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggccggagctacggatgacgcccaaaaggatagcatttatgcgtccgctctggtggaggccaccaagttctgtgcccctatctacgagtgcgcttgggtctctagcacaggcattgtgaaaagagggcttgaatggtttgagaagaatgccggaaccatcaaatcctgggacgaatcttatacagagctgaaggttgatgtgccgaaaattgagcagctcgctaactaccagcaggccgcgctgaagtggcggaaggacatcggcttccgcgtcaatgccaacaccgctgcccttagcaataaagtgctggctgaatataaggttcccggggagatcgtgatgtccgtcaaagaaatgctcagcgatatgattagacggcgcaaccaaatcctgaatagaggaggcgacgagaaccctcggggccccgtgtctcgcgaacacgtggattggtgtagagagtttgtcaaggggaaatacattatggccttcaatcctccctggggagacatcaacaagtccggccggagcgggattgcgctggttgccacaggactcgctaaactggccgagaccgaaggcaagggggtgtttgatgaggctaagaaaacggtggaagcccttaacggatatctggacaagcataaagacgaggtcgatcgcgcctctgctgactccatgatcaccaatctcctgaagcacattgcgaaagcccaggaactttacaagaacagctctgctctgagagcccagggcgcccagatcgatacagctttctccagctactattggctctacaaggccggcgtgacccctgagacatttccgaccgtttcccaattcctgttcgagctggggaaacagccccggggaacgaagaaaatgaagaaagcgctcctgtctacacctatgaagtggggcaagaaactttatgaactgtttgctgacgatagcttccagcagaatcgcatctacatgcatcccgccgtgctcaccgccgggagaatttccgagatgggagtctgctttggcacaatccctgtggctaaccccgacgatgccgctcaagggagcggacacaccaagtctattctgaatcttcggaccaacacagaaacgtccaatccgtgtgcccgcaccatcgttaaactgttcgagattcagaagacaggctttaacatccaggacatggatatcgtggcgagcgaacatctcctgcaccaatctctggtcggcaaacagagccctttccagaatgcctataacgtgaaggggaatgctacctccgccaacattgtctga

SEQ ID NO: 7378 - RNA, 1449 nt, synthetic construct
  misc_feature 1..1449: note = derived and/or modified CDS sequence (opt5) from CCHFV(SPU 383/87)__KJ682816.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggccggagctacggatgacgcccaaaaggatagcatttatgcgtccgctctggtggaggccaccaagttctgtgcccctatctacgagtgcgcttgggtctctagcacaggcattgtgaaaagagggcttgaatggtttgagaagaatgccggaaccatcaaatcctgggacgaatcttatacagagctgaaggttgatgtgccgaaaattgagcagctcgctaactaccagcaggccgcgctgaagtggcggaaggacatcggcttccgcgtcaatgccaacaccgctgcccttagcaataaagtgctggctgaatataaggttcccggggagatcgtgatgtccgtcaaagaaatgctcagcgatatgattagacggcgcaaccaaatcctgaatagaggaggcgacgagaaccctcggggccccgtgtctcgcgaacacgtggattggtgtagagagtttgtcaaggggaaatacattatggccttcaatcctccctggggagacatcaacaagtccggccggagcgggattgcgctggttgccacaggactcgctaaactggccgagaccgaaggcaagggggtgtttgatgaggctaagaaaacggtggaagcccttaacggatatctggacaagcataaagacgaggtcgatcgcgcctctgctgactccatgatcaccaatctcctgaagcacattgcgaaagcccaggaactttacaagaacagctctgctctgagagcccagggcgcccagatcgatacagctttctccagctactattggctctacaaggccggcgtgacccctgagacatttccgaccgtttcccaattcctgttcgagctggggaaacagccccggggaacgaagaaaatgaagaaagcgctcctgtctacacctatgaagtggggcaagaaactttatgaactgtttgctgacgatagcttccagcagaatcgcatctacatgcatcccgccgtgctcaccgccgggagaatttccgagatgggagtctgctttggcacaatccctgtggctaaccccgacgatgccgctcaagggagcggacacaccaagtctattctgaatcttcggaccaacacagaaacgtccaatccgtgtgcccgcaccatcgttaaactgttcgagattcagaagacaggctttaacatccaggacatggatatcgtggcgagcgaacatctcctgcaccaatctctggtcggcaaacagagccctttccagaatgcctataacgtgaaggggaatgctacctccgccaacattatctga

SEQ ID NO: 7379 - RNA, 1449 nt, synthetic construct
  misc_feature 1..1449: note = derived and/or modified CDS sequence (opt5) from CCHFV(SPU 431/85)__KJ682815.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggccagcgctacggatgacgcccaaaaggattccatttatgcgtctgctctggtggaggccaccaagttctgtgcccctgtctacgagtgcgcttgggtgagctccacaggaatcgttaaaagaggccttgaatggtttgagaagaatgccgggaccattaaatcttgggacgaaagctatacagagctgaaggtggatgtcccgaaaatcgagcagctcgctaactaccagcaggccgcgctgaagtggcggaaggacattggattccgcgtgaatgccaacaccgctgccctttccaataaagttctggctgaatataaggtgcccggcgagatcgtcatgagcgtgaaagaaatgctctctgatatgatcagacggcgcaaccaaattctgaatagagggggagacgagaaccctcggggccccgtgtcccgcgaacacgtcgattggtgtagagagtttgttaagggcaaatacatcatggccttcaatcctccctggggagacattaacaagagcgggcggtctggcatcgcgctggtggccacagggctcgctaaactggccgagaccgaaggaaagggcgtgtttgatgaggctaagaaaacggtcgaagcccttaacgggtatctggacaagcataaagacgaggtggatcgcgcctccgctgacagcatgattaccaatctcctgaagcacatcgcgaaagcccaggaactttacaagaactcttccgctctgagagcccagggagcccagattgatacagctttcagctcctactattggctctacaaggccggcgttacccctgagacatttccgaccgtgtctcaattcctgttcgagctgggcaaacagccccgggggacgaagaaaatgaagaaagcgctcctgagcacacctatgaagtggggaaagaaactttatgaactgtttgctgacgataccttccagcagaatcgcatctacatgcatcccgccgtcctcacagccggcagaatctccgagatgggggtgtgctttggaaccattcctgttgctaaccccgacgatgccgctcaaggcagcgggcacaccaagtctatcctgaatcttcggacaaacacggaaaccaataacccgtgtgcccgcacaattgtgaaactgttcgagatccagaagaccggatttaatattcaggacatggatatcgtcgcgtccgaacatctcctgcaccaaagcctggtgggcaaacagtctcctttccagaacgcctataatgtcaagggcaacgctacaagcgtgaatatcatttga

SEQ ID NO: 7380 - RNA, 1449 nt, synthetic construct
  misc_feature 1..1449: note = derived and/or modified CDS sequence (opt5) from CCHFV(SPU 45/88)__KJ682819.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggccagcgctacggatgacgcccaaaaggattccatttatgcgtctgctctggtggaggccaccaagttctgtgcccctatctacgagtgcgcttgggtcagctccacaggaattgtgaaaagaggccttgaatggtttgagaagaatgccgggaccatcaaatcttgggacgaaagctatacagagctgaaggttgatgtgccgaaaattgagcagctcgctaactaccagcaggccgcgctgaagtggcggaaggacatcggattccgcgtcaatgccaacaccgctgccctttccaataaagtgctggctgaatataaggttcccggcgagatcgtgatgagcgtcaaagaaatgctctctgatatgattagacggcgcaaccaaatcctgaatagagggggagacgagaaccctcggggccccgtgtcccgcgaacacgtggattggtgtagagagtttgtcaagggcaaatacattatggccttcaatcctccctggggagacatcaacaagagcgggcggtctggcattgcgctggttgccacagggctcgctaaactggccgagaccgaaggaaagggcgtgtttgatgaggctaagaaaacggtggaagcccttaacgggtatctggacaagcataaagacgaggtcgatcgcgcctccgctgacagcatgatcaccaatctcctgaagcacattgcgaaagcccaggaactttacaagaactcttccgctctgagagcccagggagcccagatcgatacagctttcagctcctactattggctctacaaggccggcgtgacccctgagacatttccgaccgtttctcaattcctgttcgagctgggcaaacagccccgggggacgaagaaaatgaagaaagcgctcctgagcacacctatgaagtggggaaagaaactttatgaactgtttgctgacgattccttccagcagaatcgcatctacatgcatcccgccgtgctcaccgccggcagaattagcgagatgggggtctgctttggaacaatccctgtggctaaccccgacgatgccgctcaaggctctgggcacaccaagtccattctgaatcttcggaccaacacagaaacgaataacccgtgtgcccgcaccatcgttaaactgttcgagattcagaagacaggatttaatatccaggacatggatatcgtggcgagcgaacatctcctgcaccaatctctggtcggcaaacagagccctttccagaacgcctataatgtgaagggcaacgctacctccgccaatattatctga

SEQ ID NO: 7381 - RNA, 1449 nt, synthetic construct
  misc_feature 1..1449: note = derived and/or modified CDS sequence (opt5) from CCHFV(SPU 48/90)__KJ682822.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggccagcgctacggatgacgcccaaaaggattccatttatgcgtctgctctggtggaggccaccaagttctgtgcccctatctacgagtgcgcttgggtcagctccacaggaattgtgaaaagaggccttgaatggtttgagaagaatgccgggaccatcaaatcttgggacgaaagctatacagagctgaaggttgatgtgccgaaaattgagcagctcgctaactaccagcaggccgcgctgaagtggcggaaggacatcggattccgcgtcaatgccaacaccgctgccctttccaataaagtgctggctgaatataaggttcccggcgagatcgtgatgagcgtcaaagaaatgctctctgatatgattagacggcgcaaccaaatcctgaatagagggggagacgagaaccctcggggccccgtgtcccgcgaacacgtggattggtgtagagagtttgtcaagggcaaatacattatggccttcaatcctccctggggagacatcaacaagagcgggcggtctggcattgcgctggttgccacagggctcgctaaactggccgagaccgaaggaaagggcgtgtttgatgaggctaagaaaacggtggaagcccttaacgggtatctggacaagcataaagacgaggtcgatcgcgcctccgctgacagcatgatcaccaatctcttcaagcacattgcgaaagcccaggaactgtacaagaactcttccgctcttagagcccagggagcccagatcgatacagcttttagctcctactattggctgtacaaggccggcgtgacccctgagacattcccgaccgtttctcaattcctctttgagctgggcaaacagccccgggggacgaagaaaatgaagaaagcgctgctcagcacacctatgaagtggggaaagaaactgtatgaacttttcgctgacgattcctttcagcagaatcgcatctacatgcatcccgccgtgctgaccgccggcagaattagcgagatgggggtctgcttcggaacaatccctgtggctaaccccgacgatgccgctcaaggctctgggcacaccaagtccattctcaatctgcggaccaacacagaaacgaataacccgtgtgcccgcaccatcgttaaactttttgagattcagaagacaggattcagcatccaggacatggatatcgtggcgtctgaacatctgctccaccaaagcctggtcggcaaacagtccccttttcagaatgcctataacgtgaagggcaatgctacctctgccaacattatctga

SEQ ID NO: 7382 - RNA, 1449 nt, synthetic construct
  misc_feature 1..1449: note = derived and/or modified CDS sequence (opt5) from CCHFV(SPU 497/88)__KJ682820.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggccagcgctacggatgacgcccaaaaggattccatttatgcgtctgctctggtggaggccaccaagttctgtgcccctatctacgagtgcgcttgggtcagctccacaggaattgtgaaaagaggccttgaatggtttgagaagaatgccgggaccatcaaatcttgggacgaaagctatacagagctgaaggttgatgtgccgaaaattgagcagctcgctaactaccagcaggccgcgctgaagtggcggaaggacatcggattccgcgtcaatgccaacaccgctgccctttccaataaagtgctggctgaatataaggttcccggcgagatcgtgatgagcgtcaaagaaatgctctctgatatgattagacggcgcaaccaaatcctgaatagagggggagacgagaaccctcggggccccgtgtcccgcgaacacgtggattggtgtagagagtttgtcaagggcaaatacattatggccttcaatcctccctggggagacatcaacaagagcgggcggtctggcattgcgctggttgccacagggctcgctaaactggccgagaccgaaggaaagggcgtgtttgatgaggctaagaaaacggtggaagcccttaacgggtatctggacaagcataaagacgaggtcgatcgcgcctccgctgacagcatgatcaccaatctcctgaagcacattgcgaaagcccaggaactttacaagaactcttccgctctgagagcccagggagcccagatcgatacagctttcagctcctactattggctctacaaggccggcgtgacccctgagacatttccgaccgtttctcaattcctgttcgagctgggcaaacagccccgggggacgaagaaaatgaagaaagcgctcctgagcacacctatgaagtggggaaagaaactttatgaactgtttgctgacgattccttccagcagaatcgcatctacatgcatcccgccgtgctcaccgccggcagaattagcgagatgggggtctgctttggagctatccctgtggccaaccccgacgatgctgcccaaggctctgggcacacaaagtccattctgaatcttcggaccaacaccgaaacaaataacccgtgtgcgcgcacgatcgttaaactgttcgagattcagaagaccggatttaatatccaggacatggatatcgtggccagcgaacatctcctgcaccaatctctggtcggcaaacagagccctttccagaacgcttataatgtgaagggcaacgccacatccgctaatattatctga

SEQ ID NO: 7383 - RNA, 1449 nt, synthetic construct
  misc_feature 1..1449: note = derived and/or modified CDS sequence (opt5) from CCHFV(SPU 556/87)__KJ682817.1__N
  source 1..1449: mol_type = other RNA
atggagaacaagatcgaagtgaataacaaagacgagatgaatagatggttcgaagagtttaagaaaggcaacgggctggtcgataccttcacaaatagctactccttttgcgaatctgttcccaacctcgaccggttcgtgtttcagatggccggagctacggatgacgcccaaaaggatagcatttatgcgtccgctctggtggaggccaccaaattctgtgcccctatctacgagtgcgcttgggtctctagcacaggcattgtgaagaaggggcttgaatggtttgagaaaaatgccggaaccatcaagtcctgggacgaatcttatacagagctgaaagttgatgtgccgaagattgagcagctcgctaactaccagcaggccgcgctgaaatggcgcaaggacatcggcttcagagtcaatgccaacaccgctgcccttagcaataaggtgctggctgaatataaagttcccggggagatcgtgatgtccgtcaaggaaatgctcagcgatatgattcggcgcagaaaccaaatcctgaatcggggaggcgacgagaaccctcgcggccccgtgtctagagaacacgtggattggtgtcgggagtttgtcaaagggaagtacattatggccttcaatcctccctggggagacatcaacaaatccggccgcagcgggattgcgctggttgccacaggactcgctaagctggccgagaccgaaggcaaaggggtgtttgatgaggctaagaagacggtggaagcccttaacggatatctggacaaacataaggacgaggtcgatagagcctctgctgactccatgatcaccaatctcctgaaacacattgcgaaggcccaggaactttacaaaaacagctctgctctgcgggcccagggcgcccagatcgatacagctttctccagctactattggctctacaaggccggcgtgacccctgagacatttccgaccgtttcccaattcctgttcgagctggggaagcagccccgcggaacgaaaaagatgaaaaaggcgctcctgtctacacctatgaaatggggcaagaaactttatgaactgtttgctgacgatagcttccagcagaatagaatctacatgcatcccgccgtgctcaccgccgggcggatttccgagatgggagtctgctttggcacaatccctgtggctaaccccgacgatgccgctcaagggagcggacacaccaagtctattctgaatcttcgcaccaacacagaaacgaataacccgtgtgccaagaccatcgttaaactgttcgagattcagaagacaggctttaatatccaggacatggatatcgtggcgtccgaacatctcctgcaccaaagcctggtcggcaaacagtctcctttccagaacgcctataatgtgaaggggaacgctaccagcgccaatattatctga

SEQ ID NO: 7384 - RNA, 1449 nt, synthetic construct
  misc_feature 1..1449: note = derived and/or modified CDS sequence (opt5) from CCHFV(SPU 92/01)__KC880335.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggccagcgctacggatgacgcccaaaaggattccatttatgcgtctgctctggtggaggccaccaagttctgtgcccctatctacgagtgcgcttgggtcagctccacaggaattgtgaaaagaggccttgaatggtttgagaagaatgccgggaccatcaaatcttgggacgaaagctatacagagctgaaggttgatgtgccgaaaattgagcagctcgctaactaccagcaggccgcgctgaagtggcggaaggacatcggattccgcgtcaatgccaacaccgctgccctttccaataaagtgctggctgaatataaggttcccggcgagatcgtgatgagcgtcaaagaaatgctctctgatatgattagacggcgcaaccaaatcctgaatagagggggagacgagaaccctcggggccccgtgtcccgcgaacacgtggattggtgtagagagtttgtcaagggcaaatacattatggccttcaatcctccctggggagacatcaacaagagcgggcggtctggcattgcgctggttgccacagggctcgctaaactggccgagaccgaaggaaagggcgtgtttgatgaggctaagaaaacggtggaagcccttaacgggtatctggacaagcataaagacgaggtcgatcgcgcctccgctgacagcatgatcaccaatctcctgaagcacattgcgaaagcccaggaactttacaagaactcttccgctctgagagcccagggagcccagatcgatacagctttcagctcctactattggctctacaaggccggcgtgacccctgagacatttccgaccgtttctcaattcctgttcgagctgggcaaacagccccgggggacgaagaaaatgaagaaagcgctcctgagcacacctatgaagtggggaaagaaactttatgaactgtttgctgacgattccttccagcagaatcgcatctacatgcatcccgccgtgctcaccgccggcagaattagcgagatgggggtctgctttggaacaatccctgtggctaaccccgacgatgccgctcaaggctctgggcacaccaagtccattctgaatcttcagaccaacacagaaacgaataacccgtgtgcccggaccatcgttaaactgttcgagattcagaagacaggatttaatatccaagacatggatatcgtggcgagcgaacatctcctgcaccagtctctggtcggcaaacagagccctttccagaacgcctataatgtgaagggcaacgctacctccgtcaatattatctga

SEQ ID NO: 7385 - RNA, 1449 nt, synthetic construct
  misc_feature 1..1449: note = derived and/or modified CDS sequence (opt5) from CCHFV(SRR)__KU707901.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccggagctacggatgacgcccaaaaagatagcatttatgcgtccgctctggtggaggccaccaagttctgtgcccctatctacgagtgcgcttgggtctctagcacaggcattgtgaagaaagggcttgaatggtttgagaagaatgccggaaccatcaaatcctgggacgaatcttatacagagctgaaggttgaggtgccgaaaattgaacagctcgctaactaccagcaggccgcgctgaagtggcggaaggatatcggcttccgcgtcaatgccaacaccgctgcccttagccacaaagtgctggctgagtataaggttcccggggaaatcgtgatgtccgtcaaagagatgctcagcgacatgattagacggcgcaatctgatcctgaacagaggaggcgatgaaaatcctcggggccccgtgtctcgcgagcacgtggagtggtgtagagaatttgtcaaggggaaatacattatggccttcaaccctccctggggagacatcaataagtccggccggagcgggattgcgctcgttgccacaggactggctaaacttgccgagaccgaaggcaagggggtgtttgatgaggctaagaaaacggtggaagccctgaacggatatctcgacaagcacaaagatgaggtcgacaaggcctctgctgacaacatgatcaccaatctgcttaaacatattgcgaaggcccaagagctgtacaagaactccagcgctctccgcgcccagggcgcccagatcgatacagctttctcttcctactattggctgtacaaagccggcgtgacccctgaaacatttccgaccgttagccagttcctgttcgagctcgggaagcaacccagaggaacgaaaaagatgaaaaaggcgctgctttccacacctatgcggtggggcaagaaactgtatgaactctttgctgacgattctttccagcagaatcgcatctacatgcaccccgccgtgctgaccgccgggagaattagcgagatgggagtctgctttggcacaatccctgtggctaaccccgacgatgccgctcaggggtccggacataccaagagcattcttaatctgcggaccaacacagaaacgaataacccgtgtgccaaaaccatcgttaaactcttcgagattcaaaagacaggctttaatatccaggacatggatatcgtggcgtctgagcatctgctgcaccagtccctcgtcggcaagcaaagccctttccagaacgcctataatgtgaaggggaacgctacctctgccaatattatctga

SEQ ID NO: 7386 - RNA, 1449 nt, synthetic construct
  misc_feature 1..1449: note = derived and/or modified CDS sequence (opt5) from CCHFV(STV/HU29223)__AF481802.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaaaattctgggaccatcaagagctgggacgaaaactatgccgagctgaaagtggatgttccgaagattgagcagctcgctaattaccagcaggccgcgctgaagtggagaaaagacatcggattccgggtgaacgccaatacagctgccctttccaacaaggtcctggctgaatataaagtgcccggcgagatcgttatgagcgtgaaggaaatgctctctgatatgattcgcagacggaatctgatcctgaaccgcgggggagacgagaatctcagaggccctgtctcccgggaacacgtggagtggtgtcgcgagtttgtgaaaggcaagtacattatggccttcaatcccccttggggagatatcaacaaaagcggaagatctggcattgcgctggtcgccaccgggcttgctaagctggccgaaacagagggaaagggcgtttttgacgaagctaaaaagaccgtggaggccctcaatgggtatctggataaacatcgggacgaagtggacaaggcctccgctgatagcatgatcacgaaccttctgaaacacattgcgaaggcccaagagctctacaagaactcttccgctctgcgcgcccagggagcccagatcgacacccccttcagctccttttactggctgtataaagctggcgtcacacctgagaccttcccgacaatctctcagttcctctttgaactgggcaagcaacccagagggaccaaaaagatgaaaaaggcccttctgagcacgcctatgaagtgggggaaaaagctctacgagctgttcgcggatgactcctttcagcagaaccggatttatatgcatcccgctgtgcttacagccggccgcatcagcgaaatgggggtttgcttcggaaccattcctgtggccaatcccgatgacgctgcccagggctctgggcacacaaaatccatcctgaacctcagaaccagcaccgagacaaataacccgtgtgctaagacgattgtcaaactgtttgaaatccaaaagaccggattcaatatccaggatatggacattgtggcctctgagcatctgctccaccagagcctggttggcaagcaatccccttttcagaacgcgtacaatgtgaaaggcaacgccacatctgctaatatcatttga

SEQ ID NO: 7387 - RNA, 1449 nt, synthetic construct
  misc_feature 1..1449: note = derived and/or modified CDS sequence (opt5) from CCHFV(TAJ/HU8966)__AY049083.2__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagaaaggccttgaatggtttgagaagaatgccgggaccatcaaatcttgggacgaaagctatacagagctgaaggttgaggtgccgaaaattgaacagctcgctaactaccagcaggccgcgctgaagtggcggaaggatatcggattccgcgtcaatgccaacaccgctgccctttcccacaaagtgctggctgagtataaggttcccggcgaaatcgtgatgagcgtcaaagagatgctctctgacatgattagacggcgcaatctgatcctgaacagagggggagatgaaaatcctcggggccccgtgtcccgcgagcacgtggagtggtgtagagaatttgtcaagggcaaatacattatggccttcaaccctccctggggagacatcaataagagcggacggtctggcattgcgctcgttgccacagggctggctaaacttgccgagaccgaaggaaagggcgtgtttgatgaggctaagaaaacggtggaagccctgaacgggtatctcgacaagcacaaagatgaggtcgacaaggcctccgctgacaacatgatcaccaatctgcttaaacatattgcgaaggcccaagagctgtacaagaacagctctgctctccgcgcccagggagcccagatcgatacagctttctccagctactattggctgtacaaagccggcgtgacccctgaaacatttccgaccgtttcccagttcctgttcgagctcggcaagcaacccagagggacgaaaaagatgaaaaaggcgctgctttctacacctatgaagtgggggaaaaagctgtatgaactctttgctgacgatagcttccagcagaatcggatctacatgcaccccgccgtgctgaccgccggccgcatttccgagatgggggtctgctttggaacaatccctgtggctgaccccgatgacgccgctcagggcagcgggcataccaaatctattcttaacctgagaaccaatacagaaacgaacaatccgtgtgccaagaccatcgttaaactcttcgagattcaaaagacaggatttaacatccaggatatggacatcgtggcgtccgagcatctgctgcaccagagcctcgtcggcaagcaatctcctttccagaatgcctataacgtgaaaggcaatgctaccagcgccaacattatctga

SEQ ID NO: 7388 - RNA, 1449 nt, synthetic construct
  misc_feature 1..1449: note = derived and/or modified CDS sequence (opt5) from CCHFV(TAJ/HU8975)__AY297692.2__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagaaaggccttgaatggtttgagaagaatgccgggaccatcaaatcttgggacgaaagctatattgagctgaaggttgaggtgccgaaaatcgaacagctcgctaactaccagcaggccgcgctgaagtggcggaaggatatcggattccgcgtcaatgccaacacagctgccctttcccacaaagtgctggctgagtataaggttcccggcgaaattgtgatgagcgtcaaagagatgctctctgacatgatcagacggcgcaatctgattctgaacagagggggagatgaaaatcctcggggccccgtgtcccgcgagcacgtggagtggtgtagagaatttgtcaagggcaaatacatcatggccttcaaccctccctggggagacattaataagagcggacggtctggcatcgcgctcgttgccaccgggctggctaaacttgccgagacagaaggaaagggcgtgtttgatgaggctaagaaaaccgtggaagccctgaacgggtatctcgacaagcacaaagatgaggtcgacaaggcctccgctgacaacatgattacgaatctgcttaaacatatcgcgaaggcccaagagctgtacaagaacagctctgctctccgcgcccagggagcccagatcgataccgctttctccagctactattggctgtacaaagccggcgtgacacctgaaacctttccgacagtttcccagttcctgttcgagctcggcaagcaacccagagggaccaaaaagatgaaaaaggcgctgctttctacgcctatgaagtgggggaaaaagctgtatgaactctttgctgacgatagcttccagcagaatcggatttacatgcaccccgccgtgctgacagccggccgcatctccgagatgggggtctgctttggaaccattcctgtggctaaccccgacgatgccgctcagggcagcgggcatacaaaatctatccttaatctgagaaccaacaccgaaacaaataacccgtgtgccaagacgattgttaaactcttcgagatccaaaagaccggatttaatatccaggacatggatattgtggcgtccgagcatctgctgcaccagagcctcgtcggcaagcaatctcctttccagaacgcctataatgtgaaaggcaacgctacaagcgccaatatcatttga

SEQ ID NO: 7389 - RNA, 1449 nt, synthetic construct
  misc_feature 1..1449: note = derived and/or modified CDS sequence (opt5) from CCHFV(TAJ/HU8978)__AY297691.2__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccggagctacggatgacgcccaaaaagatagcatttatgcgtccgctctggtggaggccaccaagttctgtgcccctatctacgagtgcgcttgggtctctagcacaggcattgtgaagaaagggcttgaatggtttgagaagaatgccggaaccatcaaatcctgggacgaatcttatacagagctgaaggttgaggtgccgaaaattgaacagctcgctaactaccagcaggccgcgctgaagtggcggaaggatatcggcttccgcgtcaatgccaacaccgctgcccttagccacaaagtgctggctgagtataaggttcccggggaaatcgtgatgtccgtcaaagagatgctcagcgacatgattagacggcgcaatctgtttctgaacagaggaggcgatgaaaatcctcggggccccgtgtctcgcgagcacgtggagtggtgtagagagttcgtcaaggggaaatacatcatggcctttaaccctccctggggagacattaataagtccggccggagcgggatcgcgctcgttgccacaggactggctaaacttgccgaaaccgaaggcaagggggtgttcgatgaggctaagcgcacggtggaagccctgaacggatatctcgacaaacacaaggatgaggtcgacaaagcctctgctgacaacatgattaccaatctgcttaagcatatcgcgaaagcccaagagctgtacaagaactccagcgctctcagagcccagggcgcccagattgatacatctttttccagctactattggctgtacaaggctggccggacccctgaaacattcccgaccgtgtcccagttcctgtttgagctcgggaaacaaccccgcggaacgaagaaaatgaagaaagccctgctttctacacctatgaagtggggcaagaaactgtatgaactcttcgcggacgatagctttcagcagaatagaatctacatgcaccccgctgttctgaccgccgggcggatctccgagatgggagtgtgcttcggcacaattcctgtcgccaaccccgacgatgctgcccaggggagcggacataccaagtctatccttaatctgcgcaccaacacagaaacgaataacccgtgtgctaaaaccattgtgaagctctttgagatccagaaaacaggcttcaatattcaagacatggatatcgttgcctccgagcatctgctgcaccagagcctcgtgggcaagcaatctccttttcagaacgcgtataatgtcaaggggaacgccaccagcgctaatatcatttga

SEQ ID NO: 7390 - RNA, 1449 nt, synthetic construct
  misc_feature 1..1449: note = derived and/or modified CDS sequence (opt5) from CCHFV(Uzbek/TI10145)__AF481799.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagaaaggccttgaatggtttgagaagaatgccgggaccatcaaatcttgggacgaaagctatacagagctgaaggttgaggtgccgaaaattgaacagctcgctgattaccagcaggccgcgctgaagtggcggaaggacatcggattccgcgtcaacgccaataccgctgccctttcccacaaagtgctggctgagtataaggttcccggcgaaatcgtgatgagcgtcaaagagatgctctctgatatgattagacggcgcaacctgatcctgaatagagggggagacgaaaaccctcggggccccgtgtcccgcgagcacgtggagtggtgtagagaatttgtcaagggcaaatacattatggccttcaatcctccctggggagatatcaacaagagcggacggtctggcattgcgctcgttgccacagggctggctaaacttgccgagaccgaaggaaagggcgtgtttgacgaggctaagaaaacggtggaagccctgaatgggtatctcgataagcacaaagacgaggtcgacaaggcctccgctgataacatgatcaccaacctgcttaaacatattgcgaaggcccaagagctgtacaagaatagctctgctctccgcgcccagggagcccagatcgacacagctttctccagctactattggctgtacaaagccggcgtgacccctgaaacatttccgaccgtttcccagttcctgttcgagctcggcaagcaacccagagggacgaaaaagatgaaaaaggcgctgctttctacacctatgaagtgggggaaaaagctgtatgaactctttgctgatgacagcttccagcagaaccggatctacatgcaccccgccgtgctgaccgccggccgcatttccgagatgggggtctgctttggaacaatccctgtggctaatcccgatgacgccgctcagggcagcgggcataccaaatctattcttaacctgagaaccaatacagaaacgaacaatccgtgtgccaagaccatcgttaaactcttcgagattcaaaagacaggatttaacatccaggatatggacatcgtggcgtccgagcatctgctgcaccagagcctcgtcggcaagcaatctcctttccagaatgcctataacgtgaaaggcaatgctaccagcgccaacattatctga

SEQ ID NO: 7391 - RNA, 1449 nt, synthetic construct
  misc_feature 1..1449: note = derived and/or modified CDS sequence (opt5) from CCHFV(ROS/TI28044)__AY277672.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaaaattctgggaccatcaagagctgggacgaaaactatgccgagctgaaagtggatgttccgaagattgagcagctcgctaattaccagcaggccgcgctgaagtggagaaaagacatcggattccgggtgaacgccaatacagctgccctttccaacaaggtcctggctgaatataaagtgcccggcgagatcgttatgagcgtgaaggaaatgctctctgatatgattcgcagacggaatctgatcctgaaccgcgggggagacgagaatcctagaggccccgtctcccgggaacacgtggagtggtgtcgcgagtttgtgaaaggcaagtacattatggccttcaaccctccctggggagatatcaacaaacctggaagaagcggcattgcgctcgtcgccaccgggctggctaaacttgccgaaacagagggaaagggcgtttttgacgaagctaaaaagaccgtggaggccctgaatgggtatctcgataaacatcgggacgaagtggacaaggcctctgctgattccatgatcgcgaacctgcttaaacacattgccaaggctcaagagctgtacaagaatagctctgccctccgcgcccagggagctcagatcgacacgccgttctccagcttttactggctgtataaagccggcgtcacccccgagacattccctaccatctcccagttcctgtttgaactcggcaagcaacccagagggacaaagaagatgaaaaaggcgctgctttctacccctatgaagtgggggaaaaagctgtacgaactcttcgctgatgacagctttcagcagaaccggatttatatgcatcccgccgtgctgacggccggccgcatctccgagatgggggtttgcttcggaacaattccggtggctaatcctgatgacgccgctcagggcagcgggcacaccaaatctatccttaacctgagaacatccaccgagaccaataacccctgtgccaagacaattgtcaaactctttgaaatccaaaagacgggattcaatatccaggatatggacattgtggcgagcgagcatctgctgcaccagtctctcgttggcaagcaaagcccttttcagaacgcctacaatgtgaaaggcaacgctacctccgccaatatcatttga

SEQ ID NO: 7392 - RNA, 1449 nt, synthetic construct
  misc_feature 1..1449: note = derived and/or modified CDS sequence (opt5) from CCHFV(7001)__AF415236.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagcggggccttgaatggtttgagaaaaatgccgggaccatcaagtcttgggacgaaagctatacagagctgaaagttgaggtgccgaagattgaacagctcgctgattaccagcaggccgcgctgaaatggcgcaaggacatcggattcagagtcaacgccaataccacagctctttcccacaaggtgctggccgagtataaagttcccggcgaaatcgtgatgagcgtcaaggagatgctctctgatatgattcggcgcagaaacctgatcctgaatcgcgggggagacgaatcccctcggggccccgtgagcagagagcacgtggagtggtgtcgggaatttgtcaaaggcaagtacattatggctttcaaccctccctggggagatatcaataaatctgggcgctccggcattgccctcgttgcgaccgggctggccaaacttgctgagacggaaggaaaaggcgtgtttgacgaggccaagaagaccgtggaagctctgaacgggtatctcaataaacacaaggatgaggtcgacaaagccagcgccgactctatgatcacaaacctgcttaagcatattgctaaagcgcaagagctgtacaagaactccagcgccctcagagctcagggagcccagatcgataccgccttctcctcttactattggctgtacaaggctggcgtgacacctgaaacctttccgacggttagccagttcctgttcgagctcggcaaacaaccccgggggacaaagaaaatgaagaaagccctgctttccacccctctgaagtggggaaagaaactctatgaactgtttgcggacgatagcttccagcagaatcgcatctacatgcaccccgctgtgcttacagccggcagaatttctgagatgggggtctgctttggaaccatccctgtggccaaccccgacgatgctgcccagggctccgggcataccaagagcattctgaatctccggacaaacacggaaaccaataacccgtgtcctaaaacaatcgttaagctgttcgagattcaaaagaccggatttaatatccaggacatggatatcgtggcttctgagcatctgctccaccagagcctggtcggcaagcaatcccccttccagaacgcctataatgtgaagggcaacgcgacatctgccaatattatctga

SEQ ID NO: 7393 - RNA, 1449 nt, synthetic construct
  misc_feature 1..1449: note = derived and/or modified CDS sequence (opt5) from CCHFV(79121M18)__GU477494.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagcggggccttgaatggtttgagaaaaatgccgggaccatcaagtcttgggacgaaagctatacagagctgaaagttgaggtgccgaagattgaacagctcgctgattaccagcaggccgcgctgaaatggcgcaaggacatcggattcagagtcaacgccaataccacagctctttcccacaaggtgctggccgagtataaagttcccggcgaaatcgtgatgagcgtcaaggagatgctctctgatatgattcggcgcagaaacctgatcctgaatcgcgggggagacgaatcccctcggggccccgtgagcagagagcacgtggagtggtgtcgggaatttgtcaaaggcaagtacattatggctttcaaccctccctggggagatatcaataaatctgggcgctccggcattgccctcgttgcgaccgggctggccaaacttgctgagacggaaggaaaaggcgtgtttgacgaggccaagaagaccgtggaagctctgaacgggtatctcaataaacacaaggatgaggtcgacaaagccagcgccgactctatgatcacaaacctgcttaagcatattgctaaagcgcaagagctgtacaagaactccagcgccctcagagctcagggagcccagatcgataccgccttctcctcttactattggctgtacaaggctggcgtgacacctgaaacctttccgacggttagccagttcctgttcgagctcggcaaacaaccccgggggacaaagaaaatgaagaaagccctgctttccacccctctgaagtggggaaagaaactctatgaactgtttgcggacgatagcttccagcagaatcgcatctacatgcaccccgctgtgcttacagccggcagaatttctgagatgggggtctgctttggaaccatccctgtggccaaccccgacgatgctgcccagggctccgggcataccaagagcattctgaatctccggacaaacacggaaaccaataacccgtgtgctaaaacaatcgttaagctgttcgagattcaaaagaccggatttaatatccaggacatggatatcgtggcctctgagcatctgctccaccagagcctggtcggcaagcaatcccctttccagaacgcgtataatgtgaagggcaacgccacatctgctaatattatctga

SEQ ID NO: 7394 - RNA, 1449 nt, synthetic construct
  misc_feature 1..1449: note = derived and/or modified CDS sequence (opt5) from CCHFV(AP92)__DQ211638.1__N
  source 1..1449: mol_type = other RNA
atggagaacaagatcgaagtgaatagcaaagacgatctgaacaagtggttcgaggaatttaaaaagggcaatgggctcgtcgacaccttcacaaactcctactctttttgcgagaatgttcccaacctggatagattcgtgtatcagatggccagcgctacggacgatgcccaaaaagactccatttacgcgtctgctcttgtggaagccaccaagtattgtgcccctatctacgagtgcgcttgggtcagctccacaggaattgtgaagaaaggcctggagtggtttgaaaagaatacctctacaatcaaaagctgggatgagtcctataccgaactcaaggttgacattccgaaaatcgagcagctgagctcttaccagcaggccgctcttaagtggcggaaggatatcgggttccgcattaacgccaatacaaccgcgctgtccaacaaagtgctcgccgagtataaggtccccggagaaatcctggtgcctgttaaagagatgctgagcgacatgattagacggcgcaatatcattctcaacagaggctctgatgaaaatccccgggggcctgtgtcccacgagcatatcgaatggtgtcgcgagtttattaagggaaaatacatcatggctttcaatcccccttggggcgacatcaacaagagcggcagatctgggattgccctggtcgctacgggacttgccaaactggcggagaccgaaggcaagggggtgtttgaggaagccaagaaaacagtggaggctctcaaggattacctggacaaacaccgggacgaagtcgataagacctccgccgacaacatggttacaagccttctgaaacatatcgctaaggcccaagagctctataagaactcctctgccctgcgcgctcagggagcgcagattgataccccgttcagctccttttactggctgtataaagccggcgtgacgcccgagacattccctaccgtgagccagtttctcttcgaactggggaagcaacccagaggaaccaaaaagatgaaaaaggctctgctgtctacacctatgaagtggggcaaaaagctctacgagctgttcgccgacgattcctttcagcagaatcggatctatatgcaccccgccgtccttaccgctggccgcattagcgaaatgggggtgtgcttcggaacaatcccggttgccaaccctgacgatgcggctcagggctctgggcatacgaaaagcatcctgaatctcagaaccaacacagagtccaataacccctgtgcccggaccattgtgaagctgtttgaaatccagaaaacaggattcgacattaaggatatggacatcgtcgcctctgagcaccttctccaccaaagcctggtgggcaagcagtccccttttcaaaatgcttacaacgttaaagggaatgccaccagcgctaacattatctga

SEQ ID NO: 7395 - RNA, 1449 nt, synthetic construct
  misc_feature 1..1449: note = derived and/or modified CDS sequence (opt5) from CCHFV(ArD15786)__DQ211640.1__N
  source 1..1449: mol_type = other RNA
atggagaacaagatcgaagtgaataacaaagacgagctgaataagtggttcgaagagtttaaaaagggcaacgggctcgtcgataccttcacaaatagctactccttttgcgaaaacgttcccaatctggacagattcgtgtttcagatggccggagctacggatgacgcccaaaaagattctatttatgcgagcgctcttgtggaggccaccaagtactgtgcccctatctatgagtgcgcttgggtctcctctacaggcattgtgaagcgggggctggaatggttcgagaaaaacaccggaacaatcaagagctgggacgaatcctacaccgagctcaaagttgatgtgccgaagattgagcagctggccaattatcagcaggctgcccttaaatggcgcaaggacatcggctttagagtcaacgcgaatacagccgctctgtctaacaaggtgctcagcgaatacaaagttcccggggagatcgtgatgtccgtcaaggaaatgctgagcgatatgattcggcgcagaaatctgatcctcaaccggggaggcgacgagaatcctcgcggccccgtgtctaaagaacacattgagtggtgtagagagttcgtgaaggggaaatatatcatggcctttaaccctccctggggagatgtcaacaagtccggccggagcgggattgctctggttgccaccggacttgcgaaactggccgaaacggagggcaagggggtgttcgaagaggctaagaaaaccgtggaagccctcaaggagtacctggacaaacataaggatgaggtcgacaaggcttctgccgactccatggtgacaaatcttctgaaacacatcaccaaggcccaagaactctacaaaaacagctctgctctgcgcgcgcagggagcccagattgatacacctttttccagcttctattggctgtacaaggctggcgttaccccggagacgtttcccacagtgtcccagttcctcttcgaactgggcaaacaacctagagggaccaagaaaatgaagaaggcccttctgtctacacccatgaaatggggaaagaaactctatgagctgtttgccgacgatagcttccagcagaatcggatctacatgcatcctgctgtccttaccgccggccgcatctccgaaatgggggtgtgctttggaaccattcccgttgcgaacccggacgatgctgcccagggcagcgggcacacaaagtctatcctgaatctcagaacgaactccgagaccaataacccttgtgccaaaacaattgtgaagctgttcgaggtccaaaagaccggatttaatatccaggacatggatattgtggctagcgaacatctgctccaccagtctctggtcggcaaacaaagccccttccagaacgcctataatgtgaagggcaacgctacatccgccaatatcatctga

SEQ ID NO: 7396 - RNA, 1449 nt, synthetic construct
  misc_feature 1..1449: note = derived and/or modified CDS sequence (opt5) from CCHFV(ArD39554)__DQ211641.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggccagcgctacggatgacgcccaaaaggattccatttatgcgtctgctctggtggaggccaccaagttctgtgcccctatctacgagtgcgcttgggtcagctccacaggaattgtgaaaagaggccttgaatggtttgagaagaatgccgggaccatcaaatcttgggacgaaagctatacagagctgaaggttgatgtgccgaaaattgagcagctcgctaactaccagcaggccgcgctgaagtggcggaaggacatcggattccgcgtcaatgccaacaccgctgccctttccaataaagtgctggctgaatataaggttcccggcgagatcgtgatgagcgtcaaagaaatgctctctgatatgattagacggcgcaaccaaatcctgaatagagggggagacgagaaccctcggggccccgtgtcccgcgaacacgtggattggtgtagagagtttgtcaagggcaaatacattatggccttcaatcctccctggggagacatcaacaagagcgggcggtctggcattgcgctggttgccacagggctcgctaaactggccgagaccgaaggaaagggcgtgtttgatgaggctaagaaaacggtggaagcccttaacgggtatctggacaagcataaagacgaggtcgataaggcctccgctgacagcatgatcaccaatctcctgaaacacattgcgaaggcccaggaactttacaagaactcttccgctctgcgcgcccagggagcccagatcgatacagctttcagctcctactattggctctacaaagccggcgtgacccctgagacatttccgaccgtttctcaattcctgttcgagctgggcaagcagcccagagggacgaaaaagatgaaaaaggcgctcctgacaacccctatgaagtggggaaagaaactttatgaactgtttgctgacgatagcttccagcagaatcggatctacatgcatcccgccgtgctcacagccggccgcatttccgagatgggggtctgctttggaaccatccctgtggctaaccccgacgatgccgctcaaggcagcgggcacaccaaatctattctgaatcttagaacaaacacggaaaccaataacccgtgtgcccggacaatcgttaagctgttcgagattcagaaaaccggatttaatatccaggacatggatatcgtggcgtccgaacatctcctgcaccaaagcctggtcggcaagcagtctcctttccagaacgcctataatgtgaagggcaacgctacaagcgccaatattatctga

SEQ ID NO: 7397 - RNA, 1449 nt, synthetic construct
  misc_feature 1..1449: note = derived and/or modified CDS sequence (opt5) from CCHFV(BT958)__EF123122.1__N
  source 1..1449: mol_type = other RNA
atggagaacaagatcgaagtgaataacaaagacgagatgaatagatggttcgaagagtttaagaaagaaaacggcctggtcgataccttcacaaatagccactccttttgcgagtctgttcccaacctcgacaagttcgtgtttcagatggccagcgctacggatgacgcccaaaaagattccatttacgcggctgccctggtggaggccaccaagttctgtgctcctatctatgaatgcgcctgggtctctagcacagggattgtgaagaaaggacttgagtggtttgaaaagaatgctggcaccatcaaatcctgggacgagtcttacacagagctgaaggttgaagtgccgaaaattgagcagctcagcaactatcagcaggccgcgctgaagtggcggaaggatatcgggttccgcgtcaatgccaacaccgctacactttcccataaagtgctggccgaatacaaggttcccggagagatcgtgatgagcgtcaaagaaatgctctctgacatgattagacggcgcaatctgatcctgaacagaggcggggatgagaatcctcggggacccgtgtcccgcgagcacgtggaatggtgtagagagtttgtcaagggcaaatatattatggctttcaaccctccctggggcgacatcaataagagcgggcggtctggaattgccctcgttgcgaccggcctggccaaacttgctgaagccgaggggaagggagtgtttgatgaagctaagaaaacggtggaggccctgaacggctacctcgacaagcataaagatgaggtcgacaagtccagcgccgactctatgatcaccaacctgcttaaacacattgctaaggcgcaagaactgtatcgcaattccagcgccctcagagctcagggggcccagatcgatacagccttctcctcttactactggctgtataaggctggagtgacccctgagacatttccgaccgttagccagttcctgttcgaactcggcaaacaaccccggggcacgaagaaaatgaagaaagccctgctttccacacctatgaagtgggggaagaaactgtacgagctctttgcggacgatagcttccagcagaaccgcatctatatgcatcccgctgtgctgaccgccggaagaatttctgaaatgggcgtctgctttgggacaatccctgtggccaatcccgacgatgctgcccttggatccggccacaccaagagcattctgaacctccggacctctacagaggctaataacccgtgtgccaaaacgatcgttaagctgttcgagattcagaaaaaggggtttgtgatcaaggacatggatatcgtcgcgagcgaacatctgctccaccaatccctggtgggaaaacagtctcctttccagaatgcctacaacgtcaagggcaatgctaccagcgccaacattatctga

SEQ ID NO: 7398 - RNA, 1449 nt, synthetic construct
  misc_feature 1..1449: note = derived and/or modified CDS sequence (opt5) from CCHFV(C-68031)__DQ211642.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgagagattcgtgtttcagatggccagcgctacggacgatgcccaaaaagactccatttatgcgtctgctctggtggaggccaccaagttctgtgcccctatctacgaatgcgcttgggtcagctccacaggaattgtgaagaaaggccttgagtggtttgaaaagaatgccgggaccatcaaatcttgggatgagagctatattgagctgaaggttgaagtgccgaaaatcgagcagctcgctaactaccagcaggccgcgctgaagtggcggaaggacatcggattccgcgtcaatgccaacacagctgccctttcccacaaagtgctggctgaatataaggttcccggcgagattgtgatgagcgtcaaagaaatgctctctgatatgatcagacggcgcaatctgattctgaacagagggggagacgagaatcctcggggccccgtgtcccgcgagcacgtggaatggtgtagagagtttgtcaagggcaaatacatcatggccttcaaccctccctggggagatattaataagagcggacggtctggcatcgcgctcgttgccaccgggctggctaaacttgccgaaacagagggaaagggcgtgtttgacgaagctaagaaaaccgtggaggccctgaacgggtatctcgataagcacaaagacgaggtcgataaggcctccgctgacaacatgattacgaatctgcttaaacatatcgcgaaggcccaagaactgtacaagaacagctctgctctccgcgcccagggagcccagatcgacaccgctttctccagctactattggctgtacaaagccggcgtgacacctgagacctttccgacagtttcccagttcctgttcgaactcggcaagcaacccagagggaccaaaaagatgaaaaaggcgctgctttctacgcctatgaagtgggggaaaaagctgtatgagctctttgctgatgacagcttccagcagaatcggatttacatgcaccccgccgtgctgacagccggccgcatctccgaaatgggggtctgctttggaaccattcctgtggctaaccccgatgacgccgctcagggcagcgggcatacaaaatctatccttaatctgagaaccaacaccgagacaaataacccgtgtgccaagacgattgttaaactcttcgagatccaaaagaccggatttaatatccaggatatggacattgtggcgtccgaacatctgctgcaccagagcctcgtcggcaagcaatctcctttccagaacgcctataatgtgaaaggcaacgctacaagcgccaatatcatttga

SEQ ID NO: 7399 - RNA, 1449 nt, synthetic construct
  misc_feature 1..1449: note = derived and/or modified CDS sequence (opt5) from CCHFV(China)__AF354296.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgagagattcgtgtttcagatggccagcgctacggacgatgcccaaaaagactccatttatgcgtctgctctggtggaggccaccaagttctgtgcccctatctacgaatgcgcttgggtcagctccacaggaattgtgaagaaaggccttgagtggtttgaaaagaatgccgggaccatcaaatcttgggatgagagctatacagagctgaaggttgaagtgccgaaaattgagcagctcgctaactaccagcaggccgcgctgaagtggcggaaggacatcggattccgcgtcaatgccaacaccgctgccctttcccacaaagtgctggctgaatataaggttcccggcgagatcgtgatgagcgtcaaagaaatgctctctgatatgattagacggcgcaatctgatcctgaactccgggggagacgagaatcctagaggccccgtgagccgggagcacgtggaatggtgtcgcgagtttgtcaagggcaaatacattatggccttcaaccctccctggggagatatcaataagtctgggagatccggcattgcgctcgttgccacagggctggctaaacttgccgaaaccggaggcaagggggtgtttgacgaggctaagaaaacggtggaagccctgaacggatatctcgataagcacaaagacgaggtcgataaggccagcgctgacaacatgatcaccaatctgcttaaacatattgcgaaggcccaagagctgtacaagaactcttccgctctccgggcccagggcgcccagatcgacacagctttcagctcctactattggctgtacaaagccggcgcgacccctgaaacatttccgaccgtgtctcagttcctgttcgagctcgggaagcaaccccgcggaacgaaaaagatgaaaaaggctctgcttagcacacctatgaagtggggcaaaaagctgtatgaactctttgccgatgactccttccagcagaatagaatctacatgcaccccgccgttctgaccgctgggcggattagcgagatgggagtgtgctttggcacaatccctgtcgccaaccccgatgacgctgcccaggggtctggacataccaaatccattcttaatctgcgcaccaacacagaaacgaataacccgtgtgcgaagaccatcgtgagactcttcgagattcagaaaacaggctttaatatccaagatatggacatcgttgccagcgagcatctgctgcaccagtctctcgtgggcaagcaaagccctttccagaacgcttataatgtcaaggggaacgccacctccgctaatattatctga

SEQ ID NO: 7400 - RNA, 1449 nt, synthetic construct
  misc_feature 1..1449: note = derived and/or modified CDS sequence (opt5) from CCHFV(China)__AF358784.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagcggggccttgaatggtttgagaaaaatgccgggaccatcaagtcttgggacgaaagctatacagagctgaaagttgaggtgccgaagattgaacagttcgctgattaccagcaggccgcgctcaaatggcgcaaggacatcggatttagagtcaacgccaataccacagctctgtcccacaaggtgcttgccgagtataaagttcccggcgaaatcgtgatgagcgtcaaggagatgctgtctgatatgattcggcgcagaaacctcatcctgaatcgcgggggagacgaatcccctcggggccccgtgagcagagagcacgtggagtggtgtcgggagttcgtcaaaggcaagtacattatggcttttaaccctccctggggagatatcaataaatctgggcgctccggcattgccctggttgcgaccgggctcgccaagctggctgaaacggaaggaaaaggcgtgttcgacgaggccaagaagaccgtggaagctcttaacgggtatctgaataaacacaaggatgaggtcgacaaagccagcgccgactctatgatcacaaacctcctgaagcatattgctaaagcgcaagagctttacaagaactccagcgccctgagagctcagggagcccagatcgataccgccttttcctcttactattggctctacaaggctggcgtgacacctgaaaccttcccgacggttagccagttcctgtttgagctgggcaaacaaccccgggggacaaagaaaatgaagaaagccctcctgtccacccctcttaagtggggaaagaaactgtatgaactcttcgcggacgatagctttcagcagaatcgcatctacatgcaccccgctgtgctgacagccggcagaatttctgagatgggggtctgcttcggaaccatccctgtggccaaccccgacgatgctgcccagggctccgggcataccaagagcattcttaatctgcggacaaacacggaaaccaataacccgtgtgctaaaacaatcgttaagctctttgagattcagaaaaccggattcaatatccaagacatggatatcgtggcctctgagcatctgctgcaccagagcctcgtcggcaagcaatccccttttcagaacgcgtataatgtgaagggcaacgccacatctgctaatattatctga

SEQ ID NO: 7401 - RNA, 1449 nt, synthetic construct
  misc_feature 1..1449: note = derived and/or modified CDS sequence (opt5) from CCHFV(China)__AF362080.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgagagattcgtgtttcagatggccagcgctacggacgatgcccaaaaagactccatttatgcgtctgctctggtggaggccaccaagttctgtgcccctatctacgaatgcgcttgggtcagctccacaggaattgtgaagaaaggccttgagtggtttgaaaagaatgccgggaccatcaaatcttgggatgagagctatacagagctgaaggttgaagtgccgaaaattgagcagctcaccaactaccagcaggctgccctgaagtggcggaaggacatcggattccgcgtcaatgcgaacacagccgctctttcccacaaagtgctggccgaatataaggttcccggcgagatcgtgatgagcgtcaaagaaatgctctctgatatgattagacggcgcaatctgatcctgaacagagggggagacgagaatcctcggggccccgtgtcccgcgagcatgtggaatggtgtagagagtttgtcaagggcacctacattatggctttcaaccctccctggggagatatcaataaaagcgggcggtctggcattgccctcgttgcgacggggctggccaagctggctgaaaccgagggaaaaggcgtgtttgacgaagccaagaagacagtggaggctctgaacgggtatctcgataaacacaaggacgaggtcgataaagcctccgccgacaacatgatcaccaatctgcttaagcatattgctaaagcgcaagaactgtacaagaacagctctgccctccgcgctcagggagcccagatcgacacagccttctccagctactattggctgtacaaggctggcgtgacccctgagacgtttccgacagtttcccagttcctgttcgaactcggcaaacaacccagagggaccaagaaaatgaagaaagccctgctttctacacctatgaagtggggaaagaaactgtatgagctctttgcggatgacagcttccagcagaatcggatctacatgcaccccgctgtgctgaccgccggccgcatttccgaaatgggggtctgctttggaaccatccctgtggccaaccccgatgacgctgcccagggcagcgggcatacaaagtctattcttaatctgagaacgaacaccgagacaaataacccgtgtgctaaaaccatcgttaaactcttcgagattcaaaagacaggatttaatatccaggatatggacatcgtggcctccgaacaccttctgcaccagagcctcgtcggcaagcaatctcctttccagaacgcgtataatgtgaagggcaacgccaccagcgctaatattatctga

SEQ ID NO: 7402 - RNA, 1449 nt, synthetic construct
  misc_feature 1..1449: note = derived and/or modified CDS sequence (opt5) from CCHFV(China)__AY029157.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgagagattcgtgtttcagatggccagcgctacggacgatgcccaaaaagactccatttatgcgtctgctctggtggaggccaccaagttctgtgcccctatctacgaatgcgcttgggtcagctccacaggaattgtgaagaaaggccttgagtggtttgaaaagaatgccgggaccatcaaatcttgggatgagagctatacagagctgaaggttgaagtgccgaaaattgagcagctcgctaactaccagcaggccgcgctgaagtggcggaaggacatcggattccgcgtcaatgccaacaccgctgccctttcccacaaagtgctggctgaatataaggttcccggcgagatcgtgatgagcgtcaaagaaatgctctctgatatgattagacggcgcaatctgatcctgaacagagggggagacgagaatcctcggggccccgtgtcccgcgagcacgtggaatggtgtagagagtttgtcaagggcaaatacattatggccttcaaccctccctggggagatatcaataagagcggacggtctggcattgcgctcgttgccacagggctggctaaacttgccgaaaccgagggaaagggcgtgtttgacgaagctaagaaaacggtggaggccctgaacgggtatctcgataagcacaaagacgaggtcgataaggcctccgctgacaacatgatcaccaatctgcttaaacatattgcgaaggcccaagaactgtacaagaacagctctgctctccgcgcccagggagcccagatcgacacagctttctccagctactattggctgtacaaagccggcgtgacccctgagacatttccgaccgtttcccagttcctgttcgaactcggcaagcaacccagagggacgaaaaagatgaaaaaggcgctgctttctacacctatgaagtgggggaaaaagctgtatgagctctttgctgatgacagcttccagcagaatcggatctacatgcaccccgccgtgctgaccgccggccgcatttccgaaatgggggtctgctttggaacaatccctgtggctaaccccgatgacgccgctcagggcagcgggcataccaaatctattcttaatctgagaaccaacacagagacgaataacccgtgtgccaagaccatcgttaaactcttcgagattcaaaagacaggatttaatatccaggatatggacatcgtggcgtccgaacatctgctgcaccagagcctcgtcggcaagcaatctcctttccagaacgcctataatgtgaaaggcaacgctaccagcgccaatattatctga

SEQ ID NO: 7403 - RNA, 1449 nt, synthetic construct
  misc_feature 1..1449: note = derived and/or modified CDS sequence (opt5) from CCHFV(DAK 8194)__U88411.1__N
  source 1..1449: mol_type = other RNA
atggagaacaagatcgaagtgaataacaaagacgagctgaataagtggttcgaagagtttaaaaagggcaacgggctcgtcgataccttcacaaatagctactccttttgcgaaaacatgcccaatctggacagattcgtttttcagatggccggagctacggatgacgcccaaaaagattctatttatgcgagcgctcttgtggaggccaccaagtactgtgcccctatctatgagtgcgcttgggtgtcctctacaggcattgtcaagcgggggctggaatggttcgagaaaaacaccggaacaatcaagagctgggacgaatcctacaccgagctcaaagtggatgttccgaagattgagcagctggccaattatcagcaggctgcccttaaatggcgcaaggacatcggctttagagtgaacgcgaatacagccgctctgtctaacaaggtcctcagcgaatacaaagtgcccggggagatcgttatgtccgtgaaggaaatgctgagcgatatgattcggcgcagaaatctgatcctcaaccggggaggcgacgagaatcctcgcggccccgtctctaaagaacacattgagtggtgtagagagttcgtgaaggggaaatatatcatggcctttaaccctccctggggagatgtgaacaagtccggccggagcgggattgctctggtcgccaccggacttgcgaaactggccgaaacggagggcaagggggttttcgaagaggctaagaaaaccgtggaagccctcaaggagtacctggacaaacataaggatgaggtggacaaggcttctgccgactccatggtcacaaatcttctgaaacacatcaccaaggcccaagaactctacaaaaacagctctgctctgcgcgcgcagggagcccagattgatacacctttttccagcttctattggctgtacaaggctggcgtgaccccggagacgtttcccacagtttcccagttcctcttcgaactgggcaaacaacctagagggaccaagaaaatgaagaaggcccttctgtctacacccatgaaatggggaaagaaactctatgagctgtttgccgacgatagcttccagcagaatcggatctacatgcatcctgctgtgcttaccgccggccgcatctccgaaatgggggtctgctttggaaccattcccgtggcggacccggatgacgctgcccagggcagcgggcacacaaagtctatcctgaacctcagaacgtccagcgagaccaataacccttgtgccaaaacaattgttaagctgttcgaggtgcaaaagaccggatttaatatccaggatatggacattgtcgcttctgaacatctgctccaccagagcctggtgggcaaacaatcccccttccagaacgcctataatgtcaagggcaacgctacatctgccaatatcatctga

SEQ ID NO: 7404 - RNA, 1449 nt, synthetic construct
  misc_feature 1..1449: note = derived and/or modified CDS sequence (opt5) from CCHFV(Drosdov)__U88412.1__N
  source 1..1449: mol_type = other RNA
atggagaacaagatcgaagtgaatagcaaagacgagatgaacaagtggttcgaagagtttaaaaaggaaaatggcctgatggataccttcacaaactcctactctttttgcgagaatgtccccaacctcgacaaattcgtttttcagatggccagcgctacggatgacgcccaaaaggattccatttatgcgtctgctctggtggaggccaccaagttctgtgcccctatctacgaatgcgcttgggtgagctccacagggattgtcaaaaagggacttgagtggtttgagaaaaattctggcaccatcaagagctgggacgaaaactatacagagctgaaagtggatgttccgaagattgaacagctcgccaattaccagcaggctgccctgaagtggagaaaagacatcgggttccgggtgaacgcgaataccgccgctctttccaacaaggtcctggccgagtataaagtgcccggagaaatcgttatgagcgtgaaggagatgctctctgatatgattcgcagacggaatctgatcctgaaccgcggcggggacgaaaatcctagaggacccgtctcccgggagcacgtggagtggtgtcgcgaatttgtgaaaggcaagtacattatggctttcaaccctccctggggcgatatcaacaaaagcgggagatctggaattgccctcgtcgcgacaggcctggccaaacttgctgagaccgaagggaagggagtttttgacgaggccaagaagacggtggaagctctgaatggctatctcgataaacatcgggacgaggtggacaaggcctccgccgatagcatgatcaccaacctgcttaaacacattgctaaggcgcaagagctgtacaaaaattcttccgccctccgcgctcagggggcccagatcgacacacctttcagctccttttactggctgtataaggccggagtcaccccggaaacattccccaccatctctcagttcctgtttgagctcggcaagcaacctagaggcacgaaaaagatgaaaaaggctctgcttagcacacccatgaagtgggggaaaaagctgtacgaactcttcgccgatgactcctttcagcagaaccggatttatatgcatcctgcggtgctgaccgctggacgcatcagcgagatgggcgtttgcttcgggacaattcccgtggccaatccggatgacgccgctcagggatctggccacaccaaatccatccttaacctgagaaccagcacagaaacgaataacccttgtgccaagaccattgtcaaactctttgagatccaaaagacagggttcaatatccaggatatggacattgtggcttctgagcatctgctgcaccagagcctcgttggaaagcaatccccctttcagaacgcctacaatgtgaaaggcaacgcgacctctgccaatatcatttga

SEQ ID NO: 7405 - RNA, 1449 nt, synthetic construct
  misc_feature 1..1449: note = derived and/or modified CDS sequence (opt5) from CCHFV(Eskisehir23-2012)__KR092376.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaaaataccgggacaatcaagtcttgggacgaaaactatgccgagctgaaagtggatgttccgaagattgagcagctcgctaattaccagcaggccgcgctgaagtggagaaaagacatcggattccgggtgaacgccaataccgctgcccttagcaacaaggtcctggctgaatataaagtgcccggcgagatcgttatgtccgtgaaggaaatgctcagcgatatgattcgcagacggaatctgatcctgaaccgcgggggaggcgagaatcctagaggccccgtctctcgggaacacgtggagtggtgtcgcgagtttgtgaaagggaagtacattatggccttcaaccctccctggggagacatcaacaaatccggcagaagcgggattgcgctcgtcgccacaggactggctaaacttgccgaaaccgagggcaagggggtttttgatgaagctaaacggacggtggaggccctgaatggatatctcgacaagcatcgcgatgaagtggacaaagcctctgctgactccatgatcaccaacctgcttaagcacattgcgaaagcccaagagctgtacaagaatagctctgctctcagagcccagggcgcccagatcgatacacctttctccagcttttactggctgtataaggctggcgtcaccccggagacattccccaccatctcccagttcctgtttgaactcgggaaacaacctcggggaacgaagaaaatgaagaaagccctgctttctacacccatgaagtggggcaagaaactgtacgaactcttcgcggacgatagctttcagcagaaccgcatttatatgcatcctgctgtgctgaccgccgggagaatctccgagatgggagtttgcttcggcacaattcccgtggccaatccggacgatgctgcccaggggagcggacacaccaagtctatccttaacctgcggacctccacagagacgaataacccttgtgctaaaaccattgtcaagctctttgaaatccaaaagacaggcttcaatatccaggacatggatattgtggccagcgagcatctgctgcaccagtctctcgttggcaagcaaagcccctttcagaacgcgtacaatgtgaaggggaacgccacctccgctaatatcatttga

SEQ ID NO: 7406 - RNA, 1449 nt, synthetic construct
  misc_feature 1..1449: note = derived and/or modified CDS sequence (opt5) from CCHFV(Hodzha)__AY223475.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagaaaggccttgaatggtttgagaagaatgccgggaccatcaaatcttgggacgaaagctatacagagctgaaggttgaggtgccgaaaattgaacagctcgctaactaccagcaggccgcgctgaagtggcggaaggatatcggattccgcgtcaatgccaacaccgctgccctttcccacaaagtgctgagcgagtataaggttcccggcgaaatcgtgatgtctgtcaaagagatgctctccgacatgattagacggcgcaatctgatcctgaacagagggggagatgaaaatcctcggggccccgtgagccgcgagcacgtggagtggtgtagagaatttgtcaagggcaaatacattatggctttcaaccctccctggggagacatcaataagtctggacggtccggcattgccctcgttgcgacagggctggccaaacttgctgagaccgaaggaaagggcgtgtttgatgaggccaagaaaacggtggaagctctgaacgggtatctcgacaagcacaaagatgaggtcgacaaggccagcgccgacaacatgaccacaaatctgcttaaacatatcgctaaggcgcaagagctgtacaagaactcttccgccctccgcgctcagggagcccagattgataccgccttcagctcctactattggctgtacaaagctggcgtgacacctgaaacctttccgacggtttctcagttcctgttcgagctcggcaagcaacccagagggaccaaaaagatgaaaaaggccctgcttagcacacctatgaagtgggggaaaaagctgtatgaactctttgcggacgattccttccagcagaatcggatctacatgcaccccgctgtgctgacagccggccgcatcagcgagatgggggtctgctttggaaccgtgcctgttgccgaccccgatgacgctgcccagggctctgggcataccaaatccattcttaacctgagaacaaatacggaaaccaacaatccgtgtgctaagacaatcgtgaaactcttcgagattcaaaagaccggatttaacatccaggatatggacattgtcgccagcgagcatctgctgcaccagtctctcgtgggcaagcaaagccctttccagaatgcgtataacgtcaaaggcaatgccacatccgctaacatcatctga

SEQ ID NO: 7407 - RNA, 1449 nt, synthetic construct
  misc_feature 1..1449: note = derived and/or modified CDS sequence (opt5) from CCHFV(Iran-52)__DQ446212.1__N
  source 1..1449: mol_type = other RNA
atggagaacaagatcgaagtgaatagcaaagacgagatgaacaagtggttcgaagagtttaaaaagggcaatgggctggtcgataccttcacaaactcctactctttttgcgaaagcgttcccaatctcgacagattcgtgtttcagatggcctccgctacggatgacgcccaaaaagattctatttatgcgagcgctctggtggaggccaccaagttctgtgcccctatctacgagtgcgcttgggcctcctctacaggaattgtcaagaaaggccttgaatggtttgagaagaacgctgggaccatcaaaagctgggacgaatcctatacagagctgaaggtggaggttccgaaaattgaacagctcagcaattaccagcaggccgcgctgaagtggcggaaggatatcggattccgcgtgaacgccaataccgctgccctttctaacaaagtcctggctgagtataaggtgcccggcgaaatcgttatgtccgtgaaagagatgctcagcgacatgattagacggcgcaatctgatcctgaacagagggggagatgaaaatcctcggggccccgtctctcgcgagcacgtggagtggtgtagagaatttgtgaagggcaaatacattatggccttcaaccctccctggggagacatcaataagtccggacggagcggcattgcgctcgtcgccacagggctggctaaacttgccgagaccgaaggaaagggcgtttttgatgaggctaagaaaacggtggaagccctgaacgggtatctcgacaagcataaagatgaggtggacaaggcctctgctgactccatgatcaccaacctgcttaaacacattgcgaaggcccaagagctgtacaagaatagctccgctctccgcgcccagggagcccagatcgatacagtcttctctagctactattggctgtacaaagctggcgtgacccctgacacatttccgaccgtttcccagttcctgttcgaactcggcaagcaacccagagggacgaaaaagatgaaaaaggccctgcttagcacacctatgaagtgggggaaaaagctgtatgagctctttgcggatgactctttccagcagaaccggatctacatgcatcccgctgtgctgaccgccggccgcatttccgaaatgggggtctgctttggaacaatccctgtggccaatcccgatgacgctgcccttggcagcgggcacaccaaatctattctgaacctcagaaccaatacagagacgaacaatccgtgtgctcggaccatcgttaagctgttcgaaattcagaaaacaggatttaacatccaagatatggacatcgtggccagcgagcatctgctccaccagtccctggtcggcaagcagtctcctttccaaaatgcgtataacgtgaagggcaatgccaccagcgctaacattatctga

SEQ ID NO: 7408 - RNA, 1449 nt, synthetic construct
  misc_feature 1..1449: note = derived and/or modified CDS sequence (opt5) from CCHFV(Iran-53)__DQ446213.1__N
  source 1..1449: mol_type = other RNA
atggagaacaagatcgaagtgaatagcaaagacgagatgaacaagtggttcgaagagtttaaaaagggcaatgggctggtcgataccttcacaaactcctactctttttgcgaaagcgttcccaatctcgacagattcgtgtttcagatggcctccgctacggatgacgcccaaaaagattctatttatgcgagcgctctggtggaggccaccaagttctgtgcccctatctacgagtgcgcttgggcctcctctacaggaattgtcaagaaaggccttgaatggtttgagaagaacgctgggaccatcaaaagctgggacgaatcctatacagagctgaaggtggaggttccgaaaattgaacagctcagcaattaccagcaggccgcgctgaagtggcggaaggatatcggattccgcgtgaacgccaataccgctgccctttctaacaaagtcctggctgagtataaggtgcccggcgaaatcgttatgtccgtgaaagagatgctcagcgacatgattagacggcgcaatctgatcctgaacaaagggggagatgaaaatcctagaggccccgtctctcgggagcacgtggagtggtgtcgcgaatttgtgaagggcaagtacattatggccttcaaccctccctggggagacatcaataaatccgggagaagcggcattgcgctcgtcgccacagggctggctaaacttgccgagaccgaaggaaagggcgtttttgatgaggctaagaagacggtggaagccctgaacgggtatctcgacaaacataaggatgaggtggacaaagcctctgctgactccatgatcaccaacctgcttaagcacattgcgaaggcccaagagctgtacaaaaatagctccgctctccgggcccagggagcccagatcgatacagtcttctctagctactattggctgtacaaggctggcgtgacccctgacacatttccgaccgtttcccagttcctgttcgaactcggcaaacaaccccgcgggacgaagaaaatgaagaaggccctgcttagcacacctatgaaatggggaaagaaactgtatgagctctttgcggatgactctttccagcagaacagaatctacatgcatcccgctgtgctgaccgccggccggatttccgaaatgggggtctgctttggaacaatccctgtggccaatcccgatgacgctgcccttggcagcgggcacaccaagtctattctgaacctccgcaccaatacagagacgaacaatccgtgtgctagaaccatcgttaaactgttcgaaattcagaagacaggatttaacatccaagatatggacatcgtggccagcgagcatctgctccaccagtccctggtcggcaagcagtctcctttccaaaatgcgtataacgtgaaaggcaatgccaccagcgctaacattatctga

SEQ ID NO: 7409 - RNA, 1449 nt, synthetic construct
  misc_feature 1..1449: note = derived and/or modified CDS sequence (opt5) from CCHFV(JD 206)__U88414.1__N
  source 1..1449: mol_type = other RNA
atggagaacaagatcgaagtgaatagcaaagacgagatgaacaagtggttcgaagagtttaaaaagggcaatgggctggtcgataccttcacaaactcctactctttttgcgaaaatgttcccaacctcgacagattcgtgtttcagatggccagcgctacggatgacgcccaaaaagattccatttatgcgtctgctctggtggaggccaccaagttctgtgcccctatctacgagtgcgcttgggccagctccacaggaattgtcaagaaaggccttgaatggtttgagaagaatgctgggaccatcaaatcttgggacgaaagctatacagagctgaaggtggaggttccgaaaattgaacagctctccaactaccagcaggccgcgctgaagtggcggaaggatatcggattccgcgtgaatgccaacaccgctgcccttagcaataaagtcctggctgagtataaggtgcccggcgaaatcgttatgtctgtgaaagagatgctctccgacatgattagacggcgcaacctgatcctgaatagagggggagatgaaaaccctcggggccccgtcagccgcgagcacgtggagtggtgtagagaatttgtgaagggcatgtacattatggccttcaatcctccctggggagacatcaacaaatctgggcggtccggcattgcgctcgtcgccacagggctggctaaacttgccgagaccgaaggaaagggcgtttttgatgaggctaagaagacggtggaagccctgaacgggtatctcgacaaacataaggatgaggtggacaaagccagcgctgactctatgatcaccaatctgcttaagcacattgcgaaagcccaagagctgtacaagaactccagcgctctccgcgcccagggagcccagatcgatacagtcttctcctcttactattggctgtacaaggctggcgtgacccctgacacatttccgaccgttagccagttcctgttcgaactcggcaaacaacccagagggacgaagaaaatgaagaaagccctgctttccacacctatgaagtggggaaagaaactgtatgagctctttgcggatgacagcttccagcagaatcggatctacatgcatcccgctgtgctgaccgccggccgcatttctgaaatgggggtctgctttggaacaatccctgtggccaaccccgatgacgctgcccttggctccgggcacaccaagagcattctgaatctcagaaccaacacagagacgaataacccgtgtgctaaaaccatcgttaagctgttcgaaattcagaaaacaggatttaatatccaagatatggacatcgtggcctctgagcatctgctccaccagagcctggtcggcaagcagtcccctttccaaaacgcgtataatgtgaagggcaacgccacctctgctaatattatctga

SEQ ID NO: 7410 - RNA, 1449 nt, synthetic construct
  misc_feature 1..1449: note = derived and/or modified CDS sequence (opt5) from CCHFV(Kashmanov)__DQ211644.1__N
  source 1..1449: mol_type = other RNA
atggagaacaagatcgaagtgaatagcaaagacgagatgaacaagtggttcgaagagtttaaaaaggaaaatggcctgatggataccttcacaaactcctactctttttgcgagaatgtccccaacctcgacaaattcgtttttcagatggccagcgctacggatgacgcccaaaaggattccatttatgcgtctgctctggtggaggccaccaagttctgtgcccctatctacgaatgcgcttgggtgagctccacagggattgtcaaaaagggacttgagtggtttgagaaaaattctggcaccatcaagagctgggacgaaaactatgccgagctgaaagtggatgttccgaagattgaacagctcgctaattaccagcaggccgcgctgaagtggagaaaagacatcgggttccgggtgaacgccaatacagctgccctttccaacaaggtcctggctgagtataaagtgcccggagaaatcgttatgagcgtgaaggagatgctctctgatatgattcgcagacggaatctgatcctgaaccgcggcggggacgaaaatcctagaggacccgtctcccgggagcacgtggagtggtgtcgcgaatttgtgaaaggcaagtacattatggccttcaaccctccctggggcgatatcaacaaaagcgggagatctggaattgcgctcgtcgccaccggcctggctaaacttgccgagacagaagggaagggagtttttgacgaggctaagaagaccgtggaagccctgaatggctatctcgataaacatcgggacgaggtggacaaggcctccgctgatagcatgatcacgaacctgcttaaacacattgcgaaggcccaagagctgtacaaaaattcttccgctctccgcgcccagggggcccagatcgacacccctttcagctccttttactggctgtataaggctggagtcacaccggaaaccttccccacaatctctcagttcctgtttgagctcggcaagcaacctagaggcaccaaaaagatgaaaaaggccctgcttagcacgcccatgaagtgggggaaaaagctgtacgaactcttcgcggatgactcctttcagcagaaccggatttatatgcatcctgctgtgctgacagccggacgcatcagcgagatgggcgtttgcttcgggaccattcccgtggccaatccggatgacgctgcccagggatctggccacacaaaatccatccttaacctgagaaccagcaccgaaacaaataacccttgtgctaagacgattgtcaaactctttgagatccaaaagaccgggttcaatatccaggatatggacattgtggcctctgagcatctgctgcaccagagcctcgttggaaagcaatccccctttcagaacgcgtacaatgtgaaaggcaacgccacatctgctaatatcatttga

SEQ ID NO: 7411 - RNA, 1449 nt, synthetic construct
  misc_feature 1..1449: note = derived and/or modified CDS sequence (opt5) from CCHFV(NIV 10405051)__JF922681.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggtcagctccacaggaattgtgaagaaaggccttgaatggtttgagaagaatgccgggaccatcaaatcttgggacgaaagctatacagagctgaaggttgaggtgccgaaaattgaacagctcgctaactaccagcaggccgcgctgaagtggcggaaggatatcggattccgcgtcaatgccaacaccgctgccctttcccacaaagtgctggctgagtataaggttcccggcgaaatcgtgatgagcgtcaaagagatgctctctgacatgattagacggcgcaatctgatcctgaacagagggggagatgaaaatcctcggggccccgtgtcccgcgagcacgtggagtggtgtagagaatttgtcaagggcaaatacattatggccttcaaccctccctggggagacatcaataagagcgggcggtctggcattgcgctcgttgccacagggctggctaaacttgccgagaccgaaggaaagggcgtgtttgatgaggctaagaaaacggtggaagccctgaacgggtatctcgacaagcacaaagatgaggtcgacaaggcctccgctgacaacatgatcaccaatctgcttaaacatattgcgaaggcccaagagctgtacaagaacagctctgctctccgcgcccagggagcccagatcgatacagctttctccagctactattggctgtacaaagccggcgtgacccctgaaacatttccgaccgtttcccagttcctgttcgagctcggcaagcaacccagagggacgaaaaagatgaaaaaggcgctgctttctacacctatgcggtggggaaagaaactgtatgaactctttgctgacgatagcttccagcagaatcgcatctacatgcaccccgccgtgctgaccgccggcagaatttccgagatgggggtctgctttggaacaatccctgtggctaaccccgacgatgccgctcagggcagcgggcataccaagtctattcttaatctgcggaccaacacagaaacgaataacccgtgtgccaaaaccatcgttaaactcttcgagattcaaaagacaggatttaatatccaggacatcgatattgtggcgtccgagcatctgctgcaccagagcctcgtcggcaagcaatctcctttccagaacgcctataatgtgaagggcaacgctaccagcgccaatatcatttga

SEQ ID NO: 7412 - RNA, 1449 nt, synthetic construct
  misc_feature 1..1449: note = derived and/or modified CDS sequence (opt5) from CCHFV(Oman)__DQ211645.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggccagctccacaggaattgtcaagaaaggccttgaatggtttgagaagaatgctgggaccatcaaatcttgggacgaaagctatacagagctgaaggtggaggttccgaaaattgaacagctctccaactaccagcaggccgcgctgaagtggcggaaggatatcggattccgcgtgaatgccaacaccgctgcccttagcaataaagtcctggctgagtataaggtgcccggcgaaatcgttatgtctgtgaaagagatgctctccgacatgattagacggcgcaacctgatcctgaatagagggggagatgaaaaccctcggggccccgtcagccgcgagcacgtggagtggtgtagagaatttattaagggcaaatacatcatggccttcaatcctccctggggagacattaacaagtctggacggtccggcatcgcgctcgtggccacagggctggctaaacttgccgagaccgaaggaaagggcgtctttgatgaggctaagaaaacggttgaagccctgaacgggtatctcgacaagcataaagatgaggtggacaaggccagcgctgactctatgattaccaatctgcttaaacacatcgcgaaggcccaagagctgtacaagaactccagcgctctccgcgcccagggagcccagatcgatacagtgttctcctcttactattggctgtacaaagctggcgtcacccctgacacatttccgaccgtgagccagttcctgttcgaactcggcaagcaacccagagggacgaaaaagatgaaaaaggccctgctttccacacctatgaagtgggggaaaaagctgtatgagctctttgcggatgacagcttccagcagaatcggatttacatgcatcccgctgttctgaccgccggccgcatctctgaaatgggggtgtgctttggaacaattcctgtcgccaaccccgatgacgctgcccttggctccgggcacaccaaaagcatcctgaatctcagaaccaacacagagacgaataacccgtgtgctaagaccattgtgaaactgttcgaaatccagaagacaggatttaatatccaagatatggacattgttgcctctgagcatctgctccaccagagcctggtgggcaagcagtcccctttccaaaacgcgtataatgtcaaaggcaacgccacctctgctaatatcatttga

SEQ ID NO: 7413 - RNA, 1449 nt, synthetic construct
  misc_feature 1..1449: note = derived and/or modified CDS sequence (opt5) from CCHFV(SCT ex Afghanistan)__JX908640.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgacgcccaaaaagattccatttatgcgtctgctctggtggaggccaccaagttctgtgcccctatctacgagtgcgcttgggccagctccacaggaattgtcaagaaaggccttgaatggtttgagaagaatgctgggaccatcaaatcttgggacgaaagctatacagagctgaaggtggaggttccgaaaattgaacagctctccaactaccagcaggccgcgctgaagtggcggaaggatatcggattccgcgtgaatgccaacaccgctgcccttagcaataaagtcctggctgagtataaggtgcccggcgaaatcgttatgtctgtgaaagagatgctctccgacatgattagacggcgcaacctgatcctgaatagagggggagatgaaaaccctcggggccccgtcagccgcgagcacgtggagtggtgtagagaatttattaagggcaaatacatcatggccttcaatcctccctggggagacattaacaagtctggacggtccggcatcgcgctcgtggccacagggctggctaaacttgccgagaccgaaggaaagggcgtctttgatgaggctaagaaaacggttgaagccctgaacgggtatctcgacaagcataaagatgaggtggacaaggccagcgctgactctatgattaccaatctgcttaaacacatcgcgaaggcccaagagctgtacaagaactccagcgctctccgcgcccagggagcccagatcgatacagtgttctcctcttactattggctgtacaaagctggcgtcacccctgaaacatttccgaccgtgagccagttcctgttcgagctcggcaagcaacccagagggacgaaaaagatgaaaaaggccctgctttccacacctatgaagtgggggaaaaagctgtatgaactctttgcggacgatagcttccagcagaatcggatttacatgcatcccgctgttctgaccgccggccgcatctctgagatgggggtgtgctttggaacaattcctgtcgccaaccccgacgatgctgcccttggctccgggcacaccaaaagcatcctgaatctcagaaccaacacagaaacgaataacccgtgtgctaagaccattgtgaaactgttcgagatccagaagacaggatttaatatccaagacatggatattgttgcctctgagcatctgctccaccagagcctggtgggcaagcagtcccctttccaaaacgcgtataatgtcaaaggcaacgccacctctgctaatatcatttga

SEQ ID NO: 7414 - RNA, 1449 nt, synthetic construct
  misc_feature 1..1449: note = derived and/or modified CDS sequence (opt5) from CCHFV(Semunya)__DQ076413.1__N
  source 1..1449: mol_type = other RNA
atggagaacaagatcgaagtgaccagcaaagacgagatgaatagatggttcgaagagtttaagaaatccaacggcctggtcgatacattcaccaattcttacagcttttgcgaatccgttcccaacctcgaccggttcgtgtttcagatggcctctgctacggatgacgcccaaaaggatagcatttatgcgtccgctctggtggaggccacaaaattctgtgcccctatctacgagtgcgcttgggtctctagcaccgggattgtgaagaagggacttgaatggtttgagaaaaatgccggcacaatcaagtcctgggacgaaagctataccgagctgaaagttggggtgccgaagattgagcagctcgctaactaccagcaggccgcgctgaaatggcgcaaggatatcggattcagagtcaatgccaacacagctgccctttctaataaggtgctggctgaatataaagttcccggcgagatcgtgatgtccgtcaaggaaatgctcagcgacatgattcggcgcagaaacctgatcctgaatcgcgggggagatgagaaccctcggggccccgtgtctagagaacacgtggagtggtgtcgggagtttgtcaaaggcaagtacattatggccttcaatcctccctggggagacatcaacaaatccgggcgcagcggcattgcgctcgttgccaccgggctggctaagctcgccgaaacggagggaaaaggcgtgtttgatgaagctaagaagaccgtggaggccctgaatgggtatctcgacaaacataaggatgaagtcgacaaagcctctgctgacggaatggtgacaaacctgcttaagcacatcgcgaaagcccaagagctgtacaagaactccagcgctctcagagcccagggcgcccagattgatacccctttctcctctttttactggctgtataaggctggcgttagcccggagacattccccaccgtgtcccagttcctgtttgaactcgggaaacaacctcggggaacgaagaaaatgaagaaagccctgcttagcacacccatgaagtggggcaagaaactgtacgagcttttcgcggacgattcttttcaggaaaatcgcatctatatgcatcctgctgtcctgaccgccgggagaatctccgagatgggagtgtgcttcggcacaattcccgttgccaacccggacgatgctgcccaggggagcggacacaccaagtctatccttaatctgcggaccaacacagaaacgaataacccttgtgctaaaaccattgtgaagctctttgagatccagaaaacaggcttcaatattcaagacatggatatcgtcgccagcgagcatctgctgcaccagtccctcgtgggcaagcagtctccctttcaaaacgcgtacaatgtcaaggggaacgccaccagcgctaatatcatttga

SEQ ID NO: 7415 - RNA, 1449 nt, synthetic construct
  misc_feature 1..1449: note = derived and/or modified CDS sequence (opt5) from CCHFV(SK 2015/human)__KX129738.1__N
  source 1..1449: mol_type = other RNA
atggagaacaagatcgaagtgaataacaaagacgagatgaataagtggttcgaagagtttaaaaagggcaacgggctggtcgatacctacacaaatagctattccttctgcgaatctgttcccaacctcgacagatttgtgttccagatggccagcgctacggatgacgcccaaaaagattccatttacgcgtctgctctggtggaggccaccaagttttgtgcccctatctatgagtgcgcttgggccagctccacaggaattgtcaagaaaggccttgaatggttcgagaagaatgctgggaccatcaaactgtgggacgaatcttacgccgagctcaaggtggaggttccgaaaattgaacagctgagcaactatcagcaggcggcccttaagtggcggaaggatatcggatttcgcgtgaatgctaacacagccgctctgtccaataaagtcctcgccgagtacaaggtgcccggcgaaatcgttatgagcgtgaaagagatgctgtctgacatgattagacggcgcaacctgatcctcaatagagggggagatgaaaaccctcggggccccgtctcccgcgagcacgtggagtggtgtagagagttcgtgaagggcaaatatattatggcgtttaatcctccctggggagacatcaacaagagcggacggtctggcattgccctggtcgctaccgggcttgccaaactggctgaaacagaaggaaagggcgttttcgatgaggccaagaaaaccgtggaagccctcaacgggtacctggacaagcataaagatgaggtggacaaggcttccgcggacagcatgatcacgaatcttctgaaacacattgccaaggctcaagagctctacaagaactcttccgccctgcgcgcccagggagctcagatcgataccgtctttagctcctattactggctgtataaagccggcgtgacacctgacaccttcccgacagtttctcagtttctcttcgaactgggcaagcaacccagagggaccaaaaagatgaaaaaggcgcttctgagcacgcctatgaagtgggggaaaaagctctacgagctgttcgctgatgactcctttcagcagaatcggatctatatgcatcccgccgtgcttacagccggccgcattagcgaaatgggggtctgcttcggaaccgtgcctgttgctaaccccgatgacgccgctctgggctctgggcacacaaaatccatcctcaatctgagaaccaacaccgagacaaataacccgtgtgccaagacgattgtgaaactgtttgaaatccagaagaccggattcaatattcaagatatggacatcgtcgcgagcgagcatctcctgcaccagtctcttgtgggcaagcagagcccttttcaaaacgcctacaatgtcaaaggcaacgctacatccgccaatatcatttga

SEQ ID NO: 7416 - RNA, 1449 nt, synthetic construct
  misc_feature 1..1449: note = derived and/or modified CDS sequence (opt5) from CCHFV(SPU128/81/7)__DQ076415.1__N
  source 1..1449: mol_type = other RNA
atggagaacaagatcgaagtgaataacaaacacgagatgaataagtggttcgaagagtttaaaaagggcaacgggctggtcgacaccttcacaaatagctactccttttgcgaatctgttcccaacctcgataaattcgtgtttcagatggccagcgctacggacgatgcccaaaaggactccatttatgcgtctgctctggtggaggccaccaagttctgtgcccctatctacgagtgcgcttgggtcagctccacaggaattgtgaaaagaggccttgaatggtttgagaagaatgccgggaccatcaaatcttgggatgaaagctatacagagctgaaggttgacgtgccgaaaattgagcagctcgctaactaccagcaggccgcgctgaagtggcggaaggatatcggattccgcgtcaatgccaacaccgctgccctttccaataaagtgctggctgaatataaggttcccggcgagatcgtgatgagcgtcaaagaaatgctctctgacatgattagacggcgcaaccaaatcctgaatagagggggagatgagaaccctcggggccccgtgtcccgcgaacatgtggactggtgtagagagtttgtcaagggcaaatacattatggccttcaatcctccctggggagatatcaacaagagcgggcggtctggcattgcgctggttgccacagggctcgctaaactggccgagaccgaaggaaagggcgtgtttgacgaggctaagaaaacggtggaagtccttaacgggtatctggataagcacaaagacgaggtggaccgcgcctccgccgatagcatgatcaccaatctcctgaagcatattgctaaagcgcaggaactttacaagaactcttccgccctgagagctcagggagcccagatcgacacagccttcagctcctactattggctctacaaggctggcgttacccctgagacatttccgaccgtgtctcaattcctgttcgagctgggcaaacagccccgggggacgaagaaaatgaagaaagccctcctgagcacacctatgaagtggggaaagaaactttatgaactgtttgcggatgactccttccagcagaatcgcatctacatgcaccccgctgtcctcaccgccggcagaattagcgagatgggggtgtgctttggaacaatccctgttgccaaccccgatgacgctgcccaaggctctgggcataccaagtccattctgaatcttcggaccaacacagaaacgaataacccgtgtgctcgcaccatcgtgaaactgttcgagattcagaagacaggatttaatatccaggatatggacatcgtcgccagcgaacacctcctgcaccaatctctggtgggcaaacagagccctttccagaacgcgtataatgtcaagggcaacgccacctccgctaatattatctga

SEQ ID NO: 7417 - RNA, 1449 nt, synthetic construct
  misc_feature 1..1449: note = derived and/or modified CDS sequence (opt5) from CCHFV(Sudan Al-Fulah 4-2008)__GQ862372.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacaaattcgtgtttcagatggccagcgctacggatgacgcccaaaaggattccatttatgcgtctgctctggtggaggccaccaagttctgtgcccctatctacgagtgcgcttgggtcagctccacaggaattgtgaaaagaggccttgaatggtttgagaagaatgccgggaccatcaaatcttgggacgaaagctatacagagctgaaggttgatgtgccgaaaattgagcagctcgctaactaccagcaggccgcgctgaagtggcggaaggacatcggattccgcgtcaatgccaacaccgctgccctttccaataaagtgctggctgaatataaggttcccggcgagatcgtgatgagcgtcaaagaaatgctctctgatatgattagacggcgcaaccaaatcctgaatagagggggagacgagaaccctcggggccccgtgtcccgcgaacacgtggattggtgtagagagtttgtcaagggcaaatacattatggccttcaatcctccctggggagacatcaacaagagcgggcggtctggcattgcgctggttgccacagggctcgctaaactggccgagaccgaaggaaagggcgtgtttgatgaggctaagaaaacggtggaagcccttaacgggtatctggacaagcataaagacgaggtcgatcgcgcctccgctgacagcatgatcaccaatctcctgaagcacattgcgaaagcccaggaactttacaagaactcttccgctctgagagcccagggagcccagatcgatacagctttcagctcctactattggctctacaaggccggcgtgacccctgagacatttccgaccgtttctcaattcctgttcgagctgggcaaacagccccgggggacgaagaaaatgaagaaagcgctcctgagcacacctatgaagtggggaaagaaactttatgaactgtttgctgacgattccttccagcagaatcgcatctacatgcatcccgccgtgctcaccgccggcagaattagcgagatgggggtctgctttggaacaatccctgtggctaaccccgacgatgccgctcaaggctctgggcacaccaagtccattctgaatcttcggaccaacacagaaacgaataacccgtgtgcccgcaccatcgttaaactgttcgagattcagaagacaggatttagcatccaggacatggatatcgtggcgtctgaacatctcctgcaccaaagcctggtcggcaaacagtcccctttccagaatgcctataacgtgaagggcaatgctacctctgccaacattatctga

SEQ ID NO: 7418 - RNA, 1449 nt, synthetic construct
  misc_feature 1..1449: note = derived and/or modified CDS sequence (opt5) from CCHFV(TAJUK)__JN086996.1__N
  source 1..1449: mol_type = other RNA
atggagaacaagatcgaagtgaataacaaagacgagatgaataagtggttcgaagagtttaaaaagggcaacgggctggtcgataccttcacaaatagctactccttttgcgaatctgttcccaacctcgacagattcgtgtttcagatggccagcgctacggatgaggcccaaaaagactccatttatgcgtctgctctggtggaggccaccaagttctgtgcccctatctacgaatgcgcttgggtcagctccacaggaattgtgaagaaaggccttgagtggtttgaaaagaatgccgggaccatcaaatcttgggatgagagctatacagagctgaaggttgaagtgccgaaaattgagcagctcgctaactaccagcaggccgcgctgaagtggcggaaggacatcggattccgcgtcaatgccaacaccgctgccctttcccacaaagtgctggctgaatataaggttcccggcgagatcgtgatgagcgtcaaagaaatgctctctgatatgattagacggcgcaatctgatcctgaacagagggggagacgagaatcctcggggccccgtgtcccgcgagcacgtggaatggtgtagagagtttgtcaagggcaaatacattatggccttcaaccctccctggggagatatcaataagagcggacggtctggcattgcgctcgttgccacagggctggctaaacttgccgaaaccgagggaaagggcgtgtttgacgaagctaagaaaacggtggaggccctgaacgggtatctcgataagcacaaagacgaggtcgataaggcctccgctgacaacatgatcaccaatctgcttaaacatattgcgaaggcccaagaactgtacaagaacagctctgctctccgcgcccagggagcccagatcgacacagctttctccagctactattggctgtacaaagccggcgtgacccctgagacatttccgaccgtttcccagttcctgttcgaactcggcaagcaacccagagggacgaaaaagatgaaaaaggcgctgctttctacacctatgaagtgggggaaaaagctgtatgagctctttgctgatgacagcttccagcagaatcggatctacatgcaccccgccgtgctgaccgccggccgcatttccgaaatgggggtctgctttggaacaatccctgtggctaaccccgatgacgccgctcagggcagcgggcataccaaatctattcttaatctgagaaccaacacagagacgaataacccgtgtgccaagaccatcgttaaactcttcgagattcaaaagacaggatttaatatccaggatatggacatcgtggcgtccgaacatctgctgcaccagagcctcgtcggcaagcaatctcctttccagaacgcctataatgtgaaaggcaacgctaccagcgccaatattatctga

SEQ ID NO: 7419 - RNA, 1449 nt, synthetic construct
  misc_feature 1..1449: note = derived and/or modified CDS sequence (opt5) from CCHFV(UG3010)__DQ211650.1__N
  source 1..1449: mol_type = other RNA
atggagaacaagatcgaagtgaccagcaaagacgagatgaatagatggttcgaagagtttaagaaatccaacggcctggtcgatacattcaccaattcttacagcttttgcgaatccgttcccaacctcgaccggttcgtgtttcagatggcctctgctacggatgacgcccaaaaggatagcatttatgcgtccgctctggtggaggccacaaaattctgtgcccctatctacgagtgcgcttgggtctctagcaccgggattgtgaagaagggacttgaatggtttgagaaaaatgccggcacaatcaagtcctgggacgaaagctataccgagctgaaagttggggtgccgaagattgagcagctcgctaactaccagcaggccgcgctgaaatggcgcaaggatatcggattcagagtcaatgccaacacagctgccctttctaataaggtgctggctgaatataaagttcccggcgagatcgtgatgtccgtcaaggaaatgctcagcgacatgattcggcgcagaaacctgatcctgaatcgcgggggagatgagaaccctcggggccccgtgtctagagaacacgtggagtggtgtcgggagtttgtcaaaggcaagtacattatggccttcaatcctccctggggagacatcaacaaatccgggcgcagcggcattgcgctcgttgccaccgggctggctaagctcgccgaaacggagggaaaaggcgtgtttgatgaagctaagaagaccgtggaggacctgaatgggtatctcgataaacataaggacgaagtcgacaaagcctctgccgatggaatggtgacaaacctgcttaagcacatcgctaaagcgcaagagctgtacaagaactccagcgccctcagagctcagggcgcccagattgacacccctttctcctctttttactggctgtataaggccggcgttagcccggagacattccccaccgtgtcccagttcctgtttgaactcgggaaacaacctcggggaacgaagaaaatgaagaaagctctgcttagcacacccatgaagtggggcaagaaactgtacgagcttttcgccgatgactcttttcaggaaaatcgcatctatatgcatcctgcggtcctgaccgctgggagaatctccgagatgggagtgtgcttcggcacaattcccgttgccaacccggatgacgccgctcaggggagcggacacaccaagtctatccttaatctgcggaccaacacagaaacgaataacccttgtgccaaaaccattgtgaagctctttgagatccagaaaacaggcttcaatattcaagatatggacatcgtcgctagcgagcatctgctgcaccagtccctcgtgggcaagcagtctccctttcaaaacgcctacaatgtcaaggggaacgcgaccagcgccaatatcatttga

SEQ ID NO: 7420 - RNA, 1449 nt, synthetic construct
  misc_feature 1..1449: note = derived and/or modified CDS sequence (opt5) from CCHFV(UGANDA 3010)__U88416.1__N
  source 1..1449: mol_type = other RNA
atggagaacaagatcgaagtgaccagcaaagacgagatgaatagatggttcgaagagtttaagaaatccaacggcctggtcgatacattcaccaattcttacagcttttgcgaatccgttcccaacctcgaccggttcgtgtttcagatggcctctgctacggatgacgcccaaaaggatagcatttatgcgtccgctctggtggaggccacaaaattctgtgcccctatctacgagtgcgcttgggtctctagcaccgggattgtgaagaagggacttgaatggtttgagaaaaatgccggcacaatcaagtcctgggacgaaagctataccgagctgaaagttggggtgccgaagattgagcagctcgctaactaccagcaggccgcgctgaaatggcgcaaggatatcggattcagagtcaatgccaacacagctgccctttctaataaggtgctggctgaatataaagttcccggcgagatcgtgatgtccgtcaaggaaatgctcagcgacatgattcggcgcagaaacctgatcctgaatcgcgggggagatgagaaccctcggggccccgtgtctagagaacacgtggagtggtgtcgggagtttgtcaaaggcaagtacattatggccttcaatcctccctggggagacatcaacaaatccgggcgcagcggcattgcgctcgttgccaccgggctggctaaacttgccgaaacggagggaaagggcgtgtttgatgaagctaagaagaccgtggaggacctgaatgggtatctcgataaacataaggacgaagtcgacaaagcctctgccgatggaatggtgacaaacctgcttaagcacatcgctaaagcgcaagagctgtacaagaactccagcgccctcctgctgcagggcgctcagattgacacccctttctcctctttttactggctctataaggccggcgttagcccggagacattccccaccgtgtcccagttcctgtttgaacttgggaaacaacctagaggaacgaagaaaatgaagaaagccctgctcagcacacccatgaagtggggcaagaaactgtacgagcttttcgctgatgactcttttcaggaaaatcggatctatatgcatcctgccgtcctgaccgcggggcgcatctccgagatgggagtgtgcttcggcacaattcccgttgctaacccggatgacgccgcccaggggagcggacacaccaagtctatcctcaatctgggcaccaacacagaaacgaataacccttgtgctaaaaccattgtgaagctgtttgagatccagaaaacaggcttcaatattcaagatatggacatcgtcgccagcgagcatctcctgcaccagtcccttgtggggaagcagtctccctttcaaaacgcttacaatgtcaagggaaacgccaccagcgcgaatatcatttga

SEQ ID NO: 7421 - RNA, 1449 nt, synthetic construct
  misc_feature 1..1449: note = derived and/or modified CDS sequence (opt5) from CCHFV(UK ex Bulgaria)__KM201260.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccagattctgtgcccctatctacgagtgcgcttgggtgagctccacaggaattgtcaagaaaggccttgaatggtttgagaaaaattctgggaccatcaaaagctgggacgaaaactatgccgagctgaaggtggatgttccgaaaattgagcagctcgctaattaccagcaggccgcgctgaagtggcggaaggacatcggattccgcgtgaacgccaatacagctgccctttccaacaaagtcctggctgaatataaggtgcccggcgagatcgttatgagcgtgaaagaaatgctctctgatatgattagacggcgcaatctgatcctgaacagagggggagacgagaatcctcggggccccgtctcccgcgaacacgtggagtggtgtagagagtttgtgaagggcaaatacattatggccttcaaccctccctggggagatatcaacaagagcgggcggtctggcattgcgctcgtcgccaccgggctggctaaacttgccgaaacagagggaaagggcgtttttgacgaagctaagaaaaccgtggaggccctgaatgggtatctcgataagcatcgcgacgaagtggacaaagcctccgctgatagcatgatcacgaacctgcttaagcacattgcgaaagcccaagagctgtacaaaaattcttccgctctcagagcccagggagcccagatcgacacccctttcagctccttttactggctgtataaggctggcgtcacaccggagaccttccccacaatctctcagttcctgtttgaactcggcaagcaacctcgggggaccaagaaaatgaagaaagccctgcttagcacgcccatgaagtggggaaagaaactgtacgaactcttcgcggatgactcctttcagcagaaccgcatttatatgcatcctgctgtgctgacagccggcagaatcagcgagatgggggtttgcttcggaaccattcccgtggccaatccggatgacgctgcccagggctctgggcacacaaagtccatccttaacctgcggaccagcaccgagacaaataacccttgtgctaaaacgattgtcaagctctttgaaatccaaaagaccggattcaatatccaggatatggacattgtggcctctgagcatctgctgcaccagagcctcgttggcaagcaatccccctttcagaacgcgtacaatgtgaagggcaacgccacatctgctaatatcatttga

SEQ ID NO: 7422 - RNA, 1449 nt, synthetic construct
  misc_feature 1..1449: note = derived and/or modified CDS sequence (opt5) from CCHFV(Yozgat19-2012)__KR092375.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaaaattctgggaccatcaagagctgggacgaaaactatgccgagctgaaagtggatgttccgaagattgagcagctcgctaattaccagcaggccgcgctgaagtggagaaaagacatcggattccgggtgaacgccaatacagctgccctttccaacaaggtcctggctgaatataaagtgcccggcgagatcgttatgagcgtgaaggaaatgctctctgatatgattcgcagacggaatctgatcctgaaccgctccggggacgagaatcctagaggacccgtcagccgggaacacgtggagtggtgtcgcgagtttgtgaaaggcaagtacattatggccttcaaccctccctggggcgatatcaacaaatctgggagatccggaattgcgctcgtcgccaccggcctggctaagctcgccgaaacagaggggaagggagtttttgacgaagctaaaaagaccgtggaggccctgaatggctatctcgataaacatcgggacgaagtggacaaggccagcgctgattctatgatcacgaacctgcttaaacacattgcgaaggcccaagagctgtacaaaaattccagcgctctccgcgcccagggggcccagatcgacacccctttctcctctttttactggctgtataaggctggagtcacaccggagaccttccccacaatcagccagttcctgtttgaactcggcaagcaacctagaggcaccaaaaagatgaaaaaggccctgctttccacgcccatgaagtgggggaaaaagctgtacgagcttttcgcggatgacagctttcagcagaaccggatttatatgcatcctgctgtgctgacagccggacgcatctctgaaatgggcgtttgcttcgggaccattcccgtggccaatccggatgacgctgcccagggatccggccacacaaaaagcatccttaacctgagaacctctaccgagacaaataacccttgtgctaagacgattgtcaaactctttgaaatccaaaagaccgggttcaatatccaggatatggacattgtggccagcgagcatctgctgcaccagtccctcgttggaaagcaatctccctttcagaacgcgtaccacgtgaaaggcaatgccacaagcgctaacatcatttga

SEQ ID NO: 7423 - RNA, 1449 nt, synthetic construct
  misc_feature 1..1449: note = derived and/or modified CDS sequence (opt5) from CCHFV(Yozgat207-2011)__KR092377.1__N
  source 1..1449: mol_type = other RNA
atggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaaaattctgggaccatcaagagctgggacgaaaactatgccgagctgaaagtggatgttccgaagattgagcagctcgctaattaccagcaggccgcgctgaagtggagaaaagacatcggattccgggtgaacgccaatacagctgccctttccaacaaggtcctggctgaatataaagtgcccggcgagatcgttatgagcgtgaaggaaatgctctctgatatgattcgcagacggaatctgatcctgaaccgcgggggagacgagaatcctagaggccccgtctcccgggaacacgtggagtggtgtcgcgagtttgtgaaaggcaagtacattatggccttcaaccctccctggggagatatcaacaaaagcggaagatctggcattgcgctcgtcgccaccgggctggctaagctcgccgaaacagagggaaagggcgtttttgacgaagctaaaaagaccgtggaggccctgaatgggtatctcgataaacatcgggacgaagtggacaaggcctccgctgatagcatgatcacgaacctgcttaaacacattgcgaaggcccaagagctgtacaaaaattcttccgctctccgcgcccagggagcccagatcgacacccctttcagctccttttactggctgtataaggctggcgtcacaccggagaccttccccacaatctctcagttcctgtttgaactcggcaagcaacctagagggaccaaaaagatgaaaaaggccctgcttagcacgcccatgaagtgggggaaaaagctgtacgagcttttcgcggatgactcctttcagcagaaccggatttatatgcatcctgctgtgctgacagccggccgcatcagcgaaatgggggtttgcttcggaaccattcccgtggccaatccggatgacgctgcccagggctctgggcacacaaaatccatccttaacctgagaaccagcaccgagacaaataacccttgtgctaagacgattgtcaaactctttgaaatccaagagaccggattcaatatccaggatatggacattgtggcctctgagcatctgctgcaccagagcctcgttggcaagcaatccccctttcagaacgcgtacaatgtgaagggcaacgccacatctgctaatatcatttga

SEQ ID NO: 7424 - RNA, 1452 nt, synthetic construct
  misc_feature 1..1452: note = derived and/or modified CDS sequence (opt5) from DUGV(ArD44313)__AF434161.1__N
  source 1..1452: mol_type = other RNA
atggagaaccagatcaaggccaataacaaaaaggagttcgacgaatggtttaaacccttcagcgaaaagctgcaactcagatccaatctgaccaactctgctagcctttgcgatcgggtgcctgacctggccctcgcggagatgaaaatggctctggccacagatgacaaggaaaaggattccatcttttctaatgcccttgtcgaggctacgcgcttctgtgccccgatttacgagtgcgcttggacctgtagcacaggcgttgtgcagaaatccctgtcttggtttgacaagaacaaagatttcattaagctctgggacgccaaatatatggatctgaagaaggggatccccgaacctgagcagctggtgagctaccagcaagcggcccagaaatggagaaaggacgtcggatatgaaattaatcagtttacccggtccctcacacaccccgtggttgctgagtacaaagtgcctggcgagatcgccgtcgatgtgaaggaaatgctgagcgacatgatccgcagacggaacgttcttctgaatggggatggagagaacgctggcaaaaaggggcccatttctcgcgaacatgtgtcctggggaagagagctcgccggcggcaaattccaggtcgtgtttaatcctccgtggggagacatcaacaagtgcggcaagagcgggattcccctggcggccaccgctatggtgaaagtcgccgaacttgacgggtctaagaaactggaggatatccggcaagctctcctggacctgaagaaatgggttgaggataataaggacgccctcgaagatggaaagggcaacgagctggtgcagacaatgaccaaacaccttgcccaggctgtggaactgtccaagaaaagcaatgcgctccgcgcccagggggctcaaattgacacgcctttctctgcctattactgggcctggtccgctggagtcaagcccgagacctttttcacactgagccagtttcttttcgaaatgggccagtccgccagaggcgggaaaaagatgatcaaggcgctgacctctacacctctccggtggggaaaaggcctgattaacctgttcgctgatgacgattttctcgggaaccgcctgtatatgcatcccgccgtgcttaccccgggaagaatgagcgagatgggcgcctgtttcggggttatccctgtggcttcccccgaggacgccatcctgggaagcggccactctaagaatattctcaactttaaaatcgatacgtccgtccaaaatccttgcgctagcacaattgtgcagctgtaccggatccagaagtctggcttcgaccttgaaagcctggaggttgtgtccaccgaacatctcctgcaccagtcttttgtcgggaaacgctgtcccacacaaaacgcctacaaggtgagaggaaatgcgaccaacgtcaatattatctga

SEQ ID NO: 7425 - RNA, 1452 nt, synthetic construct
  misc_feature 1..1452: note = derived and/or modified CDS sequence (opt5) from DUGV(ArD16095)__AF434162.1__N
  source 1..1452: mol_type = other RNA
atggagaaccagatcaaggccaataacaaaaaggaatttgacgagtggtttaaacccttcagcgaaaagctgcaactcagatccaatctgaccaactctgctagcctttgcgatcgggtgcctgacctggccctcgcggagatgaaaatggctctggccacagatgacaaggaaaaggattccattttctctaatgcccttgtcgaggctacgcgcttctgtgccccgatctacgagtgcgcttggacctgtagcacaggcgttgtgcagaaatccctgtcttggtttgacaagaacaaagatttcattaagctctgggacagcaaatatatggatctgagaaaggggatccccgaacctgagcagctggtgtcctaccagcaagccgcgcagaagtggcggaaagacgtcggatatgaaattaatcagtttacccgcagcctcacacaccccgtggttgccgagtacaaggtgcctggcgagatcgctgtcgatgtgaaagaaatgctgtctgacatgatcagacggcgcaacgttcttctgaatggggatggagagaacgccggcaagaaagggcccatttccagagaacatgtgagctggggacgggagctcgctggcggcaagttccaggtcgtgtttaatcctccgtggggagacatcaacaaatgcgggaagtctggcattcccctggccgcgaccgccatggtgaaggtcgctgaacttgacgggtccaaaaagctggaggatatccgccaagccctcctggacctgaaaaagtgggttgaggataataaagacgctctcgaagatggaaagggcaacgagctggtgcagacaatgaccaagcaccttgcccaggccgtggaactgagcaaaaagtctaatgctctcagagcgcagggggcccaaattgacacgcctttctccgcttattactgggcctggagcgccggagtcaaacccgagacctttttcacactgtcccagtttcttttcgaaatgggccagtctgctcggggcgggaagaaaatgatcaaggccctgaccagcacacctctccgctggggaaagggcctgattaacctgttcgcggatgacgatttttccgggaacagactctatatgcatcccgctgtgctgaccccgggacggatgagcgagatgggcgcctgtttcggggttatccctgtggcctctcccgaggacgctatccttggatccggccacagcaaaaatattctgaactttaagatcgatacgtctgtccaaaatccttgcgccagcacaattgtgcagctctaccgcatccagaaatccggcttcgacctggaatctcttgaggttgtgagcaccgaacatctgctccaccagtcctttgtcgggaagagatgtcccacacaaaacgcttacaaagtgcggggaaatgccaccaacgtcaatattatctga

SEQ ID NO: 7426 - RNA, 1452 nt, synthetic construct
  misc_feature 1..1452: note = derived and/or modified CDS sequence (opt5) from DUGV(IbH11480)__AF434163.1__N
  source 1..1452: mol_type = other RNA
atggagaaccagatcaaggccaataacaaaaaggagttcgacgaatggtttaaacccttcagcgaaaagctgcaactcagatccaatctgaccaactctgctagcctttgcgatcgggtgcctgacctggccctcgcggagatgaaaatggctctggccacagatgacaaggaaaaggattccatcttttctaatgcccttgtcgaggctacgcgcttctgtgccccgatttacgagtgcgcttggacctgtagcacaggcgttgtgcagaaatccctgtcttggtttgacaagaacaaagatttcattaagctctgggacgccaaatatatggatctgagaaaggggatccccgaacctgagcagctggtgagctaccagcaagcggcccagaagtggcggaaagacgtcggatatgaaattaatcagtttacccgctccctcacacaccccgtggttgctgagtacaaggtgcctggcgagatcgccgtcgatgtgaaagaaatgctgagcgacatgatcagacggcgcaacgttcttctgaatggggatggagagaacgctggcaagaaagggcccatttctagagaacatgtgtcctggggacgggagctcgccggcggcaagttccaggtcgtgtttaatcctccgtggggagacatcaacaaatgcggcaagagcgggattcccctggcggccaccgctatggtgaaggtcgccgaacttgacgggtctaaaaagctggaggatatccgccaagctctcctggacctgaaaaagtgggttgaggataataaagacgccctcgaagatggaaagggcaacgagctggtgcagacaatgaccaagcaccttgcccaggctgtggaactgtccaaaaagagcaatgcgctcagagcccagggggctcaaattgacacgcctttctctgccttttattgggcctggtccgctggagtcaaacccgagaccttctttacactgagccagttccttttcgaaatgggccagtccgcccggggcgggaagaaaatgatcaaggcgctgacctctacacctctccgctggggaaagggcctgattaacctgtttgctgatgacgatttcctcgggaacagactgtacatgcatcccgccgtgcttaccccgggacggatgagcgagatgggcgcctgttttggggttatccctgtggcttcccccgaggacgccatcctgggaagcggccactctaaaaatattctcaacttcaagatcgatacgtccgtccaaaatccttgcgctagcacaattgtgcagctgtatcgcatccagaaatctggctttgaccttgaaagcctggaggttgtgtccaccgaacatctcctgcaccagtctttcgtcgggaagagatgtcccacacaaaacgcctacaaagtgcggggaaatgcgaccaacgtcaatattatctga

SEQ ID NO: 7427 - RNA, 1452 nt, synthetic construct
  misc_feature 1..1452: note = derived and/or modified CDS sequence (opt5) from DUGV(IbAr1792)__AF434164.1__N
  source 1..1452: mol_type = other RNA
atggagaaccagatcaaggccaataacaaaaaggagttcgacgaatggtttaaacccttcagcgaaaagctgcaactcagatccaatctgaccaactctgctagcctttgcgatcgggtgcctgacctggccctcgcggagatgaaaatggctctggccacagatgacaaggaaaaggattccatcttttctaatgcccttgtcgaggctacgcgcttctgtgccccgatttacgagtgcgcttggacctgtagcacaggcgttgtgcagaaatccctgtcttggtttgacaagaacaaagatttcattaagctctgggacgccaaatatatggatctgagaaaggggatccccgaacctgagcagctggtgagctaccagcaagcggcccagaagtggcggaaagacgtcggatatgaaattaatcagtttacccgctccctcacacaccccgtggttgctgagtacaaggtgcctggcgagatcgccgtcgatgtgaaagaaatgctgagcgacatgatcagacggcgcaacgttcttctgaatggggatggagagaacgctggcaagaaagggcccatttctagagaacatgtgtcctggggacgggagctcgccggcggcaagttccaggtcgtgtttaatcctccgtggggagacatcaacaaatgcggcaagagcgggattcccctggcggccaccgctatggtgaaggtcgccgaacttgacgggtctaaaaagctggaggatatccgccaagctctcctggacctgaaaaagtgggttgaggataataaagacgccctcgaagatggaaagggcaacgagctggtgcagacaatgaccaagcaccttgcccaggctgtggaactgtccaaaaagagcaatgcgctcagagcccagggggctcaaattgacacgcctttctctgcctattactgggcctggtccgctggagtcaaacccgagacctttttcacactgagccagtttcttttcgaaatgggccagtccgcccggggcgggaagaaaatgatcaaggcgctgacctctacacctctccgctggggaaagggcctgattaacctgttcgctgatgacgattttctcgggaacagactgtatatgcatcccgccgtgcttaccccgggacggatgagcgagatgggcgcctgtttcggggttatccctgtggcttcccccgaggacgccatcctgggaagcggccactctaaaaatattctcaactttaagatcgatacgtccgtccaaaatccttgcgctagcacaattgtgcagctgtaccgcatccagaaatctggcttcgaccttgaaagcctggaggttgtgtccaccgaacatctcctgcaccagtcttttgtcgggaagagatgtcccacacaaaacgcctacaaagtgcggggaaatgcgaccaacgtcaatattatctga

SEQ ID NO: 7428 - RNA, 1452 nt, synthetic construct
  misc_feature 1..1452: note = derived and/or modified CDS sequence (opt5) from DUGV(KT281/75)__AF434165.1__N
  source 1..1452: mol_type = other RNA
atggagaaccagatcaaggccaataccaaaaaggagttcgacgaatggtttaaacccttcagcgataagctgcaactcagatccacactgacgaactctgctagcctttgcgaccgggtgcctgatctggccctcgcggaaatgaaaatggctctggccaccgacgataaggagaaggactccatcttttctaatgcccttgtcgaagctacacgcttctgtgccccgatttacgagtgcgcttggacctgtagcacaggcgttgtgcagaaatccctgtcttggtttgataagaacaaagacttcattaagctctgggatgccaaatatatggacctgagaaaggggatccccgagcctgaacagctggtgagctaccagcaagcggcccagaagtggcggaaagatattggatatgagatcaatcagtttacccgctccctcacacaccccgtcgtggctgaatacaaggttcctggcgagatcgccgtggacgtcaaagagatgctgagcgatatgattagacggcgcaacgtgcttctgaatggggacggagaaaacgctggcaagaaagggcccatctctagagagcatgtttcctggggacgggaactcgccggcggcaagttccaggtggtctttaatcctccgtggggagacattaacaaatgcggcaagagcgggatccccctggcggccaccgctatggtgaaggtggccgagcttgatgggtctaaaaagctggaagacattcgccaagctctcctggatctgaaaaagtggatcgaggacaataaagatgccctcgaggacggaaagggcaacgaactgattcagacgatgaccaagcaccttgcccaggctgtcgagctgtccaaaaagagcaatgcgctcagagcccagggggctcaaatcgatacacctttctctgccttttattgggcctggtccgctggagttaaacccgaaaccttctttacactgagccagttccttttcgagatgggccagtccgcccggggcgggaagaaaatgatcaaggcgctgacctctacgcctctccgctggggaaagggcctgattaacctgtttgctgacgatgacttcagcgggaatagactctacatgcatcccgccgtgctgacaccgggacggatgtccgaaatgggcgcctgttttggggtgatccctgtcgctagccccgaggatgccattcttggatctggccactccaaaaacatcctgaacttcaagattgacaccagcgtgcaaaatccttgcgcttctacaatcgttcagctctatcgcatccagaaaagcggctttgacctggagtcccttgaagtggtctctaccgagcatctgctccaccagagcttcgtggggaagagatgtcccacccaaaacgcctacaaagttcggggaaatgcgacaaacgtgaatattatctga

SEQ ID NO: 7429 - RNA, 1452 nt, synthetic construct
  misc_feature 1..1452: note = derived and/or modified CDS sequence (opt5) from DUGV(NJT130)__FJ422213.2__N
  source 1..1452: mol_type = other RNA
atggagaaccagatcaaggccaataacaaaaaggaatttgacgagtggtttaaacccttcagcgataagctgcaactcagatccaccctgacaaattctgctagcctttgcgacaaagtgcctgatctggccctcgcggaaatgaagatggctctggccacggacgataaggagaaagactccattttctctaacgcccttgtcgaagctacccggttctgtgccccgatctacgagtgcgcttggacatgtagcaccggcgttgtgcagaagtccctgtcttggtttgataaaaataaggacttcattaaactctgggatgccaagtatatggacctgcgcaaggggatccccgagcctgaacagctggtgagctaccagcaagcggcccagaaatggagaaaggatattggatatgagatcaaccagtttacacggtccctcacccaccccgtcgtggctgaatacaaagttcctggcgagatcgccgtggacgtcaaggagatgctgagcgatatgattcgcagacggaatgtgcttctgaacggggacggagaaaatgctggcaaaaaggggcccatctctcgcgagcatgtttcctggggaagagaactcgccgagggcaaattccaggtggtctttaaccctccgtggggcgacattaataagtgcggaaagagcgggatccccctggcggccacagctatggtgaaagtggccgaacttgatggctctaagaaactggaggacattcggcaagctctcctggatctgaagaaatgggtcgaggacaacaaggatgccctcgaagacgggaagggaaatgagctgatccagaccatgacgaaacaccttgcccaggctgttgaactgtccaagaaaagcaacgcgctccgcgcccagggcgctcaaattgatacccctttctctgccttttattgggcctggtccgctggggtgaagcccgagacattctttaccctgagccagttccttttcgaaatgggacagtccgccagaggcggcaaaaagatgatcaaggcgctgacatctacccctctccggtgggggaaaggactgatcaatctgtttgctgacgatgacttcagcggcaaccgcctctacatgcatcccgccgtgctgacgccggggagaatgtccgagatgggagcctgttttggcgtcattcctgtggctagccccgaggatgccatccttgggtctggacactccaagaacattctgaatttcaaaatcgacacaagcgttcaaaacccttgcgcttctaccattgtgcagctctatcggatccaaaagagcggctttgacctggaatcccttgaggtcgtgtctacagaacatctgctccaccagagcttcgttggcaaacgctgtcccacccagaatgcctacaaggtgagagggaacgcgaccaatgtcaacatcatttga

SEQ ID NO: 7430 - RNA, 1452 nt, synthetic construct
  misc_feature 1..1452: note = derived and/or modified CDS sequence (opt5) from DUGV(IbAr1792)__KU925457.1__N
  source 1..1452: mol_type = other RNA
atggagaaccagatcaaggccaataacaaaaaggagttcgacgaatggtttaaacccttcagcgaaaagctgcaactcagatccaatctgaccaactctgctagcctttgcgatcgggtgcctgacctggccctcgcggagatgaaaatggctctggccacagatgacaaggaaaaggattccatcttttctaatgcccttgtcgaggctacgcgcttctgtgccccgatttacgagtgcgcttggacctgtagcacaggcgttgtgcagaaatccctgtcttggtttgacaagaacaaagatttcattaagctctgggacgccaaatatatggatctgagaaaggggatccccgaacctgagcagctggtgagctaccagcaagcggcccagaagtggcggaaagacgtcggatatgaaattaatcagtttacccgctccctcacacaccccgtggttgctgagtacaaggtgcctggcgagatcgccgtcgatgtgaaagaaatgctgagcgacatgatcagacggcgcaacgttcttctgaatggggatggagagaacgctggcaagaaagggcccatttctagagaacatgtgtcctggggacgggagctcgccggcggcaagttccaggtcgtgtttaatcctccgtggggagacatcaacaaatgcggcaagagcgggattcccctggcggccaccgctatggtgaaggtcgccgaacttgacgggtctaaaaagctggaggatatccgccaagctctcctggacctgaaaaagtgggttgaggataataaagacgccctcgaagatggaaagggcaacgagctggtgcagacaatgaccaagcaccttgcccaggctgtggaactgtccaaaaagagcaatgcgctcagagcccagggggctcaaattgacacgcctttctctgccttttattgggcctggtccgctggagtcaaacccgagaccttctttacactgagccagttccttttcgaaatgggccagaacgcccggggcgggaagaaaatgatcaaggcgctgacctccacacctctccgctggggaaagggcctgattaacctgtttgctgatgacgatttcctcgggaatagactgtacatgcatcccgccgtgcttaccccgggacggatgtctgagatgggcgcctgttttggggttatccctgtggctagccccgaggacgccatcctgggatccggccacagcaaaaacattctcaatttcaagatcgatacgtctgtccaaaacccttgcgcttccacaattgtgcagctgtatcgcatccagaaaagcggctttgaccttgaatctctggaggttgtgagcaccgaacatctcctgcaccagtccttcgtcgggaagagatgtcccacacaaaatgcctacaaagtgcggggaaacgcgaccaatgtcaacattatctga

SEQ ID NO: 7431 - RNA, 1449 nt, synthetic construct
  misc_feature 1..1449: note = derived and/or modified CDS sequence (opt5) from NSDV(Jilin)__NC_034386.1__N
  source 1..1449: mol_type = other RNA
atgcagaaccaaatcgtggccgacaataaggatgctattctggcctggcacaaaacctacagcgagaagcatagactcaaatccgtcctgacaaactctgcgagcttctgcgaaacgatccccgacctttccggctatgaggtttctatgcggctggtgagctccgaatctgagaaggatagcgtgtacgcttccgccctcgtcgccgctaccaaattttgtgcccctattctggaatgcgcttggacaagctgtaccgggatggtggagcgcggacttgactggttcgagaataacaaggaaacagttaagatctgggatgccgagtatggcaaactgagaaccgaagcgccgtctcccgagcagctcctggggtaccagcgggccgctctgaagtggcgcaaagacacaaagtatggaattaatagaaacaccgccgctctcgccgcggccatcgctacggagtaccgggtgcctggctccatcgtcgtgaatgttaaagatatgctgagcgacatgattcgcagacggaacaagatccttaatcgcgatgggtctgaagacgtgcccaagagaggacctgtctccaaagagcacattgattgggcccgggacctggctcagggcaagtttctcgtggtgttcaatcccccttggggcgatatcaacaaagccggaaagagcgggattgccctggctgcgaccggcatggccaaacttatcgaactggacgggccgaagattgctgaggacctccgcgaatctctgaaaggactggtcgcctggatcaacgcccataaggatgaggttgagaatggcaaggaagtggtggacgggctcacaaaacatctgcaaaaggctcttgagctggccaaacagtccagcgcgatgagagctcagggagcccagatcgataccgtcttttcctcttattactggctctggaaggccggcgtgacagctgaaatgttccccaccgttagccaatttctgttcgagcttggcaaagtgcctcgggggaacaagaagatgaaaaaggccctgtccagcatgcccctcaaatggggaaagaaactgctggctctctttgccgacgattctttcacggcgaatcgcatttacatgcaccctggcgtcctgacagccgggagaatgtccgaacttggagtgtgctttggcgctatccccgttgccaacccggacgatgctgccgaggggagcggacacattaagaacatcctggcgcagaccacagacacccaggccggcaatccttgtgctcagaacattgtggccctcttcaatatccaaaaggctggctttgatatcgagtctatggacattgtcgccctggaacaccttctgcatcagagcctcgtggggaaacggtcccccttccagaacgcctataatatcagaggaaacgctacctctattcaaatcatttga

SEQ ID NO: 7432 - RNA, 1449 nt, synthetic construct
  misc_feature 1..1449: note = derived and/or modified CDS sequence (opt5) from NSDV(62873)__HQ286609.1__N
  source 1..1449: mol_type = other RNA
atgcagaaccaaatcgtggccgacaataaggatgctattctggcctggcacaaaacctacagcgagaagcataaactcaagtccgtcctgacaaactctgcgagcttctgcgaaacgatccccgacctttccggctatgaggtttctatgagactggtgagctccgaatctgagaaagatagcgtgtacgcttccgccctcgtcgccgctaccaagttttgtgcccctattctggaatgcgcttggacaagctgtaccgggatgatccagcggggacttgactggttcgagaataacggcgagatggtgaagatttgggatgccgactatgggaaactgcgcacagaaatcccgtctcccgagcagctcctgggataccagagagcggccctgaagtggcggaaagataccaagtatggcatcaataaaaacacagctgccctcgctgccgcgattgccaccgaataccgcgttcctgggtccatcgtggtcaatgtgaaggacatgctgagcgatatgattagacggcgcaacaagatccttaatagagacggatctgaggatgttcccaaacggggccctgtgtccaaggagcacattgactgggctcgcgatctggcccaaggcaaatttctcgtcgtgttcaatcccccttggggagacatcaacaaggctgggaaaagcggcattgccctggccgctacggggatggcgaagctgatcgaactggacggaccgaaagtggccgaggatctcaaggaatctctgaagtccctggtcgcttggatcaacgcccataaagacgaggttgaaaatggcaaggaggtggtggatgggctcaccaaacaccttcagaaggcccttgagctggctaaacagagctccgccatgagagcgcagggagctcaaattgacacagtcttttctagctattactggctctggaaggccggcgtgaccgccgaaatgttccccacagtttcccagtttctgttcgagcttggcaaggtgcctcgggggaacaaaaagatgaaaaaggctctgagctctatgcccctcaaatggggaaagaagctgctggccctctttgctgatgactccttcaccgccaatcgcatctacatgcatcctggcgtcctgacggcggggagaatgagcgaacttggagtgtgctttggcgccattcccgttgctaacccggatgacgccgctgaggggtctggacacatcaaaaacattctgaattataagacagatacccaggccggcaacccttgtgcgcagaatatcgtggccctcttcaacatccaaaaagctggctttgacattgaaagcatggatatcgtcgcctccgagcatctgcttcaccagtctctggtggggaagcggagccccttccagaatgcttacaacattcgcggaaatgccacatccatccaaattatctga

SEQ ID NO: 7433 - RNA, 1449 nt, synthetic construct
  misc_feature 1..1449: note = derived and/or modified CDS sequence (opt5) from NSDV(779)__HQ286602.1__N
  source 1..1449: mol_type = other RNA
atgcagaaccaaatcgtggccgacaataaggatgctattctggcctggcacaaaacctacagcgagaagcataaactcaagtccgtcctgacaaactctgcgagcttctgcgaaacgatccccgacctttccggctatgaggtttctatgagactggtgagctccgaatctgagaaagatagcgtgtacgcttccgccctcgtcgccgctaccaagttttgtgcccctattctggaatgcgcttggacaagctgtaccgggatgatccagcggggacttgactggttcgataataacggcgagatggtgaagatttgggacgccgattatgggaaactgcgcacagaggttccgtctcccgaacagctcctgggataccagagagcggccctgaagtggcggaaagacaccaagtatggcatcaataaaaacacagctgccctcgctgccgcgatcgccaccgagtaccgcgtgcctgggtccattgtcgtgaatgttaaggatatgctgagcgacatgatcagacggcgcaacaagattcttaatagagatggatctgaagacgtgcccaaacggggccctgtctccaaggagcacatcgattgggctcgcgacctggcccaaggcaaatttctcgtggtgttcaatcccccttggggagacattaacaaggctgggaaaagcggcatcgccctggccgctacggggatggcgaagctgattgagctggatggaccgaaagtcgccgaagacctcaaggagtctctgaagtccctggttgcttggatcaacgcccataaagatgaagtggagaatggcaaggaagtggtcgacgggctcaccaaacaccttcagaaggcccttgagctggctaaacagagctccgccatgagagcgcagggagctcaaatcgatacagtgttttctagctattactggctctggaaggccggcgttaccgccgagatgttccccacagtgtcccagtttctgttcgaacttggcaaggtccctcgggggaacaaaaagatgaaaaaggctctgagctctatgcccctcaaatggggaaagaagctgctggccctctttgctgacgattccttcaccgccaatcgcatttacatgcatcctggcgtgctgacggcggggagaatgagcgagcttggagtttgctttggcgccatccccgtggctaacccggacgatgccgctgaagggtctggacacattaaaaacatcctgaattataagacagacacccaggccggcaacccttgtgcgcagaatattgtcgccctcttcaacatccaaaaagctggctttgatatcgagagcatggacattgtggcctccgaacatctgcttcaccagtctctggtcgggaagcggagccccttccagaatgcttacaacatccgcggaaatgccacatccattcaaatcatttga

SEQ ID NO: 7434 - RNA, 1449 nt, synthetic construct
  misc_feature 1..1449: note = derived and/or modified CDS sequence (opt5) from NSDV(6233)__HQ286603.1__N
  source 1..1449: mol_type = other RNA
atgcagaaccaaatcgtggccgacaataaggatgctattctggcctggcacaaaacctacagcgagaagcataaactcaagtccgtcctgacaaactctgcgagcttctgcgaaacgatccccgacctttccggctatgaggtttctatgagactggtgagctccgaatctgagaaagatagcgtgtacgcttccgccctcgtcgccgctaccaagttttgtgcccctattctggaatgcgcttggacaagctgtaccgggatgatccagcggggacttgactggttcgataataacggcgagatggtgaagatttgggacgccgattatgggaaactgcgcacagaggttccgtctcccgaacagctcctgggataccagagagcggccctgaagtggcggaaagacaccaagtatggcatcaataaaaacacagctgccctcgctgccgcgatcgccaccgagtaccgcgtgcctgggtccattgtcgtgaatgttaaggatatgctgagcgacatgatcagacggcgcaacaagattcttaatagagatggatctgaagacgtgcccaaacggggccctgtctccaaggagcacatcgattgggctcgcgacctggcccaaggcaaatttctcgtggtgttcaatcccccttggggagacattaacaaggctgggaaaagcggcatcgccctggccgctacggggatggcgaagctgattgagctggatggaccgaaagtcgccgaagacctcaaggagtctctgaagtccctggttgcttggatcaacgcccataaagatgaagtggagaatggcaaggacgtggtcgatgggctcaccaaacaccttcagaaggcccttgaactggctaaacagagctccgccatgagagcgcagggagctcaaatcgacacagtgttttctagctattactggctctggaaggccggcgttaccgccgagatgttccccacagtgtcccagtttctgttcgagcttggcaaggtccctcgggggaacaaaaagatgaaaaaggctctgagctctatgcccctcaaatggggaaagaagctgctggccctctttgctgatgactccttcaccgccaatcgcatttacatgcatcctggcgtgctgacggcggggagaatgagcgaacttggagtttgctttggcgccatccccgtggctaacccggatgacgccgctgaggggtctggacacattaaaaacatcctgaattataagacagatacccaggccggcaacccttgtgcgcagaatattgtcgccctcttcaacatccaaaaagctggctttgacatcgaaagcatggacattgtggcctccgagcatctgcttcaccagtctctggtcgggaagcggagccccttccagaatgcttacaacatccgcggaaatgccacatccattcaaatcatttga

SEQ ID NO: 7435 - RNA, 1449 nt, synthetic construct
  misc_feature 1..1449: note = derived and/or modified CDS sequence (opt5) from NSDV(40350)__HQ286608.1__N
  source 1..1449: mol_type = other RNA
atgcagaaccaaatcgtggccgacagcaaggatgctattctggcctggcacaaaacctactccgagaagcataaactcaagtctgtcctgacaaatagcgcgtccttctgcgaaacgatccccgacctttctggctatgaggttagcatgagactggtgtcctctgatagcgaaaaagactccgtgtacgctagcgccctcgtcgccgctaccaagttttgtgcccctattctggagtgcgcttggacatcttgtaccgggatgatccagcggggacttgattggttcgaaaacaatggcgagatggtgaagatttgggacgccgattatgggaaactgcgcacagaggttccgtcccccgaacagctcctgggataccagagagcggccctgaagtggcggaaagacaccaagtatggcatcaacaaaaatacagctgccctcgctgccgcgatcgccaccgagtaccgcgtgcctgggagcattgtcgtgaacgttaaggatatgctgtctgacatgatcagacggcgcaataagattcttaacagagatggatccgaagacgtgcccaaacggggccctgtcagcaaggagcacatcgattgggctcgcgacctggcccaaggcaaatttctcgtggtgttcaatcccccttggggagacattaacaaggctgggaaatctggcatcgccctggccgctacggggatggcgaagctgattgagctggatggaccgaaaatcgccgaagacctcaaggagtcccttaagagcctggtcgcttggatcaatgcccataaagatgaagttgagaacggcaaggaagtggtggacgggctcaccaaacatctgcagaaggcccttgagctggctaaacagtcctctgccatgagagcgcagggagctcaaattgatacagtctttagctcctattactggctctggaaggccggcgtgaccgccgagatgttccccacagttagccagtttctgttcgaacttggcaaggtgcctcgggggaataaaaagatgaaaaaggctctgtcttccatgcccctcaaatggggaaagaagctgctggccctctttgctgacgatagcttcaccgccaaccgcatctacatgcaccctggcgtcctgacggcggggagaatgtctgagcttggagtgtgctttggcgccattcccgttgctaatccggacgatgccgctgaagggagcggacacatcaaaaacattctgaactataagacagacacccaggccggcaatccttgtgcgcagaacatcgtggccctcttcaatatccaaaaagctggctttgatattgagtccatggacatcgtcgcctctgaacatctgcttcaccagagcctggtggggaagcggtcccccttccagaacgcttacaatattcgcggaaacgccacaagcatccaaattatctga

SEQ ID NO: 7436 - RNA, 1449 nt, synthetic construct
  misc_feature 1..1449: note = derived and/or modified CDS sequence (opt5) from NSDV(616287)__HQ286605.1__N
  source 1..1449: mol_type = other RNA
atgcagaaccaaatcgtggccgacaataaggatgctattctggcctggcacaaaacctacagcgagaagcataaactcaagtccgtcctgacaaactctgcgagcttctgcgaaacgatccccgacctttccggctatgaggtttctatgagactggtgagctccgaatctgagaaagatagcgtgtacgcttccgccctcgtcgccgctaccaagttttgtgcccctattctggaatgcgcttggacaagctgtaccgggatgatccagcggggacttgactggttcgataataacggcgagatggtgaagatttgggacgccgattatgggaaactgcgcacagaggttccgtctcccgaacagctcctgggataccagagagcggccctgaagtggcggaaagacaccaagtatggcatcaataaaaacacagctgccctcgctgccgcgatcgccaccgagtaccgcgtgcctgggtccattgtcgtgaatgttaaggatatgctgagcgacatgatcagacggcgcaacaagattcttaatagagatggatctgaagacgtgcccaaaaagggccctgtctccaaagagcacgtggattgggctcgggacctggcccaaggcaagtttctcgtggtcttcaatcccccttggggagacatcaacaaagctggcaagagcgggattgccctggccgctacggggatggcgaaacttatcgagctggatggaccgaaggttgccgaagacctcaaggagtctctgaaatccctggtggcttggattaacgcccataaggatgaagtggagaatggcaaagaagtcgtggacgggctcaccaagcatctgcagaaagcccttgagctggctaagcagagctccgccatgcgcgcgcagggagctcaaatcgatacagtgttttctagctattactggctctggaaggccggcgttaccgccgagatgttccccacagtctcccagtttctgttcgaacttggcaaagtgcctagagggaacaagaaaatgaagaaagctctgagctctatgcccctcaagtggggaaagaaactgctggccctctttgctgacgattccttcaccgccaatcggatctacatgcaccctggcgttctgacggcggggcgcatgagcgagcttggagtgtgctttggcgccattcccgtcgctaacccggacgatgccgctgaagggtctggacacatcaagaacattctgaattataaaacagacacccaggccggcaacccttgtgcgcagaatatcgtggccctcttcaacattcaaaaggctggctttgatatcgagagcatggacatcgtcgcctccgaacatctgcttcaccagtctctggtggggaaaagaagccccttccagaatgcttacaacattcggggaaatgccacatccatccaaattatctga

SEQ ID NO: 7437 - RNA, 1449 nt, synthetic construct
  misc_feature 1..1449: note = derived and/or modified CDS sequence (opt5) from NSDV(615526)__HQ286606.1__N
  source 1..1449: mol_type = other RNA
atgcagaaccaaatcgtggccgacaataaggatgctattctggcctggcacaaagcgtacagcgagaagcataaactcaagtccgtcctgaccaactctgctagcttctgcgaaacaatccccgacctttccggctatgaggtttctatgagactggtgagctccgaatctgagaaagatagcgtgtacgcctccgccctcgtcgctgccacgaagttttgtgctcctattctggaatgcgcctggaccagctgtacagggatgatccagcggggacttgactggttcgattctaatggcgagatggtgaagatttgggacgcggattatgggaaactgcgcaccgaggttccgtcccccgaacagctcctgggataccagagagccgctctgaagtggcggaaagacacaaagtatggcatcaacaaaaataccgccgctctcgccgcggccatcgctacagagtaccgcgtgcctgggagcattgtcgtgaacgttaaggatatgctgtctgacatgatcagacggcgcaataagattcttaacagagatggatccgaagacgtgcccaaaggcggccctgtcagcaaggagcacatcgattgggcccgggacctggctcaagggaaatttctcgtggtgttcaatcccccttggggagacattaacaaggccggcaaatctgggatcgccctggctgcgaccggaatggccaagctgattgagctggatggcccgaaaatcgctgaagacctcaaggagtcccttaagagcctggtcgcctggatcaatgcccataaagatgaagttgagaacgggaaggaagtggtggacggactcacgaaacatctgcagaaggctcttgagctggccaaacagtcctctgcgatgcgcgctcagggcgcccaaattgataccgtctttagctcctattactggctctggaaggccggcgtgacagctgagatgttccccaccgttagccagtttctgttcgaacttgggaaggtgcctagaggaaataaaaagatgaaaaaggccctgtcttccatgcccctcaaatggggcaagaagctgctggctctctttgccgacgatagcttcacagcgaaccggatctacatgcaccctggggtcctgaccgccggacgcatgtctgagcttggcgtgtgctttggggctattcccgttgccaatccggacgatgctgccgaaggaagcggccacatcaaaaacattctgaactataagacggacacacaggcgggcaatccttgtgcccagaacatcgtggctctcttcaatatccaaaaagccgggtttgatattgagtccatggacatcgtcgcttctgaacatctgcttcaccagagcctggtgggaaagagatcccccttccagaacgcctacaatattcggggcaacgccaccagcatccaaattatctga

SEQ ID NO: 7438 - RNA, 1449 nt, synthetic construct
  misc_feature 1..1449: note = derived and/or modified CDS sequence (opt5) from NSDV(708)__AF504293.1__N
  source 1..1449: mol_type = other RNA
atgcagaaccaaatcgtggccgacaataaggatgctattctggcctggcacaaagcgtacagcgagaagcataaactcaagtccgtcctgaccaactctgctagcttctgcgaagccatccccgacctttccggctatgaggtttctatgagactggtgagctccgattctgaaaaagacagcgtgtacgcctccgctctcgtcgccgctacaaagttttgtgcccctattctggagtgcgcgtggacgagctgtaccgggatggtggaacggggacttgattggttcgagaataaccgcgagatggttaagatctgggacacagaatatggcaaactgagaaccgaggtgccgtctcccgaacagctcctggggtaccagcgggccgctctgaagtggcgcaaagatacaaagtatggaattaataaaaacaccgccgctctcgccgcggccatcgctacagagtacaaggtccctggctccctggtggttaatgtgaaggacatgcttagcgatatgatcagacggcgcaacaaaattctgaatagagacgggtctgaggatgtccccaagcggggacctgtgtccaaagaacacatcgactgggcccgcgatctcgctcagggcaagtttctggtggtcttcaatcccccttggggcgacattaacaaagccggaaagagcgggatcgcccttgctgcgaccggcatggccaaactgattgagctcgacgggccgaagatcgctgaagatctgaaggagtctctgaaatccctcgttgcctggattaacgcccataaggacgaagtggagaatggaaaagaggtggtcgatagcctgacgaagtatcttcaaaaagctctggaactcgccaagcagtcctctgcgatgagagctcagggcgcccagatcgacaccgtgtttagctcctactactggctgtggaaggccggggttacagctgagatgttccccaccgtgagccaatttcttttcgaactgggaaaagtccctcggggcaacaagaaaatgaagaaagccctctcttccatgcccctgaagtggggcaagaaactgctcgctctgtttgccgatgacagcttcacagcgaatcgcatctatatgcaccctggggtgcttaccgccggaagaatgtctgagctgggcgtttgctttggggctattcccgtggccaacccggatgacgctgccgatggaagcggccatatcaagtccattctcaactacaaaacggacacacaggcggggaatccttgtgcccagaacatcgtcgctctgttcaatattcagaaggccggatttgatatcgaatctatggacatcgtggctagcgagcaccttctgcaccaatccctcgtcggcaaacggagccccttccagaacgcctataatattcgcggcaacgccacctctatccagattatctga

SEQ ID NO: 7439 - RNA, 702 nt, synthetic construct
  misc_feature 1..702: note = derived and/or modified CDS sequence (opt5) from BUNV__NC_001927.1__N
  source 1..702: mol_type = other RNA
atgatcgagctggagttccacgacgtggccgctaacaccagctccacatttgatcccgaagtcgcctacgcgaatttcaagagagttcatacgaccggcctctcttatgaccacattcggatcttttacattaaagggcgcgaaatcaagacaagcctggctaaaagatccgagtgggaagtgacccttaacctgggaggctggaagattacagtgtataataccaacttccctgggaatcggaacaatccggtccccgatgacggactcacactgcatcgcctttctggctttctggccagatacctcctggagaaaatgctgaaggtgagcgagcctgaaaagctcatcatcaaatccaagattatcaaccccctggccgagaaaaatgggattacctggaacgatggagaagaggtttatctttctttctttcctggcagcgagatgttcctgggcacgtttcggttctaccccctcgctatcgggatttataaggtgcagcgcaaagaaatggagcctaagtacctggaaaagaccatgagacaacggtacatgggacttgaggccgctacatggaccgtctccaaactgacagaagtgcagagcgccctcaccgttgtgtcttccctgggctggaagaaaacgaatgtcagcgcggccgctcgcgactttctggccaagttcgggatcaacatgtga

SEQ ID NO: 7440 - RNA, 702 nt, synthetic construct
  misc_feature 1..702: note = derived and/or modified CDS sequence (opt5) from BUNV(SFCrEq231)__KP063894.1__N
  source 1..702: mol_type = other RNA
atgatcgagctggagttcaacgacgtggccgctaataccagctccacatttgatcccgaagtcgcctacattaacttcaagagaatctatacgaccggcctctcttacgaccacattcggatcttttatattaaagggcgcgaaatcaagacaagcctgaccaaaagatccgagtgggaagttacacttaatctgggaggctggaaggtgaccgtgttcaacacaaattttcctgggaaccgcaattctccggtccccgatgacggactcaccctgcatcggcttagcggcttcctggcgagatacctcctggagaaaatcctgaaggtgtccgagcctgaaaagctcattatcaaatctaagattatcaaccccctggctgagaaaaatgggattacgtggagcgatggagaagaggtttatctttcctttttccctggcagcgagatgtttctgggcaccttcaagttttaccccctcgccatcgggatttataaagtgcagcggaaggaaatggagcctaagtacctggagaaaacaatgcgccaaagatacatgggacttgaagcctctacctggacagtctccaaggtgaacgaagttcagagcgctctgaccgtggtctctggcctcgggtggaaaaagacgaatgtgtccgccgctgcccgggagttcctggcgaaatttggaatcaacatgtga

SEQ ID NO: 7441 - RNA, 702 nt, synthetic construct
  misc_feature 1..702: note = derived and/or modified CDS sequence (opt5) from BUNV(AMH001130)__JF961342.1__N
  source 1..702: mol_type = other RNA
atgatcgagctggagttccacgacgtggccgctaacaccagctccacatttgatcccgaagtcgcctacgcgaatttcaagagagttcatacgaccggcctctcttatgaccacattcggatcttttacattaaagggcgcgaagtgaagacaagcctggctaaaagatccgagtgggaagtgacccttaacctgggaggctggaagatcacagtctataataccaacttccctgggaatcggaacaatccggtgcccgatgacggactcacactgcatcgcctttctggctttctggccagatacctcctggagaaaatgctgaaggttagcgagcctgaaaagctcattatcaaatccaagatcattaaccccctggccgagaaaaatgggatcacctggaacgatggagaagaggtgtatctttctttctttcctggcagcgagatgttcctgggcacgtttcggttctaccccctcgctattgggatctataaggtccagcgcaaagaaatggagcctaagtacctggaaaagaccatgagacaacggtacatgggacttgaggccgctacatggaccgtgtccaaactgacagaagttcagagcgccctcaccgtggtctcttccctgggctggaagaaaacgaatgtgagcgcggccgctcgcgactttctggccaagttcgggattaacatgtga

SEQ ID NO: 7442 - RNA, 702 nt, synthetic construct
  misc_feature 1..702: note = derived and/or modified CDS sequence (opt5) from BUNV(ArB29051)__AM709778.1__N
  source 1..702: mol_type = other RNA
atgatcgagctggagttccacgacgtggccgctaacaccagctccacatttgatcccgaagtcgcctacgcgaatttcaagagagttcatacgaccggcctctcttatgaccacattcggatcttttacattaaagggcgcgaaatcaagacaagcctggctaaaagatccgagtgggaagtgacccttaacctgggaggctggaagattacagtgtataataccaacttccctgggaatcggaacaatccggtccccgatgacggactcacactgcatcgcctttctggctttctggccagatacctcctggagaaaatgctgaagctcagcgagcctgaaaagctgatcatcaaatccaagattatcaacccccttgccgagaaaaatgggattacctggaacgatggagaagaggtgtatctgtctttctttcctggcagcgagatgttcctcggcacgtttcggttctaccccctggctatcgggatttataaggttcagcgcaaagaaatggagcctaagtaccttgaaaagaccatgagacaacggtacatgggactggaggccgctacatggaccgtgtccaaactcacagaagtccagagcgccctgaccgtggtttcttccctgggctggaagaaaacgaatgtgagcgcggccgctcgcgactttctcgccaagttcgggatcaacatgtga

SEQ ID NO: 7443 - RNA, 702 nt, synthetic construct
  misc_feature 1..702: note = derived and/or modified CDS sequence (opt5) from BUNV(ArB28215)__AM711130.1__N
  source 1..702: mol_type = other RNA
atgatcgagctggagttcaacgacgtggccgtcaataccagctcctcttttgatcccgaagctgcctacgcgaacttcaagagagttcacacaacgggcctcagctatgaccatattcggatcttttacattaaagggcgcgaaatcaaggtgtccctgtctaaaagaagcgagtgggaagtgaccattaatcttggaggctggaagatcgctgtctataacacaaatttccctgggaaccgcaattccccggtgcccgatgacggactgaccctccaccggctgtctggctttcttgccagattcctgctcgagaaaatgctgaagatgagcgagcctgaaaagctgatcattaaagccaagatcattaaccccctcgctgagaaaaatcggatcacatggaacgatggggaagaggtttacctgtcctttttccctggaagcgagatgtttcttggcaccttcaagttttatcccctggccattggcatctacaaagtgcagcgcaaggaaatggagcctaagtatttcgaaaagacaatgagacaacggtacatggggctcgaggcttcttcctggaccgtcagcaaactgacggacgtgcagtctgcccttaccgttgtgtccggactgggctggaaaaagacaaatgtcagcgcggccgctcgcgattttctcgccaaattcgggattaacatgtga

SEQ ID NO: 7444 - RNA, 702 nt, synthetic construct
  misc_feature 1..702: note = derived and/or modified CDS sequence (opt5) from BUNV(Peurto Almendras)__AJ697960.1__N
  source 1..702: mol_type = other RNA
atgagcgagatcgccttcgacgatattggccagatcgctgcctccacctttaaccccgacaatcaatacattgggttcaagaaagtgtttacaatcggactgacgtatgatcagattagaatcttctttctcaacggcaagaaagcgaaggaaaccctgtctaaacggagcgaggaaacagtcacccttaatttcgggggatggcgcatccctattgttaacacacactttccgggcaatagaaacatcgacctggctgatgacgccctcaccctgcatcgggtgtccgggtaccttgcccgctatctgctcgagaaggtgctgtctgctcaggaacccgagaaggtcattatcaaaacaagaattatcaatcctattgccgctagcaacggaatcacctgggatgacggctacgaggtgtatctgtccttctttcccggctctgaatgcttcctcgaggcctttaagttctaccctctggcgatcgggatttataaagttcagaagggaatgatggatgtgaaatttcttgaaaagacgatgcggcaaaagtacgccggcctggacgctaccgtctggacacagcagaaatacaccgatgtgatcaatgccctcctggttgtgaacgggcttggatggaagaaaagcaatgtctccgctgccgcgaaggacttcctgagcaaattcggcattcagatctga

SEQ ID NO: 7445 - RNA, 702 nt, synthetic construct
  misc_feature 1..702: note = derived and/or modified CDS sequence (opt5) from BUNV__AF325122.1__N
  source 1..702: mol_type = other RNA
atgatcgagctggaatttaacgacgtggccgctaataccagctccacatttgatcccgaggtcgcctacattaacttcaagagactctatacgaccggcctgtcttacgaccacatccggattttctatatcaaagggcgcgaaattaagacaagccttgcgaaaagatccgagtgggaagttaccctgaatctcggaggctggaaggtgacagtgttcaacaccaattttcctgggaaccgcaattctccggtccccgatgacggactgacacttcatcggctgagcggctacctcgctagatatctgctggagaaaatcctcaaggtgtccgatcctgagaagctgatcattaaatctaagatcattaacccccttgccgagaaaaatgggatcacctggagcgacggagaagaagtttacctgtccttctttcctggcagcgagatgttcctcggcacgtttcggttctatcccctggccattgggatctacaaggtgcagcgcaaagagatggaacctaagtaccttgagaagaccatgagacaacggtatatgggactggaggcttctacatggaccgtctccaaactcaacgaagtgcagagcgccctgacagttgtgtctggcctggggtggaagaaaaccaatgtctccagcgctgcccgcgaatttctcgcgaagttcggaatttctatgtga

SEQ ID NO: 7446 - RNA, 702 nt, synthetic construct
  misc_feature 1..702: note = derived and/or modified CDS sequence (opt5) from Ab-BUNV(Cu20-XJ)__KJ710424.1__N
  source 1..702: mol_type = other RNA
atgctggagctcgaatttgaggacgtgcccaccaacatcggcagcacatttgatcctgaatccgggtacattaatttccagagaaactatctgccgggagtcacgcttgaccaaatccggattttctacatcaagggccgcgagattaaaaattctctggccaagagaagcgaatgggaggttaccctcaaccttgggggatggaaagtgcccgtgctgaatacaaacttccctggcaatcggtccaacgctgtccccgattatgggctgacctttcaccgcatctctggatacctcgccagatatctgctgggcaagtacctcgcggagacagaacctgagaaactgatcatgcggaccaagattatcaatccccttgctgaaaagaacggcattacatgggagagcgggcctgaggtgtatctgtccttctttccgggagccgaaatgttcctcggcacctttaaattctaccccctggccatcgggatttacaaggttcagcgcaaagagatggaccctaagtttcttgagaaaacgatgagacagcggtatctgggactcgatgctcagacctggacaaccacaaagctggacgaagtggaacgcgccctgaaggtcgtgtctggcctcgggtggaaaaagaccaatgttagcaacgctgccagagagttcctgtccaaatttggaatccggatgtga

SEQ ID NO: 7447 - RNA, 702 nt, synthetic construct
  misc_feature 1..702: note = derived and/or modified CDS sequence (opt5) from ANADV(2513 Irkutsk)__KT313716.1__N
  source 1..702: mol_type = other RNA
atgatcgaactggagttcaacgacgtggccgctaataccagctccacatttgatcccgaagtcgcctacattaacttcaagagaatctatacgaccggcctctcttacgaccacattcggatcttttatattaaagggcgcgaaatcaagacaagcctggcgaaaagatccgagtgggaagttacccttaatctgggaggctggaaggtgacagtgttcaacaccaattttcctgggaaccgcaattctccggtccccgatgacggactcacactgcatcggcttagcggcttcctggctagatacctcctggagaaaatcctgaaggtgtccgatcctgagaagctcattatcaaatctaagattatcaaccccctggccgagaaaaatgggattacctgggccgacggagaagaagtttatcttagctttttccctggctccgagatgtttctgggcacgttccggttttaccccctcgctatcgggatttataaggtgcagcgcaaagagatggaacctaagtacctggagaagaccatgagacaacggtacatgggacttgaagccagcacatggaccgtctctaaactgaacgaggtgcagtccgctctcacagttgtgagcggcctggggtggaagaaaaccaatgtctcttccgccgcgcgcgagttcctggccagatttggaatcaacatgtga

SEQ ID NO: 7448 - RNA, 702 nt, synthetic construct
  misc_feature 1..702: note = derived and/or modified CDS sequence (opt5) from ANADV(EIV-23263Tyum)__KT313761.1__N
  source 1..702: mol_type = other RNA
atgatcgaactggagttcaacgacgtggccgctaataccagctccacatttgatcccgaagtcgcctacattaacttcaagagaatctatacgaccggcctctcttacgaccacattcggatcttttatattaaagggcgcgaaatcaagacaagcctggcgaaaagatccgagtgggaagttacccttaatctgggaggctggaagatcacagtgttcaacaccaattttcctgggaaccgcaattctccggtgcccgatgacggactcacactgcatcggcttagcggcttcctggctagatacctcctggagaaaattctgaaggtctccgatcctgagaagctcatcattaaatctaagatcattaaccccctggccgagaaaaatgggatcacctgggccgacggagaagaagtgtatcttagctttttccctggctccgagatgtttctgggcacgttccggttttaccccctcgctattgggatctataaggttcagcgcaaagagatggaacctaagtacctggagaagaccatgagacaacggtacatgggacttgaagccagcacatggaccgtgtctaaactgaacgaggtccagtccgctctcacagtggttagcggcctggggtggaagaaaaccaatgtgtcttccgccgcgcgcgagttcctggccagatttggaatcaacatgtga

SEQ ID NO: 7449 - RNA, 702 nt, synthetic construct
  misc_feature 1..702: note = derived and/or modified CDS sequence (opt5) from BATV__X73464.1__N
  source 1..702: mol_type = other RNA
atgatcgaactggagttcaacgacgtggccgctaataccagctccacatttgatcccgaagtcgcctacattaacttcaagagaatctatacgaccggcctctcttacgacaatattcggatcttttatattaaagggcgcgaaatcaagacaagcctgtccaaaagatctgagtgggaagttacccttaacctgggaggctggaaggtgacagtgttcaataccaactttcctgggaatcggaacagcccggtccccgatgacggactcacactgcaccgcctttccggcttcctggcgagatacctcctggagaaaatcctgaaggtgtctgatcctgagaagctcattatcaaaagcaagattgttaatcccctggctgagaaaaacgggatcacctgggccgacggagaagaagtgtatctttcctttttccctggcagcgagatgtttctgggcacgttccggttttaccccctcgccattgggatctataaggtccagcgcaaagagatggaacctaagtacctggagaagaccatgagacaacggtacatgggacttgaggcttctacatggaccgtgtccaaactgaatgaagttcagagcgccctcacagtggtctctggcctggggtggaagaaaaccaacgtgtccagcgctgcccgcgagttcctggcgaagtttggaatttctatgtga

SEQ ID NO: 7450 - RNA, 702 nt, synthetic construct
  misc_feature 1..702: note = derived and/or modified CDS sequence (opt5) from BATV(668)__KT313687.1__N
  source 1..702: mol_type = other RNA
atgatcgaactggaatttaacgacgtggccgctaataccagctccacatttgatcccgaggtcgcctacctcaacttcaagagaatttatacgaccggcctgtcttacgacaatatccggattttctatatcaaagggcgcgaaattaaggttagccttgcgaaaagatccgagtgggaagtgacactgaacctcggaggctggaaggtgaccgtcttcaatacaaactttcctgggaatcggaactctccggtgcccgatgacggactgacccttcaccgcctgagcggcttcctcgctagatacctgctggagaaaatcctcaaggtttccgatcctgagaagctgatcattaaatctaagatcattaatccccttgccgagaaaaacgggatcacatggagcgacggagaagaagtgtatctgtcctttttccctggcagcgagatgtttctcggcaccttccggttttaccccctggccattgggatctataaggtccagcgcaaagagatggaacctaagtaccttgagaagacgatgagacaacggtacatgggactggaggcttctacctggacagtgtccaaactcaatgaagttcagagcgccctgaccgtggtctctggcctggggtggaagaaaacaaacgtgtccagcgctgcccgcgagttcctcgcgaagtttggaattaatatgtga

SEQ ID NO: 7451 - RNA, 702 nt, synthetic construct
  misc_feature 1..702: note = derived and/or modified CDS sequence (opt5) from BATV(804922)__FJ436805.1__N
  source 1..702: mol_type = other RNA
atgatcgaactggagttcaacgacgtggccgctaataccagctccacatttgatcccgaagtcgcctacattaacttcaagagaatctatacgaccggcctctcttacgacaatattcggatcttttatattaaagggcgcgaaatcaagacaagcctggcgaaaagatccgagtgggaagttacccttaacctgggaggctggaaggtgacagtgttcaataccaactttcctgggaatcggaactctccggtccccgatgacggactcacactgcaccgccttagcggcttcctggctagatacctcctggagaaaatcctgaaggtgtccgatcctgagaagctcattatcaaatctaagattgttaatcccctggccgagaaaaacgggatcacctgggccgacggagaagaagtgtatcttagctttttccctggctccgagatgtttctgggcacgttccggttttaccccctcgctattgggatctataaggtccagcgcaaagagatggaacctaagtacctggagaagaccatgagacaacggtacatgggacttgaagccagcacatggaccgtgtctaaactgaatgaggttcagtccgctctcacagtggtcagcggcctggggtggaagaaaaccaacgtgtcttccgccgcgcgcgagttcctggccaagtttggaattagcatgtga

SEQ ID NO: 7452 - RNA, 702 nt, synthetic construct
  misc_feature 1..702: note = derived and/or modified CDS sequence (opt5) from BATV(8627-11)__FJ436802.1__N
  source 1..702: mol_type = other RNA
atgatcgaactggagttcaacgacgtggccgctaataccagctccacatttgatcccgaagtcgcctacattaacttcaagagaatctatacgaccggcctctcttacgacaatattcggatcttttatattaaagggcgcgaaatcaagacaagcctggcgaaaagatccgagtgggaagttacccttaacctgggaggctggaaggtgacagtgttcaataccaactttcctgggaatcggaactctccggtccccgatgacggactcacactgcaccgccttagcggcttcctggctagatacctcctggagaaaatcctgaaggtgtccgatcctgagaagctcattatcaaatctaagattgttaatcccctggccgagaaaaacgggatcacctgggccgacggagaagaagtgtatcttagctttttccctggctccgagatgtttctgggcacgttccggttttaccccctcgctattgggatctataaggtccagcgcaaagagatggaacctaagtacctggagaagaccatgagacatcggtacatgggacttgaagccagcacatggaccgtgtctaaactgaatgaggttcaatccgctctcacagtggtcagcggcctggggtggaagaaaaccaacgtgtcttccgccgcgcgcgagttcctggccaagtttggaattagcatgtga

SEQ ID NO: 7453 - RNA, 702 nt, synthetic construct
  misc_feature 1..702: note = derived and/or modified CDS sequence (opt5) from BATV(G-20217)__FJ436806.1__N
  source 1..702: mol_type = other RNA
atgatcgaactggagttcaacgacgtggccgctaataccagctccacatttgatcccgaagtcgcctacattaacttcaagagaatctatacgaccggcctctcttacgacaatattcggatcttttatattaaagggcgcgaaatcaagacaagcctggcgaaaagatccgagtgggaagttacccttaacctgggaggctggaaggtgacagtgttcaataccaactttcctgggaatcggaactctccggtccccgatgacggactcacactgcaccgccttagcggcttcctggctagatacctcctggagaaaatcctgaaggtgtccgatcctgagaagctcattatcaaatctaagattgttaatcccctggccgagaaaaacgggatcacctgggccgacggagaagaagtgtatcttagctttttccctggctccgagatgtttctgggcacgttccggttttaccccctcagcattgggatctataaggtccagcgcaaagagatggaacctaagtacctggagaagaccatgagacaacggtacatgggacttgaggcttctacatggaccgtgtccaaactgaatgaagttcagagcgccctcacagtggtctctggcctggggtggaagaaaaccaacgtgtccagcgctgcccgcgagttcctggcgaagtttggaatttctatgtga

SEQ ID NO: 7454 - RNA, 702 nt, synthetic construct
  misc_feature 1..702: note = derived and/or modified CDS sequence (opt5) from BATV(MS50)__JX846604.1__N
  source 1..702: mol_type = other RNA
atgatcgagctggaatttaacgacgtggccgctaataccagctccacatttgatcccgaggtcgcctacgcgaacttcaagagagttcacacgaccggcctctcttatgaccatgtgcggattttctacatcaaagggcgcgaaattaagacaagcctgtccaaaagatctgagtgggaagtgacccttaatctgggaggctggaagatcgctgtctataacacaaatttccctagcaaccggaataacccggtgcccgatgacgggctcaccctgcaccgcctttccggatacctggccagatatctctttgagaaaattgttaaggtgtctgagcctgaaaagctgctgatcaaaagcaagatcattaatcccctcgccgagaaaaacggcatcacatgggctgatggggaagagatttacctgtccttctttcctggaagcgagatgttccttggcacctttaagttctatcccctggccatcggcatttacaaagtccagcggaaggaaatggagcctaagtacctcgagaaaacgatgcgccaaagatatatggggctggaagctggaacctggacagtgtctaaggttaatgaagtgcaggccgcggtcaacgtggtgtccacccttggctggaaaaagacaaatgtcagcgccgctgcccgggagtttctggctaaattcgggatcgccatgtga

SEQ ID NO: 7455 - RNA, 702 nt, synthetic construct
  misc_feature 1..702: note = derived and/or modified CDS sequence (opt5) from BATV(ON-1/E/94)__AB257761.1__N
  source 1..702: mol_type = other RNA
atgatcgaactggaatttaacgacgtggccgctaataccagctccacatttgatcccgaggtcgcctacattaacttcaagagagtttatacgaccggcctctcttacgacaatatccggattttctatatcaaagggcgcgaaattaagacaagcctggcgaaaagatccgagtgggaagtgacccttaacctgggaggctggaaggtgacagtcttcaataccaactttcctgggaatcggaactctccggtgcccgatgacggactcacactgcaccgccttagcggcttcctggctagatacctcctggagaaaatcctgaaggtttccgatcctgagaagctcatcattaaatctaagatcgtgaatcccctggccgagaaaaacgggattacctgggccgacggagaagaagtctatcttagctttttccctggctccgagatgtttctgggcacgttccggttttaccccctcgctatcgggatttataaggtgcagcgcaaagagatggaacctaagtacctggagaagaccatgagacaacggtacatgggacttgaagccagcacatggaccgtttctaaactgaatgaggtgcagtccgctctcacagtcgtgagcggcctggggtggaagaaaaccaacgtgtcttccgccgcgcgcgagttcctggccaagtttggaatcagcatgtga

SEQ ID NO: 7456 - RNA, 702 nt, synthetic construct
  misc_feature 1..702: note = derived and/or modified CDS sequence (opt5) from BATV(UgMP-6830)__JX846601.1__N
  source 1..702: mol_type = other RNA
atgatcgaactggagttcaacgacgtggccgctaataccagctccacatttgatcccgaagtcgcctacattaacttcaagagaatctatacgaccggcctctcttacgacaatattcggatcttttatattaaagggcgcgaaatcaagacaagcctggcgaaaagatccgagtgggaagttacccttaacctgggaggctggaaggtgacagtgttcaataccaactttcctgggaatcggaactctccggtccccgatgacggactcacactgcaccgccttagcggcttcctggctagatacctcctggagaaaatcctgaaggtgtccgatcctgagaagctcattatcaaatctaagattatcaatcccctggccgagaaaaacgggattacctgggccgacggagaagaagtttatcttagctttttccctggctccgagatgtttctgggcacgttccggttttaccccctcgctatcgggatttataaggtgcagcgcaaagagatggaacctaagtacctggagaagaccatgagacaacggtacatgggacttgaagccagcacatggaccgtctctaaactgaatgaggtgcagtccgctctcacagttgtgagcggcctggggtggaagaaaaccaacgtctcttccgccgcgcgcgagttcctggccaagtttggaatcagcatgtga

SEQ ID NO: 7457 - RNA, 702 nt, synthetic construct
  misc_feature 1..702: note = derived and/or modified CDS sequence (opt5) from BIRV(ArB2198)__AM711131.1__N
  source 1..702: mol_type = other RNA
atgatcgagctggaatttcaccatgtggccgctaacaccagctccacatttgaccccgaggtcgcctacgcgaatttcaagcggattcacacgaacggcctctcttatgataatatcagaattttctacatcaaagggcgcgaaattaagaccagcctggctaaaagatccgagtgggaagttacacttaacctgggaggctggaaggtggccgtgtataataccaacttccctgggaatcggaacaatccggtccccgacgatggactcacactgcatcgcctttctggctttctggccagatacctcctggagaaaatgctgaaggtgagcgagcctgaaaagctcatcatcaaaaccaagattatcaaccccctggctgagaaaaatgggattacatggaaggacggagaagaggtttatctttccttctttcctggctctgagatgttcctgggcacctttaaattctaccccctcgccatcgggatttataaggtgcagaagaaagaaatggatcctaagtacctggagaaaacgatgcggcaacgctacatgggacttgaagctagcacctggacagtctccaaggtgagcgaggttcagtctgccctgaccgtggtctccagcctcggctggaaaaagacaaacgtgaccgcggccgctagagactttttcgccaaatttgggatcaatatgtga

SEQ ID NO: 7458 - RNA, 702 nt, synthetic construct
  misc_feature 1..702: note = derived and/or modified CDS sequence (opt5) from BOZOV(ArB13529)__AM711132.1__N
  source 1..702: mol_type = other RNA
atgatcgagctggagttcaacgacgtggccgctaataccagctccacatttgatcccgaagccgcgtacgctaacttcaagagagtccacacgaccggcctcacatatgaccatattcggatcttttacattaaagggtctgaaatcaagaccagcctggccaaacgctccgagtgggaagttacacttaatctgggaggctggaagattaccgtgtataacacaaatttccctgggaacagaaataacccgtctcccgatgacggactcaccctgcactttttctgcggctttcttgccaaaagcctgctcgagaagatgctgaaggtgtccgctcctgagaaactgatcatcaagtctaaaattacgagccccctcgccgaaaagaatgggatcacctggaacgatggagaggaagtctacctgtccttctttcctggcagcgagatgttccttggcacatttcatttctatcccctgcctattgggatctaccagggactccggcgcgacctggagccgaaatattttggcaagacccttagactgatgtacatggggctcgaggcttcttcctggacagtgagcaagctgaccgaaggacaatctgccctgacggttgtgtccggcctcgggtggaaaaagacaaatgtcagcgcggccgctcgggatttcctggccaaattcggaattaacatgtga

SEQ ID NO: 7459 - RNA, 702 nt, synthetic construct
  misc_feature 1..702: note = derived and/or modified CDS sequence (opt5) from CVV__X73465.1__N
  source 1..702: mol_type = other RNA
atgatcgagctggagttcaacgacgtggccgctaataccagctccacatttgatcccgaaattgcctacgtcaacttcaagagaatccacacgaccggcctctcttatgaccatattcggatcttttacattaaagggcgcgaaatcaagacaagcctgaccaaaagatccgagtgggaagttacacttaatctgggaggctggaaggtgaccgtgttcaacacaaattttcctgggaaccgcaattctccggtccccgatgacggactcaccctgcaccggcttagcggctatctggcgagatacctcctggagaaaatcctgaaggtgtccgatcctgagaaggttattatcaaatctaagattatcaaccccctcgctgagaaaaatgggattacgtggagcgacggagaagaagtgtatctgtccttctttcctggcagcgagatgttccttggcacctttaagttctaccccctggccatcgggatttataaagtccagcggaaggagatggaacctaagtacctcgagaaaacaatgcgccaaagatacatgggactggaagcctctacctggacaatctccaaggtgaacgaggttcaggctgcccttaccgtggtcagcggcctggggtggaaaaagacgaatgtgtctgctgccgcgcgggaatttctcgccaaattcggaatctccatgtga

SEQ ID NO: 7460 - RNA, 702 nt, synthetic construct
  misc_feature 1..702: note = derived and/or modified CDS sequence (opt5) from CVV(10081)__KP835932.1__N
  source 1..702: mol_type = other RNA
atgatcgagctggagttcaacgacgtggccgctaataccagctccacatttgatcccgaaattgcctacgtcaacttcaagagaatctatacgaccggcctctcttacgaccacattcggatcttttatattaaagggcgcgaaatcaagacaagcctgaccaaaagatccgagtgggaagttacacttaatctgggaggctggaagatcaccgtgttcaacacaaattttcctgggaaccgcaattctccggtgcccgatgacggactcaccctgcatcggcttagcggctacctggcgagatatctcctggagaaaattctgaaggtctccgatcctgagaaggtgatcattaaatctaagatcattaaccccctcgctgagaaaaatgggatcacgtggagcgacggagaagaagtttacctgtccttctttcctggcagcgagatgttccttggcacctttaagttctatcccctggccattgggatctacaaagtgcagcggaaggagatggaacctaagtacctcgagaaaacaatgcgccaaagatatatgggactggaagcctctacctggacaatctccaaggtcaacgaggtgcaggctgcccttaccgttgtgagcggcctggggtggaaaaagacgaatgtctctgctgccgcgcgggaatttctcgccaaattcggaatttccatgtga

SEQ ID NO: 7461 - RNA, 702 nt, synthetic construct
  misc_feature 1..702: note = derived and/or modified CDS sequence (opt5) from CHLV(CHLV-Mex07)__EU879062.3__N
  source 1..702: mol_type = other RNA
atgatcgagctggagttcaacgacgtggccgctaataccagctccacatttgatcccgaaattgcctacgtcaacttcaagagaatctatacgaccggcctctcttacgaccacattcggatcttttatattaaagggcgcgaaatcaagacaagcctgaccaaaagatccgagtgggaagttacacttaatctgggaggctggaaggtgaccgtgttcaacacaaattttcctgggaaccgcaattctccggtccccgatgacggactcaccctgcatcggcttagcggctacctggcgagatatctcctggagaaaatcctgaaggtgtccgatcctgagaaggttattatcaaatctaagattatcaaccccctcgctgagaaaaatgggattacgtggagcgacggagaagaagtgtacctgtccttctttcctggcagcgagatgttccttggcacctttaagttctatcccctggccatcgggatttacaaagtccagcggaaggagatggaacctaagtacctcgagaaaacaatgcgccaaagatatatgggactggaagcctctacctggacagtgtccaaggttaacgaggtgcaggctgcccttaccgtcgtgagcggcctggggtggaaaaagacgaatgtgtctgctgccgcgcgggaatttctcgccaaattcggaatctccatgtga

SEQ ID NO: 7462 - RNA, 702 nt, synthetic construct
  misc_feature 1..702: note = derived and/or modified CDS sequence (opt5) from GERV__M19420.1__N
  source 1..702: mol_type = other RNA
atgctggagctcgagttcgaagacgtgcccaacaatatcggcagcacctttgatcctgaatccgggtacacaaacttccagagaaattatctgccgggagtcacgcttgaccaaattcggatcttttacattaagggccgcgagatcaaaaactctctgagcaagagatccgaatgggaggttaccctcaatcttgggggatggaaagtgcccgtgctgaacacaaatttccctggcaaccggaataacgccgtccccgattatgggctgacctttcaccgcatttctggatacctcgctagatatctgctgggcaagtacctcgccgagacagaacctgagaaactgatcatgcggaccaagatcgtgaatccccttgcggaaaagaacggcattacatgggagagcgggcctgaggtttatctgtccttctttccgggagctgaaatgttcctcggcacctttcgcttctaccccctggccatcgggatttacaaagtgcagagaaaggagatggaccctaaatttcttgaaaagacgatgcggcagcgctatctgggaatcgatgcccagacctggacaaccacaaaactcggcgaggtcgaagctgccctgaaggtggtttctgggctgggatggaagaaaaccaatgtgagctccgctgccagagagttcctcagcaagtttggcattcggatgtga

SEQ ID NO: 7463 - RNA, 702 nt, synthetic construct
  misc_feature 1..702: note = derived and/or modified CDS sequence (opt5) from IACOV(BeAn314206)__JN572067.1__N
  source 1..702: mol_type = other RNA
atgagcgagatcattttcgacgatgtgggccagatcacctcctctacatttaaccccgacgtccaatacattaatttcaagaaaaaccacacgaccgggctgaattatgatcagatcagagtgtttttcctcaacggaaagaaagccaaggaaacactggctaaacggagcgaggaatcccttcagctgaattttggcgggtggcgcgttgtggtcatgaacacccatttccctggaaatagaaacatgctcattccggacgaggccatgacactgcaccggctttctggctacctggcgcgctatctcctggaaagaatcctgagcgggcccgagcatgagaaggtggttatcacctccaagattgtgaatcctatcgctgcctctaacggaattacatggaccgatggccccgaagtctacctcagctttttccctggcacggagatgtttctggaatccttcaaattttatccccttgccatcgggatttacaaggtgcagaaaaagatgatggagagcaaatatctggagaaggctatgcggcaaaagtactctggaatggacgccaccctctggacacagcagaaatacgctgaagttaccaatgccctggcggtggtctccaaccttggctggaagaaaagcaatgtgtctgccgctgcccgcgatttcctggctaagtttgggatccagctctga

SEQ ID NO: 7464 - RNA, 702 nt, synthetic construct
  misc_feature 1..702: note = derived and/or modified CDS sequence (opt5) from ILEV(ArB16282)__AM709780.1__N
  source 1..702: mol_type = other RNA
atgatcgagctggaatttcacgacgtgaccgccaacacaagctccacgtttgatcccgaggtcgcttacgccaatttcaagcggattcataccaacggcctcaattatgaccacatcagaattttctacatcaaagggcgcgaaattaagacatctctggcgaaaagaagcgagtgggaagttacccttaacctgggaggctggaagatctccgtgtataatacaaaattccctgggaaccggaataacccggtgcccgatgacggactcaccctgcatcgcctttctggctttctggctagatacctcctggagaagatgctgaaggtcagcgagcctgaaaaactcatcattaagtccaaaatcattaatcccctggccgagaagaacgggatcacatggtatgatggagaagaggtgtacctttctttctttcctggcagcgagatgtgcctgggcacccaggacttctatcccatggccattgaattttaccaagttcagcggaaagagatggaacctaagttcctcgagaagacgctgaaacagcgctcccttgggctggaaccgagcacctggacaatctctcagctcgtgaagctgcaatccgctctgaccgtcgtgagcggactcggctggaaaaagacaaatgttggggccgctgccagaaactttctggcgaaattcggaattaatatgtga

SEQ ID NO: 7465 - RNA, 702 nt, synthetic construct
  misc_feature 1..702: note = derived and/or modified CDS sequence (opt5) from ILEV(HB80P125)__AM709779.1__N
  source 1..702: mol_type = other RNA
atgatcgagctggaatttcacgacgtgaccgccaacacaagctccacgtttgatcccgaggtcgcttacgccaatttcaagcggattcataccaacggcctcaattatgaccacatcagaattttctacatcaaagggcgcgaaattaagacatctctggcgaaaagaagcgagtgggaagttacccttaacctgggaggctggaagatcgctgtgtataatacaaacttccctgggaatcggaacaatccggtgcccgatgacggactcaccctgcatcgcctttccggctacctggccagatgcctcctggagaaaatgctgaaggtctctgagcctgaaaagcagatcattaaaagcaagatcattaaccccctcgccgagaaaaatgggatcacatgggatgacggagaagaggtgtatctgtcctttttccctggctctgagatgtttcttggcaccttccggttttaccccctggctattgggatctataaggttcaacgcaaagaaatggagcctaagtacctcgaaaagacgatgagacagcggtacatgggactggaggccagcacctggacaatttccaaacttgctgaagtgcagagcgccctgaccgtcgtgtctggcctcgggtggaagaaaacaaacgtttccgcggccgctcgcgatttcctggccaagtttggaatcaatatgtga

SEQ ID NO: 7466 - RNA, 702 nt, synthetic construct
  misc_feature 1..702: note = derived and/or modified CDS sequence (opt5) from ILEV(ILESHA/8e)__KC608151.1__N
  source 1..702: mol_type = other RNA
atgatcgagctggaatttcacgacgtgaccgccaacacaagctccacgtttgatcccgaggtcgcttacgccaatttcaagcggattcataccaacggcctcaattatgaccacatcagaattttctacatcaaagggcgcgaaattaagacatctctggcgaaaagaagcgagtgggaagttacccttaacctgggaggctggaagatcgctgtgtataatacaaacttccctgggaatcggaacaatccgatccccgatgacggactcaccctgcatcgcctttccggctacctggccagatatctcctggagaaaatgctgaaggtgtctgagcctgaaaagcagattatcaaaagcaagattatcaaccccctcgccgagaaaaatgggattacatgggatgacggagaagaggtctacctgtcctttttccctggctctgagatgtttcttggcaccttccggttttatcccctggctatcgggatttacaaggtgcaacgcaaagaaatggagcctaagtacctcgaaaagacgatgagacagcggtatatgggactggaggccagcacctggacaatctccaaacttgctgaagttcagagcgccctgaccgtggtctctggcctcgggtggaagaaaacaaacgtgtccgcggccgctcgcgatttcctggccaagtttggaatcaatatgtga

SEQ ID NO: 7467 - RNA, 702 nt, synthetic construct
  misc_feature 1..702: note = derived and/or modified CDS sequence (opt5) from ILEV(R5964)__AY729651.1__N
  source 1..702: mol_type = other RNA
atgatcgagctggaatttcacgacgtgaccgccaacacaagctccacgtttgatcccgaggtcgcttacgccaatttcaagcggattcataccaacggcctcaattatgaccacatcagaattttctacatcaaagggcgcgaaattaagacatctctggcgaaaagaagcgagtgggaagttacccttaacctgggaggctggaagatcgctgtgtataatacaaacttccctgggaatcggaacaatccgatccccgatgacggactcaccctgcatcgcctttccggctacctggccagatatctcctggagaaaatgctgaaggtgtctgagcctgaaaagcagattatcaaaagcaagattatcaaccccctcgccgagaaaaatgggattacatgggatgacggagaagaggtctacctgtcctttttccctggctctgagatgtttcttggcaccttccggttttatcccctggctatcgggatttacaaggtgcaacgcaaagaaatggagcctaagtacctcgaaaagacgatgagacagcggtatatgggactggaggccagcacctggacaatctccaaacttgctgaagttcagagcgccctgaccgtggtctctggcctcgggtggaagaaaacaaacgtgtccgcgccggcccgcgatttcctggctaagtttggaatcaatatgtga

SEQ ID NO: 7468 - RNA, 702 nt, synthetic construct
  misc_feature 1..702: note = derived and/or modified CDS sequence (opt5) from MAGV__D13783.1__N
  source 1..702: mol_type = other RNA
atgatcgagctggagttcaacgacgtggccgctaataccagctccacatttgatcccgaaattgcctacgtcaacttcaagagaatccacacgaccggcctctcttatgaccatattcgggttctgtacatcaaagggcgcgaaattaagacaagccttaccaaaagatccgagtgggaagtgacactgaatctcggaggctggaaggtggcggtctttaacaccaatttccctgggaaccgcaattctccggtgcccgatgacggactgacacttcaccggctgagcggctttctcgctagatatctgctggagaaaatcctcaaggtttccgatcctgagaagctgatcattaaatctaagatcattaacccccttgccgagaaaaatgggatcacctgggccgacggagaagaagtgtacctgagcttctttcctggctccgagatgttcctcggcacgtttaagttctatcccctggctattgggatctacaaagtccagaagaaggagatggaacctaaatatcttgagaagaccatgcggcaacgctacatgggactggaagccgctacatggaccgtgagcaaagttaacgaggtgcaggccgcgctcacagtcgtgtctggcctggggtggaagaaaaccaatgtgtccgccgctgccagagaatttctggctaagttcggaattaacatgtga

SEQ ID NO: 7469 - RNA, 702 nt, synthetic construct
  misc_feature 1..702: note = derived and/or modified CDS sequence (opt5) from MAGV(7272)__KX100103.1__N
  source 1..702: mol_type = other RNA
atgatcgagctggagttcaacgacgtggccgctaataccagctccacatttgatcccgaaattgcctacgtcaacttcaagagaatccacacgaccggcctctcttatgaccatattcgggttctgtacatcaaagggcgcgaaattaagacaagccttaccaaaagatccgagtgggaagtgacactgaatctcggaggctggaaggtggcggtctttaacaccaatttccctgggaaccgcaattctccggtgcccgatgacggactgacacttcaccggctgagcggctttctcgctagatatctgctggagaaaatcctcaaggtttccgatcctgagaagctgatcattaaatctaagatcattaacccccttgccgagaaaaatgggatcacctgggccgacggagaagaagtgtacctgagcttctttcctggctccgagatgttcctcggcacgtttaagttctatcccctggctattgggatctacaaagtccagcggaaggagatggaacctaagtatcttgagaaaaccatgcgccaaagatacatgggactggaagccgctacatggaccgtgagcaaggttaacgaggtgcaggccgcgctcacagtcgtgtctggcctggggtggaaaaagaccaatgtgtccgccgctgcccgggaatttctggctaaattcggaattaacatgtga

SEQ ID NO: 7470 - RNA, 702 nt, synthetic construct
  misc_feature 1..702: note = derived and/or modified CDS sequence (opt5) from MAGV(3363)__KX100106.1__N
  source 1..702: mol_type = other RNA
atgatcgagctggagttcaacgacgtggccgctaataccagctccacatttgatcccgaaattgcctacgtcaacttcaagagaatctatacgaccggcctctcttacgaccacattcggatcttttatattaaagggcgcgaaatcaagacaagcctgaccaaaagatccgagtgggaagttacacttaatctgggaggctggaaggtgaccgtgttcaacacaaattttcctgggaaccgcaattctccggtccccgatgacggactcaccctgcatcggcttagcggctacctggcgagatatctcctggagaaaatcctgaaggtgtccgatcctgagaaggttattatcaaatctaagattatcaaccccctcgctgagaaaaatgggattacgtggagcgacggagaagaagtgtacctgtccttctttcctggcagcgagatgttccttggcacctttaagttctatcccctggccatcgggatttacaaagtccagcggaaggagatggaacctaagtacctcgagaaaacaatgcgccaaagatatatgggactggaagcctctacctggacaatctccaaggtgaacgaggttcaggctgcccttaccgtggtcagcggcctggggtggaaaaagacgaatgtgtctgctgccgcgcgggaatttctcgccaaattcggaatctccatgtga

SEQ ID NO: 7471 - RNA, 702 nt, synthetic construct
  misc_feature 1..702: note = derived and/or modified CDS sequence (opt5) from NRIV(DakArY357/6e)__AY593727.1__N
  source 1..702: mol_type = other RNA
atgatcgagctggaatttcacgacgtgaccgccaacacaagctccacgtttgatcccgaggtcgcttacgccaatttcaagcggattcataccaacggcctcaattatgactacatcagaattttctatatcaaagggcgcgaaattaagacatctctggcgaaaagaagcgagtgggaagttacccttaacctgggaggctggaagatcgctgtgtacaatacaaacttccctgggaatcggaacaatccgatccccgatgacggactcaccctgcaccgcctttccggctatctggccagatacctcctggagaaaatgctgaaggtgtctgagcctgaaaagcagattatcaaaagcaagattatcaaccccctcgccgagaaaaatgggattacatgggatgacggagaagaggtctatctgtcctttttccctggctctgagatgtttcttggcaccttccggttttaccccctggctatcgggatttacaaggtgcaacgcaaagaaatggagcctaagtatctcgaaaagacgatgagacagcggtacatgggactggaggccagcacctggacaatctccaaacttgctgaagttcagagcgccctgaccgtggtctctggcctcgggtggaagaaaacaaacgtgtccgcggccgctcgcgatttcctggccaagtttggaatcaatatgtga

SEQ ID NO: 7472 - RNA, 702 nt, synthetic construct
  misc_feature 1..702: note = derived and/or modified CDS sequence (opt5) from NORV__X73470.1__N
  source 1..702: mol_type = other RNA
atgatcgagctggaatttaacgacgtggccgctaataccagctccacatttgatcccgaggtcgcctacattaacttcaagagagtttatacgaccggcctctcttacgaccacatccggattttctatatcaaagggcgcgaaattaagacaagcctgaccaaaagatccgagtgggaagtgacacttaatctgggaggctggaaggtgaccgtcttcaacacaaattttcctgggaaccgcaattctccggtgcccgatgacggactcaccctgcatcggcttagcggcttcctggcgagatacctcctggagaaaatcctgaaggtttccgagcctgaaaagctcatcattaaatctaagatcattaaccccctggctgagaaaaatgggatcacgtggaccgatggagaagaggtgtatcttagctttttccctggctccgagatgtttctgggcacattcaagttttaccccctcgccattgggatctataaagtccagcggaaggaaatggagcctaagtacctggagaaaaccatgcgccaaagatacatgggacttgaagccagcacatggaccatttctaaggtgaacgaagttcaggctgccctgacggtggtctccggcctcgggtggaaaaagacaaatgtgagcgctgccgcgcgggagttcctggccaaatttggaatcaacatgtga

SEQ ID NO: 7473 - RNA, 702 nt, synthetic construct
  misc_feature 1..702: note = derived and/or modified CDS sequence (opt5) from POTV(89-3380)__AY729652.1__N
  source 1..702: mol_type = other RNA
atgatcgagctggagttcaacgacgtggccgctgataccagctccacatttgaccccgaaattgcctacgtcaatttcaagagaatccacacgaccggcctctcttatgatcatattcggatcttttacattaaagggcgcgaaatcaagacaagcctgaccaaaagatccgagtgggaagttacacttaacctgggaggctggaagatcaccgtgttcaatacaaactttcctgggaatcggaactctccggtgcccgacgatggactcaccctgcaccgccttagcggctatctggcgagatacctcctggagaaaattctgaaggtctccgaccctgagaaggtgatcattaaatctaagatcattaatcccctcgctgagaaaaacgggatcacgtggagcgatggagaagaagtttatctgtccttctttcctggcagcgagatgttccttggcacctttaagttctaccccctggccattgggatctataaagtgcagcggaaggagatggaacctaagtacctcgagaaaacaatgcgccaaagatacatgggactggaagcctctacctggacagtctccaaggtgaatgaggttcaggctgcccttaccgtggtcagcggcctggggtggaaaaagacgaacgtgtctgctgccgcgcgggaatttctcgccaaattcggaatctccatgtga

SEQ ID NO: 7474 - RNA, 702 nt, synthetic construct
  misc_feature 1..702: note = derived and/or modified CDS sequence (opt5) from SHOV(4042)__EU564831.1__N
  source 1..702: mol_type = other RNA
atgatcgagctggagttccacgacgtggccgctaacaccagctccacatttgatcccgaagtcgcctacgcgaatttcaagagagttcatacgaccggcctctcttatgaccacattcggatcttttacattaaagggcgcgaaatcaagacaagcctggctaaaagatccgagtgggaagtgacccttaacctgggaggctggaagattacagtgtataataccaacttccctgggaatcggaacaatccggtccccgatgacggactcacactgcatcgcctttctggctttctggccagatacctcctggagaaaatgctgaaggtgagcgagcctgaaaagctcatcatcaaatccaagattatcaaccccctggccgagaaaaatgggattacctggacggatggagaagaggtttatctttctttctttcctggcgctgagatgttcctgggcacctttaagttctaccccctcgccatcgggatttataaagtgcagcggaaggaaatggagcctaagtacctggagaaaacaatgcgccaaagatacatgggacttgaagctgccacctggacagtcagcaagctgaccgaagtgcaggcggccctcacggttgtgtccggcctggggtggaaaaagacaaacgtcagcgctgccgctcgggactttctggccaaattcggaatctctatgtga

SEQ ID NO: 7475 - RNA, 702 nt, synthetic construct
  misc_feature 1..702: note = derived and/or modified CDS sequence (opt5) from TENV(TSV-FE3-66FB)__FJ943505.1__N
  source 1..702: mol_type = other RNA
atgatcgaactggagttcaacgacgtggccgctaataccagctccacatttgatcccgaagtcggctacgttaacttcaagagagtgcacacgaccgggctctcttatgaccatattcggatcttttacattaaaggacgcgaaatcaagacaagcctgaccaaaagatccgagtgggaagtgacacttaatctgggcgggtggaaggtcaccgtgttcaacacaaattttcctggaaaccgcaattctccggttcccgatgacggcctcaccctgcaccggcttagcgggttcctggccagatatctcctggagaaaattctgaaggtgtccgatcctgagaagctcatcatcaaatctaagattatcaaccccctggcggagaaaaatggaattacgtgggctgacggcgaagaagtctaccttagctttttccctggctccgagatgtttctggggaccttcaagttttatcccctcgccatcggaatttacaaagtgcagcggaaggagatggaacctaagtatctggagaaaacaatgcgccaaagatacatgggccttgaagccgctacctggacaatcagcaaggttaacgaggtgcagtctgccctgaccgtcgtgtccgggctcggatggaaaaagacgaatgtgagcgctgccgcgcgggagttcctggccaaatttggcattaacatgtga

SEQ ID NO: 7476 - RNA, 702 nt, synthetic construct
  misc_feature 1..702: note = derived and/or modified CDS sequence (opt5) from XINV(BeH388464)__EU564830.1__N
  source 1..702: mol_type = other RNA
atgctggaactcgagttcaacgacgtggccgctaataccagctccacatttgatcccgaagtcggctacgccaacttcaagagaatccacacgaatgggctgtcttatgacaacattcggatcttttacattaaaggacgcgaaatcaagaccagccttgcgaaaagatccgagtgggaagttacactgaatctcggcgggtggaagattaccgtgtataacacaaatttccctggaaaccggaatcatccgatccccgatgacggcctgaccatccaccgcctttctgggtacctggctagatatctcctggagaaaattctgaaggtgagcgatcctgagaagctcctgatcaaaacaaagattatcaacccccttgccgagaaaaatggaattacctggaacgacggcgaagaagtctacctgtcctttttccctggctctgagatgtttctcgggacgttcaagttttatcccctggccatcggaatttacaaagtgcagcggaaggagatggaacctaagtaccttgagaaagctatgcgccaaagatatatgggcctggaaagcgccacctggacagtttccaagctcaatgaggtgcagagcgctctgaccgtcgtgtctgggctgggatggaaaaagacaaacgtttccgccgcggcccgggagttcctcgctaaatttggcatcaatatgtga

SEQ ID NO: 7477 - RNA, 702 nt, synthetic construct; identical to SEQ ID NO: 7439
  misc_feature 1..702: note = derived and/or modified CDS sequence (opt5) from NRIV(9800535)__JX857328.1__N
  source 1..702: mol_type = other RNA

SEQ ID NO: 7478 - RNA, 702 nt, synthetic construct
  misc_feature 1..702: note = derived and/or modified CDS sequence (opt5) from NRIV(Adrar)__KJ716848.1__N
  source 1..702: mol_type = other RNA
atgatcgagctggaatttcacgacgtggccgctaacaccagctccacatttgatcccgaggtcgcctacgcgaatttcaagagaatttatacgaccggcctctcttacgaccatatccggattttctatatcaaagggcgcgaaattaagacaagcctggctaaaagatccgagtgggaagttacccttaacctgggaggctggaagatcacagtgtacaataccaacttccctgggaatcggaacaatccggtgcccgatgacggactcacactgcaccgcctttctggctttctggccagatatctcctggagaaaatgctgaaggtcagcgagcctgaaaagctcatcattaaatccaagatcattaaccccctggccgagaaaaatgggatcacctggaacgatggagaagaggtgtacctttctttctttcctggcagcgagatgttcctgggcacgtttcggttctatcccctcgctattgggatctacaaggttcagcgcaaagaaatggagcctaagtacctggaaaagaccatgagacaacggtatatgggacttgaggccgctacatggaccgtgtccaaactgacagaagtccagagcgccctcaccgtggtttcttccctgggctggaagaaaacgaatgtgagcgcggccgctcgcgactttctggccaagttcgggattaacatgtga

SEQ ID NO: 7479 - RNA, 702 nt, synthetic construct
  misc_feature 1..702: note = derived and/or modified CDS sequence (opt5) from NRIV(D28542/4e)__KC608154.1__N
  source 1..702: mol_type = other RNA
atgatcgagctggagttccacgacgtggccgctaacaccagctccacatttgatcccgaagtcgcctacgcgaatttcaagagagtttatacgaccggcctctcttacgaccatattcggatcttttatattaaagggcgcgaaatcaagacaagcctggctaaaagatccgagtgggaagtgacccttaacctgggaggctggaagattacagtgtacaataccaacttccctgggaatcggaacaatccggtccccgatgacggactcacactgcaccgcctttctggctttctggccagatatctcctggagaaaatgctgaaggtgagcgagcctgaaaagctcatcatcaaatccaagattatcaaccccctggccgagaaaaatgggattacctggaacgatggagaagaggtttacctttctttctttcctggcagcgagatgttcctgggcacgtttcggttctatcccctcgctatcgggatttacaaggtgcagcgcaaagaaatggagcctaagtacctggaaaagaccatgagacaacggtatatgggacttgaggccgctacatggaccgtctccaaactgacagaagtgcagagcgccctcaccgttgtgtcttccctgggctggaagaaaacgaatgtcagcgcggccgctcgcgactttctggccaagttcgggatcaacatgtga

SEQ ID NO: 7480 - RNA, 702 nt, synthetic construct
  misc_feature 1..702: note = derived and/or modified CDS sequence (opt5) from NRIV(SUD-HKV141)__JX857322.1__N
  source 1..702: mol_type = other RNA
atgatcgagctggagttccacgacgtggccgctaacaccagctccacatttgatcccgaagtcgcctacgcgaatttcaagagagttcatacgaccggcctctcttatgaccacattcggatcttttacattaaagggcgcgaaatcaagacaagcctggctaaaagatccgagtgggaagtgacccttaacctgggaggctggaaggtgacagtctataataccaacttccctgggaatcggaacaatccggtgcccgatgacggactcacactgcatcgcctttctggctttctggccagatacctcctggagaaaatgctgaaggttagcgagcctgaaaagctcattatcaaatccaagatcattaaccccctggccgagaaaaatgggatcacctggaacgatggagaagaggtgtatctttctttctttcctggcagcgagatgttcctgggcacgtttcggttctaccccctcgctattgggatctataaggtccagcgcaaagaaatggagcctaagtacctggaaaagaccatgagacaacggtacatgggacttgaggccgctacatggaccgtgtccaaactgacagaagttcagagcgccctcaccgtggtctcttccctgggctggaagaaaacgaatgtgagcgcggccgctcgcgactttctggccaagttcgggattaacatgtga

SEQ ID NO: 7481 - RNA, 705 nt, synthetic construct
  misc_feature 1..705: note = derived and/or modified CDS sequence (opt5) from BWAV(M459)__NC_034480.1__N
  source 1..705: mol_type = other RNA
atgagcgacctgatcttctacgatgtggactccgtcaacgccaatgagtttgatcccgacaccggctatctcgatttcaagaacaattaccctggggctctgaacacaaatacggccagaacctttttccttaacgcggctaaagccaagaatgttctgcggaacaaaccggacaagaaagtgaatcccaagtttggaaactgggaagtggaggtcgtgaataaccacttccctggcaatcgcaacaatcccattgggaaggatgacctcacactgcatagaatctctggatatcttgcccggtggattctggaagagtacaaacgcgatgacgaaagcgagaaggagatcattgaatccaccgttatcaaccctatcgctgagtctaacggcattagatggagcgatggggccgaaatctatctctcctttttccccggaacagagatgtttctggagcctttcaaattttacccgctggctattggcatctatcgggtgaagcacaaaatgatggacgcccagttcctcaagaaggcgctgcgccaaagatacggcaaaatgaccgccgaaaagtggatgtctacaaaagtcaagaccattggggaggctgtgcggaatgttgaaaaacttaagtggggaaaaggcgggctgagcgatgccgctcgcaactttctcaagaagttcgacatcgccatgatttga

SEQ ID NO: 7482 - RNA, 705 nt, synthetic construct
  misc_feature 1..705: note = derived and/or modified CDS sequence (opt5) from BWAV(M459)__EU564827.1__N
  source 1..705: mol_type = other RNA
atgagcgacctgatcttctacgatgtggactccgtcaacgccaatgagtttgatcccgacaccggctatctcgatttcaagaacaattaccctggggctctgaacacaaatacggccagaacctttttccttaacgcggctaaagccaagaatgttctgcggaacaaaccggacaagaaagtgaatcccaagtttggaaactgggaagtggaggtcgtgaataaccacttccctggcaatcgcaacaatcccattgggaaggatgacctcacactgcatagaatctctggatatcttgcccggtggattctggaagagtacaaacgcgatgacgaaagcgagaaggagatcattgaatccaccgttatcaaccctatcgctgagtctaacggcattagatggagcgatggggccgaaatctatctctcctttttccccggaacagagatgtttctggagcctttcaaattttacccgctggctattggcatctatcgggtgaagcacaaaatgatggacgcccagttcctcaagaaggcgctgcgccaaagatacggcaaaatgaccgccgaaaagtggatgtctacaaaagtcaaggctattggggaggccgtgcggaatgttgaaaaacttaagtggggaaaaggcgggctgagcgatgctgcccgcaactttctcaagaagttcgacatcgcgatgatttga

SEQ ID NO: 7483 - RNA, 705 nt, synthetic construct
  misc_feature 1..705: note = derived and/or modified CDS sequence (opt5) from BWAV(UgAr1888)__KJ867185.1__N
  source 1..705: mol_type = other RNA
atgagcgacctgatcttctacgatgtggactccgtcaacgccaatgagtttgatcccgacaccggctatctcgatttcaagaacaattaccctggggctctgaacacaaatacggccagaacctttttccttaacgcggctaaagccaagaatgttctgcggaacaaaccggacaagaaagtgaatcccaagtttggaaactgggaagtggagattgtcaataaccacttccctggcaatcgcaacaatcccatcgggaaggatgacctcacactgcatagaatttctggatatcttgcccggtggatcctggaagagtacaaacgcgatgacgaaagcgagaaggagattatcgaatccaccgtgatcaaccctattgctgagtctaacggcatcagatggagcgatggggccgaaatttatctctcctttttccccggaacagagatgtttctggagcctttcaaattttacccgctggctatcggcatttatcgggttaagcacaaaatgatggacgcccagttcctcaagaaggcgctgcgccaaagatacggcaaaatgaccgccgaaaagtggatgtctacaaaagtgaaggctatcggggaggccgtccggaatgtggaaaaacttaagtggggaaaaggcgggctgagcgatgctgcccgcaactttctcaagaagttcgacattgcgatgatctga

SEQ ID NO: 7484 - RNA, 708 nt, synthetic construct
  misc_feature 1..708: note = derived and/or modified CDS sequence (opt5) from BWAV/PGAV(SAAr1)__EU564828.1__N
  source 1..708: mol_type = other RNA
atgagcggcgacctggtgttctacgatgtcgactccgttaactctaatgcctttgatcccgacgctgggtatgtggccttcagcaacaatcaccctggagcgctcaacatcaccacagctagaacgtttttcctgaatgccgccaaggctaaaggcgtgcttcggaacaagccggataaaaaggtcaaacccaagtttggggactgggaggtggaaattgttaataaccatttccctggaaatcgcaacaataccatcggcgaggatgacctgacactccacagaatttccgggtacctggcccggtgggtgcttgaggaacattctaaggatgacgaaagcgagaaagagctgatcgaatccaccattgtcaaccccatcgctgagtctaatggaatcaagtggagcgatggcgccgcgatttatctctcctttttccctggcacagaaatgtttctggagcccttcaaatttttccctctggccatcgggatttaccgcgtgaagcacaaaatgatggacgctcagtttctcaagaaggccctgagacaacggtatggaaaacttaccgctgagaagtggatggccacaaaagttaagagcatcggcgaagcggtgcgcgccgtcgagaaactgaagtgggggaaaggaggcatttctgatgctgccagaaccttcctcaagaagttcgacatcgctctgatttga

SEQ ID NO: 7485 - RNA, 708 nt, synthetic construct; identical to SEQ ID NO: 7484
  misc_feature 1..708: note = derived and/or modified CDS sequence (opt5) from BWAV/PGAV(191B-07)__KJ867179.1__N
  source 1..708: mol_type = other RNA

SEQ ID NO: 7486 - RNA, 708 nt, synthetic construct
  misc_feature 1..708: note = derived and/or modified CDS sequence (opt5) from CEV(283)__KX817314.1__N
  source 1..708: mol_type = other RNA
atgagcgacctggtgttctacgatgtcgcctccaccggcgctaacgggtttgaccccgatgccggatatgttgacttctgcgcgaagtacggcgagtctatcaatctcgctgccgtgagaatctttttcctgaacgccgctaaggccaaggctgcccttagccggaaacctgaacgcaaggcgaatccgaaatttggggagtggcaagtggaagtcgtgaacaatcacttccccgccaacagaaataaccctattggaaataacgatctgacaattcatcggatctccggctatctcgctcgctgggttctggagcagtacaaggaaaatgaggacgagtctcagagagaacttgtgaagacgaccgtcattaaccccatcgccgagagcaatgggatccggtgggaaaacggagctgagatttatctggcctttttccctggcacagagatgtttctcgaaaccttcaaattttaccccctgacaatcggcatttatcgcgtgaagaatgggatgatggattcccagtacctgaaaaaggcgctcagacagcggtacggatctctgaccgccgagaaatggatgagccaaaagacaggcatgatcgctaagtcccttaaagaagttgagcagctgaagtgggggcgcggaggcctcagcgacaccgccagaacgttcctgcagaaatttgggattaaacttccttga

SEQ ID NO: 7487 - RNA, 708 nt, synthetic construct
  misc_feature 1..708: note = derived and/or modified CDS sequence (opt5) from CEV(BFS-283)__U12797.1__N
  source 1..708: mol_type = other RNA
atgagcgacctggtgttctacgatgtcgcctccaccggcgctaacgggtttgaccccgatgccggatatgttgacttctgcgcgaagcacggcgagtctatcaatctcgctgccgtgagaatctttttcctgaacgccgctaaggccaaggctgcccttagccggaaacctgaacgcaaggcgaatccgaaatttggggagtggcaagtggaagtcgtgaacaatcatttccccgccaacagaaataaccctattggaaataacgatctgacaattcaccggatctccggctacctcgctcgctgggttctggagcagtataaggaaaatgaggacgagtctcagagagaacttgtgaagacgaccgtcattaaccccatcgccgagagcaatgggatccggtgggaaaacggagctgagatttacctggcctttttccctggcacagagatgtttctcgaaaccttcaaattttatcccctgacaatcggcatttaccgcgtgaagaatgggatgatggattcccagtatctgaaaaaggcgctcagacagcggtacggatctctgaccgccgagaaatggatgagccaaaagacaggcatgatcgctaagtcccttaaagaagttgagcagctgaagtgggggcgcggaggcctcagcgacaccgccagaacgttcctgcagaaatttgggattaaacttccttga

SEQ ID NO: 7488 - RNA, 708 nt, synthetic construct
  misc_feature 1..708: note = derived and/or modified CDS sequence (opt5) from CHATV(Mohko ILO8-3)__KF719221.1__N
  source 1..708: mol_type = other RNA
atgagcgacctggtgttctacgatgtcgcctccaccggcgctaacgggtttgaccccgatgagggatatatggccttctgcgttaagcacgcggaatctatcagcctcgctgccgtgagaatctttttcctgaatgccgctaaagccaaggctgcccttgcgcggaaacctgagaagaaagcctccccgaagtttggcgaatggcaagtggagattgtcaacaatcatttccccgggaaccgcaataaccctattggaaataacgacctgacagtgcacagactctctggctacctggctcggtgggttcttgaacagtataaggagaatgaggatgaaagccagcgcgagctgatcaaaacgaccgtgattaaccccatcgccgaatccaatggggtcagatgggactctggacctgagatctacctcagctttttccccggcacagagatgtttctggaaaccttcaagttttatcctctgacaattggcatctaccgggtgaaacaggggatgatggatccgcagtatctcaagaaagctctgcgccaaagatacggaacccttacagccgacaagtggatgtcccagaaggttaccgcgattgccaaaagcctgaaggaggtggaacagctcaaatggggccgcgggggactgtctgatacggctcggaccttccttcagaagtttggcatcagactgccctga

SEQ ID NO: 7489 - RNA, 708 nt, synthetic construct
  misc_feature 1..708: note = derived and/or modified CDS sequence (opt5) from CHATV(Mohko M07-1)__KF719224.1__N
  source 1..708: mol_type = other RNA
atgagcgacctggtgttctacgatgtcgcctccaccggcgctaacgggtttgaccccgatgagggatatatggccttctgcgttaagcacgcggaatctatcaatctcgctgccgtgagaatctttttcctgaacgccgctaaagccaaggctgcccttgcgcggaaacctgagaagaaagccagcccgaagtttggcgaatggcaagtggagattgtcaataaccatttccccgggaatcgcaacaatcctattggaaacaatgacctgacagtgcacagactctccggctacctggctcggtgggttcttgaacagtataaggagaacgaggatgaatctcagcgcgagctgatcaaaacgaccgtgattaatcccatcgccgaaagcaacggggtcagatgggactccggacctgagatctacctcagctttttccccggcacagagatgtttctggaaaccttcaagttttatcctctgacaattggcatctaccgggtgaaacaggggatgatggatccgcagtatctcaagaaagctctgcgccaaagatacggaacccttacagccgacaagtggatgtctcagaaggttaccgcgattgccaaatccctgaaggaggtggaacagctcaaatggggccgcgggggactgagcgatacggctcggaccttccttcagaagtttggcatcagactgccctga

SEQ ID NO: 7490 - RNA, 708 nt, synthetic construct
  misc_feature 1..708: note = derived and/or modified CDS sequence (opt5) from CHATV(Mohko S07-2)__KF719233.1__N
  source 1..708: mol_type = other RNA
atgagcgacctggtgttctacgatgtcgcctccaccggcgctaacgggtttgaccccgatgagggatatatggccttctgcgttaagcacgcggaatctatcaatctcgctgccgtgagaatctttttcctgaacgccgctaaagccaaggctgcccttgcgcggaaacctgagaagaaagccagcccgaagtttggcgaatggcaagtggagattgtcaataaccatttccccgggaatcgcaacaatcctattggaaacaatgacctgacagtgcacagactctccggctacctggctcggtgggttcttgaacagtataaggagaacgaggatgaatctcagcgcgagctgatcaaaacgaccgtgattaatcccatcgccgaaagcaacggggtcagatgggactccggacctgagatctacctcagctttttccccggcacagagatgtttctggaaaccttcaaggtgtatcctctgacaaccggcatttaccgggttaaacaggggatgatggatccgcagtatctcaagaaagctctgcgccaaagatacggaacacttaccgccgacaagtggatgtctcagaaggtgacggcgatcgccaaatccctgaaggaggtcgaacagctcaaatggggccgcgggggactgagcgataccgctcggacatttcttcagaagttcggcattagactgccctga

SEQ ID NO: 7491 - RNA, 708 nt, synthetic construct
  misc_feature 1..708: note = derived and/or modified CDS sequence (opt5) from CHATV(LEIV-11483)__FJ853592.1__N
  source 1..708: mol_type = other RNA
atgagcgacctggtgttctacgatgtcgcctccaccggcgctaacgggtttgaccccgatgagggatatatggccttctgcgttaagcacggccagtctgtgaatctcgcggctgtgagaatctttttcctgaacgccgccaaagctaaggccgctcttgcccggaaacctgaaaagaaagcgagcccgaagtttggggagtggcaagtcgaaattgtgaataaccatttccccggaaatcgcaacaatcctatcggcaacaatgacctgacaattcacagactctccgggtacctggcccggtgggttcttgagcagtataaggaaaacgaggatgagtctcagcgcgaactgatcaaaacgaccgtgattaatcccatcgctgagagcaacggagtcagatgggactccggcgccgaaatctacctcagctttttccctggcacagagatgtttctggagaccttcaagttttatcccctgacaattgggatctaccgggtgaaacagggaatgatggatcctcaatatctcaagaaagctctgcgccagagatacggcacccttacagccgacaagtggatgtctcagaaggttaccgcgattgccaaatccctgaaggaagtggagcagctcaaatgggggcggggaggcctgagcgatacggctcgcaccttccttcaaaagtttgggatcagactgccgtga

SEQ ID NO: 7492 - RNA, 708 nt, synthetic construct
  misc_feature 1..708: note = derived and/or modified CDS sequence (opt5) from CHATV(LEIV-11552)__EU479702.1__N
  source 1..708: mol_type = other RNA
atgagcgacctggtgttctacgatgtcgcctccaccggcgctaacgggtttgaccccgatgagggatatatggccttctgcgttaagcacggccagtctgtgaatctcgcggctgtgagaatctttttcctgaacgccgccaaagctaaggccgctcttgcccggaaacctgaaaagaaagcgagcccgaagtttggggagtggcaagtcgaaattgtgaataaccatttccccggaaatcgcaacaatcctatcggcaacaatgacctgacaattcacagactctccgggtacctggcccggtggatccttgagcagtataaggaaaacgaggatgagtctcagcgcgaactgattaaaacgaccgttatcaatcccatcgctgagagcaacggagtgagatgggactccggcgccgaaatttacctcagctttttccctggcacagagatgtttctggagaccttcaagttttatcccctgacaatcgggatttaccgggtcaaacagggaatgatggatcctcaatatctcaagaaagctctgcgccagagatacggcacccttacagccgacaagtggatgtctcagaaggtgaccgcgatcgccaaatccctgaaggaagttgagcagctcaaatgggggcggggaggcctgagcgatacggctcgcaccttccttcaaaagtttgggattagactgccgtga

SEQ ID NO: 7493 - RNA, 708 nt, synthetic construct
  misc_feature 1..708: note = derived and/or modified CDS sequence (opt5) from CHATV(LEIV-13107)__FJ946829.1__N
  source 1..708: mol_type = other RNA
atgagcgacctggtgttctacgatgtcgcctccaccggcgctaacgggtttgaccccgatgagggatatatggccttctgcgttaagcacggccagtctgtgaatctcgcggctgtgagaatctttttcctgaacgccgccaaagctaaggccgctcttgcccggaaacctgaaaagaaagcgaatccgaagtttggggagtggcaagtcgaaattgtgaacaatcatttccccggaaaccgcaataaccctatcggcaataacgacctgacaattcacagactcagcgggtacctggcccggtgggttcttgagcagtataaggaaaatgaggatgagtcccagcgcgaactgatcaaaacgaccgtgattaaccccatcgctgagtctaatggagtcagatgggacagcggcgccgaagtgtacctctcctttttccctggcacagagatgtttctggagaccttcaagttttatcccctgacaatcgggatttaccgggttaaacagggaatgatggatcctcaatatctcaagaaagctctgcgccagagatacggcacccttacagccgacaagtggatgtctcagaaggtgaccgcgatcgccaaaagcctgaaggaagtcgagcagctcaaatgggggcggggaggcctgtccgatacggctcgcaccttccttcaaaagtttgggattagactgccgtga

SEQ ID NO: 7494 - RNA, 708 nt, synthetic construct
  misc_feature 1..708: note = derived and/or modified CDS sequence (opt5) from CHATV(LEIV-17794)__FJ913879.1__N
  source 1..708: mol_type = other RNA
atgagcgacctggtgttctacgatgtcgcctccaccggcgctaacgggtttgaccccgatgagggatatatggccttctgcgttaagcacggccagtctgtgaatctcgcggctgtgagaatctttttcctgaacgccgccaaagctaaggccgctcttgcccggaaacctgaacgcaaggcgagcccgaaatttggggagtggcaagtcgaaattgtgaataaccatttccccggaaatagaaacaatcctatcggcaacaatgacctgacaattcaccggctctccgggtacctggcccgctgggttcttgagcagtataaggaaaacgaggatgagtctcagagagaactgatcaagacgaccgtgattaatcccatcgctgagagcaacggagtccggtgggactccggcgccgaaatctacctcagctttttccctggcacagagatgtttctggagaccttcaaattttatcccctgacaattgggatctaccgcgtgaagcagggaatgatggatcctcaatatctcaaaaaggctctgagacagcggtacggcacccttacagccgacaaatggatgtctcagaaggttaccgcgattgccaagtccctgaaagaagtggagcagctcaagtgggggcgcggaggcctgagcgatacggctagaaccttccttcaaaaatttgggatccggctgccgtga

SEQ ID NO: 7495 - RNA, 708 nt, synthetic construct
  misc_feature 1..708: note = derived and/or modified CDS sequence (opt5) from CHATV(LEIV-17827)__GQ330475.1__N
  source 1..708: mol_type = other RNA
atgagcgacctggtgttctacgatgtcgcctccaccggcgctaacgggtttgaccccgatgagggatatatggccttctgcgttaagtacggcgaatctatcaatctcgcggctgtgagaatctttttcctgaacgccgccaaagctaaggccgctcttgcccggaaacctgagaagaaagcgaatccgaagtttggggaatggcaagtggagattgtcaacaatcacttccccggaaaccgcaataaccctattggcaataacgacctgacaatccatagactcagcgggtatctggcccggtgggtgcttgaacagtacaaggagaatgaggatgaatcccagcgcgagctgattaaaacgaccatcatcaaccccattgctgaatctaatggagttagatgggagagcggcgccgaggtgtatctctcctttttccctggcacagaaatgtttctggagatcttcaagttttaccccctgaccattgggatctatcgggtcaaacagggaatgatggaccctcagtacctcaagaaagctctgcgccaaagatacggcacacttaccgccgataagtggatgtctcagaaggtgacagcgattgccaaaagcctgaaggaagttgagcagctcaaatgggggcggggaggcctgtccgacaccgctcgcacgttccttcagaagtttgggatcagactgccgtga

SEQ ID NO: 7496 - RNA, 708 nt, synthetic construct
  misc_feature 1..708: note = derived and/or modified CDS sequence (opt5) from CHATV(LEIV-17829)__GQ330476.1__N
  source 1..708: mol_type = other RNA
atgagcgacctggtgttctacgatgtcgcctccaccggcgctaacgggtttgaccccgatgagggatatatggccttctgcgttaagtacggcgaatctatcaatctcgcggctgtgagaatctttttcctgaacgccgccaaagctaaggccgctcttgcccggaaacctgagaagaaagcgaatccgaagtttggggaatggcaagtggagattgtcaacaatcacttccccggaaaccgcaataaccctattggcaataacgacctgacaatccatagactcagcgggtatctggcccggtgggtgcttgaacagtacaaggagaatgaggatgaatcccagcgcgagctgattaaaacgaccatcatcaaccccattgctgaatctaatggagttagatgggacagcggcgccgaggtgtatctctcctttttccctggcacagagatgtttctggaaatcttcaagttttaccccctgaccattgggatctatcgggtcaaacagggaatgatggatcctcagtacctcaagaaagctctgcgccaaagatacggcacacttaccgccgacaagtggatgtctcagaaggtgacagcgattgccaaaagcctgaaggaggttgaacagctcaaatgggggcggggaggcctgtccgataccgctcgcacgttccttcagaagtttgggatcagactgccgtga

SEQ ID NO: 7497 - RNA, 708 nt, synthetic construct
  misc_feature 1..708: note = derived and/or modified CDS sequence (opt5) from CHATV(LEIV-18733)__HQ734824.1__N
  source 1..708: mol_type = other RNA
atgagcgacctggtgttctacgatgtcgcctccaccggcgctaacgggtttgaccccgatgagggatatatggccttctgcgttaagtacggcgaatctatcaatctcgcggctgtgagaatctttttcctgaacgccgccaaagctaaggccgctcttgcccggaaacctgagaagaaagcgaatccgaagtttggggaatggcaagtggagattattaacaatcacttccccggaaaccgcaataaccctatcggcaataacgacctgacaattcatagactcagcgggtatctggcccggtgggtccttgaacagtacaaggagaatgaggatgaatcccagcgcgagctgatcaaaacgaccatcattaaccccatcgctgaatctaatggagtgagatgggacagcggcgccgaggtttatctctcctttttccctggcacagagatgtttctggaaattttcaagttttaccccctgaccatcgggatttatcgggtgaaacagggaatgatggatcctcagtacctcaagaaagctctgcgccaaagatacggcacacttaccgccgacaagtggatgtctcagaaggtcacagcgatcgccaaaagcctgaaggaggtggaacagctcaaatgggggcggggaggcctgtccgataccgctcgcacgttccttcagaagtttgggattagactgccgtga

SEQ ID NO: 7498 - RNA, 708 nt, synthetic construct
  misc_feature 1..708: note = derived and/or modified CDS sequence (opt5) from CHATV(LEIV-18895)__GQ330482.1__N
  source 1..708: mol_type = other RNA
atgagcgacctggtgttctacgatgtcgcctccaccggcgctaacgggtttgaccccgatgagggatatatggccttctgcgttaagtacggcgaatctatcaatctcgcggctgtgagaatctttttcctgaacgccgccaaagctaaggccgctcttgcccggaaacctgagcgcaaggcgaatccgaaatttggggaatggcaagtggagattgtcaacaatcacttccccggaaacagaaataaccctattggcaataacgacctgacaatccatcggctcagcgggtatctggcccgctgggtgcttgaacagtacaaggagaatgaggatgaatcccagagagagctgattaagacgaccatcatcaaccccattgctgaatctaatggagttcggtgggacagcggcgccgaggtgtatctctcctttttccctggcacagagatgtttctggaaatcttcaaattttaccccctgaccattgggatctatcgcgtcaagcagggactcatggatcctcagtacctgaaaaaggctcttagacaacggtacggcacactgaccgccgacaaatggatgtctcagaaggtgacagcgattgccaagagcctcaaagaggttgaacagctgaagtgggggcgcggaggcctttccgataccgctagaacgttcctgcagaaatttgggatccggctcccgtga

SEQ ID NO: 7499 - RNA, 708 nt, synthetic construct
  misc_feature 1..708: note = derived and/or modified CDS sequence (opt5) from CHATV(LEIV-22712)__HQ734825.1__N
  source 1..708: mol_type = other RNA
atgagcgacctggtgttctacgatgtcgcctccaccggcgctaacgggtttgaccccgatgagggatatatggccttctgcgttaagcacggcgaatctatcaatctcgcggctgtgagaatctttttcctgaacgccgccaaagctaaggccgctcttgcccggaaacctgagaagaaagcgagcccgaagtttggggaatggcaagtggagattattaataaccatttccccggaaatcgcaacaatcctatcggcaacaatgacctgacaattcacagactctccgggtacctggcccggtgggtccttgaacagtataaggagaacgaggatgaatctcagcgcgagctgatcaaaacgaccgtgatcaatcccattgctgaaagcaacggagttagatgggactccggcgccgagatctacctcagctttttccctggcacagagatgtttctggaaaccttcaagttttatcccctgacaattgggatctaccgggtgaaacagggaatgatggatcctcagtatctcaagaaagctctgcgccaaagatacggcacccttacagccgacaagtggatgtctcagaaggtcaccgcgattgccaaatccctgaaggaggtggaacagctcaaatgggggcggggaggcctgagcgatacggctcgcaccttccttcagaagtttgggatcagactgccgtga

SEQ ID NO: 7500 - RNA, 708 nt, synthetic construct
  misc_feature 1..708: note = derived and/or modified CDS sequence (opt5) from CHATV(LEIV-23500)__EU479701.1__N
  source 1..708: mol_type = other RNA
atgagcgacctggtgttctacgatgtcgcctccaccggcgctaacgggtttgaccccgatgccggatatatggcgttctgcgttaagcacggcgagtctatcaatctcgctgccgtgagaatctttttcctgaacgccgctaaagccaaggctgcccttgcgcggaaacctgaaaagaaagccaatccgaagtttggggagtggcaagtggaaattgtcaacaatcatttccccggaaaccgcaataaccctattggcaataacgacctgacaatccacagactcagcgggtacctggctcggtgggtgcttgagcagtataaggaaaatgaggatgagtcccagcgcgaactgattaaaacgaccgttatcaaccccatcgccgagtctaatggagtgagatgggaaaacggcgctgaggtctacctcagctttttccctggcacagagatgtttctggaaaccttcaagttttatcccctgacaattgggatctaccgggtgaaacagggaatgatggaccctcagtatctcaagaaagccctgcgccaaagatacggcacccttacagcggataagtggatgtcccagaaggttaccgccattgctaaatctctgaaggaggtggaacagctcaaatgggggcggggaggcctgagcgacacggcccgcaccttccttcagaagtttgggatcagactgccgtga

SEQ ID NO: 7501 - RNA, 708 nt, synthetic construct
  misc_feature 1..708: note = derived and/or modified CDS sequence (opt5) from INKV__Z68496.1__N
  source 1..708: mol_type = other RNA
atgggcgacctggtgttctacgatgaggccagcaccggggctaacggatttgaccccgatgccggcttcgtcgcgtttatggctgaccacggggaatccatcaatctcgccgccgttagaattttctttctgaacgctgccaaggctaaagccgcgcttgcccggaagcctgagcgcaaagctacaccgaagttcggagaatggcaagtggagatcgtgaataaccattttcccggcaatagaaacaatcctattgggaacaatgatctgacgatccaccggctctctggatatctggcccgctgggtccttgaacatttcaccgaggacgatgacgagagccagagagaactgattcggtccacaatcatcaaccccattgctgagtctaatggcatccactggaacaatggccctgaaatttacctcagctttttccccgggaccgagatgtttctggaggtgttcaaattttatcctctgacaatcggaatttaccgcgttaagcatggcatgatggatccgcagtatctcaagaaagccctgagacagcggtacgggacccttacagcggaaaagtggatggcccagaaaaccgtgctgatcgctaagtccctcaaagacgtcgagcaactgaagtggggacgcggcgggctttctgatgccgctagaacgttcctgattaagttcggagtgaaactcccctga

SEQ ID NO: 7502 - RNA, 708 nt, synthetic construct
  misc_feature 1..708: note = derived and/or modified CDS sequence (opt5) from INKV(KN3641)__U47137.1__N
  source 1..708: mol_type = other RNA
atgggcgacctggtgttctacgatgtcgccagcaccggggctaacggatttgaccccgatgccggcttcgttgcgtttatggctgaccacggggagtccatcaatctcgccgccgtgagaattttctttctgaacgctgccaaggctaaagccgcgcttgcccggaagcctgaacgcaaagctacaccgaagttcggagagtggcaagtggaaatcgtcaataaccattttcccggcaatagaaacaatcctattgggaacaatgatctgacgatccaccggctctctggatatctggcccgctgggtgcttgagcatttcaccgaagacgatgacgagagccagagagagctgattcggtccacaatcatcaaccccattgctgaatctaatggcatccactggaacaatggccctgagatttacctcagctttttccccgggaccgaaatgtttctggaggttttcaaattttatcctctgacaatcggaatttaccgcgtgaagcatggcatgatggatccgcagtatctcaagaaagccctgagacagcggtacgggacccttacagcggagaagtggatggcccagaaaaccgtcctgatcgctaagtccctcaaagacgtggaacaactgaagtggggacgcggcgggctttctgatgccgctagaacgttcctgattaagttcggagttaaactcccctga

SEQ ID NO: 7503 - RNA, 708 nt, synthetic construct
  misc_feature 1..708: note = derived and/or modified CDS sequence (opt5) from INKV(Lovanger)__KU302751.1__N
  source 1..708: mol_type = other RNA
atgggcgacctggtgttctacgatgtcgccagcaccggggctaacggatttgaccccgatgccggcttcgttgcgtttatggctgaccacggggagtccatcaatctcgccgccgtgagaattttctttctgaacgctgccaaggctaaagccgcgcttgcccggaagcctgaacgcaaagctacaccgaagttcggagagtggcaagtggaaatcgtcaataaccattttcccggcaatagaaacaatcctattgggaacaatgatctgacgatccaccggctctctggatatctggcccgctgggtgcttgagcatttcaccgaagacgatgacgagagccagagagagctgattcggtccacaatcatcaaccccattgctgaatctaatggcatccactggaacaatggccctgagatttacctcagctttttccccgggaccgaaatgtttctggaggttttcaaattttatcctctgacaatcggaatttaccgcgtgaagcatggcatgatggatccgcagtatctcaagaaagccctgagacagcggtacgggacccttacagcggagaagtggatgacccagaaaacggtcctgatcgccaagtccctcaaagacgtggaacaactgaagtggggacgcggcgggctttctgatgctgccagaaccttcctgattaagttcggagttaaactcccctga

SEQ ID NO: 7504 - RNA, 708 nt, synthetic construct
  misc_feature 1..708: note = derived and/or modified CDS sequence (opt5) from INKV(SW AR 83-161)__U47138.1__N
  source 1..708: mol_type = other RNA
atgggcgacctggtgttctacgatgtcgccagcaccggggctaacggatttgaccccgatgccggcttcgttgcgtttatggctgaccacggggagtccatcaatctcgccgccgtgagaattttctttctgaacgctgccaaggctaaagccgcgcttgcccggaagcctgaacgcaaagctacaccgaagttcggagagtggcaagtggaaatcgtcaataaccattttcccggcaatagaaacaatcctattgggaacaatgatctgacgatccaccggctctctggatatctggcccgctgggtgcttgagcatttcaccgaagacgatgacgagagccagagagagctgattcggtccacaatcatcaaccccattgctgaatctaatggcatccactggaacaatggccctgagatttacctcagctttctgcccgggaccgaaatgttcctggaggtttttaaattctatcctctcacaatcggaatttaccgcgtgaagcatggcatgatggatccgcagtatctgaagaaagcccttagacagcggtacgggaccctgacagcggagaagtggatggcccagaaaaccgtcctcatcgctaagtccctgaaagacgtggaacaacttaagtggggacgcggcgggctgtctgatgccgctagaacgtttctcattaagttcggagttaaactgccctga

SEQ ID NO: 7505 - RNA, 708 nt, synthetic construct
  misc_feature 1..708: note = derived and/or modified CDS sequence (opt5) from LUMV__X73468.1__N
  source 1..708: mol_type = other RNA
atgagcgacctggtgttctacgatgtcgcctccaccggcgctaacgggtttgaccccgatgccggatatgttgacttctgcgtgaagcacggcgagtctatcaatctccatagcgtgagaatctttttcctgaacgcggctaaagccaaggccgctcttgcccggaaacctgaacgcaaggcttccccgaaatttggggagtggcaggtcgaaattgtgaataaccacttccccggaaatagaaacaatcctattgataacaatgacctgacaatccatcggctctctggctacctggcccgctgggttcttgagcaatttaaggaaaacgaggatgcggcccagagagagctgattaagacgaccgtgatcaatcccatcgctgaaagcaacgggattcggtgggacaatggagccgagatctatctcgctttctttcctggcacagaaatgttcctggagacctttaacttctaccccctgacaattggcatctatcgcgtcaaacacgggatgatggatcctcagtacctcaagaaagccctgagacggcgctatggatcccttaccgcggacaagtggatgtctcagaaaacagtggccattgctaagagcctgaaggatgttgagcaactcaaatggggcagagggggactgtccgacaccgcccgggtgtttcttcagaagttcggcatcaaactgccgtga

SEQ ID NO: 7506 - RNA, 708 nt, synthetic construct
  misc_feature 1..708: note = derived and/or modified CDS sequence (opt5) from LUMV(SAAr 1881)__KX817326.1__N
  source 1..708: mol_type = other RNA
atgagcgacctggtgttctacgatgtcgcctccaccggcgctaacgggtttgaccccgatgccggatatgttgacttctgcgtgaagcacggcgagtctatcaatctccatagcgtgagaatctttttcctgaacgcggctaaagccaaggccgctcttgcccggaaacctgaacgcaaggcttccccgaaatttggggagtggcaggtcgaaattgtgaataaccacttccccggaaatagaaacaatcctattgataacaatgacctgacaatccatcggctctctggctacctggcccgctgggttcttgagcaatttaaggaaaacgaggatgcggcccagagagagctgattaagacgaccgtgatcaatcccatcgctgaaagcaacgggattcggtgggacaatggagccgagatctatctcgctttctttcctggcacagaaatgttcctggagacctttaacttctaccccctgacaattggcatctatcgcgtcaaacacgggatgatggatcctcagtacctcaagaaagccctgagacagcggtatggatcccttaccgcggacaagtggatgtctcagaaaacagtggccattgctaagagcctgaaggatgttgagcaactcaaatggggccgcgggggactgtccgacaccgccagagtgtttcttcagaagttcggcatcaaactgccgtga

SEQ ID NO: 7507 - RNA, 708 nt, synthetic construct
  misc_feature 1..708: note = derived and/or modified CDS sequence (opt5) from MELV(TRVL 9375)__KX817329.1__N
  source 1..708: mol_type = other RNA
atgggcgacctgatcttctacgatgtggccagcaccggggctaacggatttgaccccgatgccggctatctcgcgttcacaattgctcacggggaggccatcaatctgtccgccgtcagaatctttttccttaacgctgccaaggctaaagccgcgctgtctcggaagcctgaacgcaaagccacgccgaagtttggagactggcaggttgagattgtgaataaccatttccccggcaatagaaacaatcctattgggaacaatgatctcaccatccaccggctgagcggataccttgctcgctgggtgctggacctctttaaagaaaacgaggatgaatcccaaaaggagctgatccagtctacaattatcaatcccattgccgagagcaacggcatccattgggctaatggcgtcgaaatttatctgtccttctttcctgggaccgagatgttcctcgaagcctttagattctaccccctgacaatcggaatttatcgggtgaagcacggccttatggaccctcagtacctgaaaaaggcgctccgccagagatatgggaccctgacagccgataaatggatggctcaaaagaccacgatgatcgccaaatctcttaaggacgttgagcagctgaagtggggaaaaggcgggctcagcgatgctgcccggacctttctgcagaagttcggagtgcgcctgccgtga

SEQ ID NO: 7508 - RNA, 708 nt, synthetic construct
  misc_feature 1..708: note = derived and/or modified CDS sequence (opt5) from MBV__U31989.1__N
  source 1..708: mol_type = other RNA
atgagcgacctggtgttctacgatgtcgcctccaccggcgctaacgggtttgaccccgatgccggatatgttgacttctgcgcgaagcacggcgagtctatcaatctcgctgccgtgagaatctttttcctgaacgccgctaaagccaaggctgcccttagccggaaacctgaacgcaaggcgaatccgaaatttggggagtggcaagtggaaattgtcaacaatcatttccccgccaacagaaataaccctattggaaataacgatctgacaatccaccggatttccggctacctcgctcgctgggtgctggagcaatatagagaaaatgaggacgagtctcagcgggaacttgttaagacgaccgtgatcaaccccatcgccgagagcaatgggattcgctgggaaaacggacctgagatctacctggcctttttccccggcacagagatgtttctcgaaaccttcaagttttatcctctgacaattggcatctacagagtcaaacatgggatgatggatccgcagtatctgaagaaagctctccggcagcgctacggatccctgaccgcggagaagtggatgtctcagaaaacaggcatgattgccaagagccttaaggaagtggagcagctgaaatgggggagaggaggcctctccgacaccgctcggacgttcctgcagaagtttgggatccgccttccctga

SEQ ID NO: 7509 - RNA, 708 nt, synthetic construct
  misc_feature 1..708: note = derived and/or modified CDS sequence (opt5) from SAV(VR723)__U47139.1__N
  source 1..708: mol_type = other RNA
atgagcgagctggtgttctacgacgtcgcctccaccggcgctaacgggtttgatcccgacgccggatatctcgcgttctgcgttaagcacggcgaatctatcagcctgtcctctgtgagaatctttttccttaatgctgccaaagccaaggctgccctgagccggaaacctgagcgcaaggctaacccgaaatttggggaatggcaagtggagattgtcaataaccatttccccggaaatagaaacaatcctattgataacctcgacctgacaatccaccggctttccggctacctggcccgctgggtgctcgaacagtttattgagaatgaggatgaatctcagagagagctgatcaagacgaccgttatcaaccccattgcggaaagcaatgggatcaagtgggagaacggagccgagatttatctgtccttctttcctggcacagaaatgttcctcgagatctttaaattctaccccctgaccattggcatctatcgggtgaagcaggggatgatggaccctcagtaccttaaaaaggctctgcgccaaagatatggaagcctcacagccgataaatggatgtctcagaaggtcggcgctattgccaagtccctgaaagacatcgaacagcttaagtgggggaaaggaggcctgagcgataccgcgcggacatttctccagaagttcgggatcaaactgccgtga

SEQ ID NO: 7510 - RNA, 708 nt, synthetic construct
  misc_feature 1..708: note = derived and/or modified CDS sequence (opt5) from SDNV(BeAr 103645)__U47140.1__N
  source 1..708: mol_type = other RNA
atgggcgacctggtgttctacgatgtcgccagcaccggggctaacggatttgaccccgatgccggcttcgttgcgtttatggctgggcacggagagtccatcaatctcacagccgtgagaattttctttctgaacgccgctaaggccaaagctgccctttctcggaagcctgaacgcaaagcgacgccgaagttcggcgactggcaagtggagatcgtcaataaccattttcccgggaatagaaacaatcctattggaaacaatgatctgaccatccaccggattagcggctatctcgcccgctggacactggaacatttcagagagggcggggacgaagctcagaaagagcttatccggaccacaatcattaaccccatcgccgagtccaatggcattcactgggctaacggagccgaaatctacctgagctttttccctgggaccgagatgtttctcgaagcgttcaagttttatcccctgacaattggaatctaccgcgtgaagcatggcatgatggatgcccagtatctgaaaaaggctctcagacagcggtacgggaccctgacggccgacgagtggatggctcagaaaaccgttcttattacaaagtctctgaaagatgtggagcaactcaagtggggacgcggcggcctgtccgacgccgccagaaccttcctttctaagttcggggtcaaactgccttga

SEQ ID NO: 7511 - RNA, 708 nt, synthetic construct
  misc_feature 1..708: note = derived and/or modified CDS sequence (opt5) from SDNV(BeAr 103645)__KX817335.1__N
  source 1..708: mol_type = other RNA
atgggcgacctggtgttctacgatgtcgccagcaccggggctaacggatttgaccccgatgccggcttcgttgcgtttatggctgggcacggagagtccatcaatctcacagccgtgagaattttctttctgaacgccgctaaggccaaagctgccctttctcggaagcctgaacgcaaagcgacgccgaagttcggcgactggcaagtggagatcgtcaataaccattttcccgggaatagaaacaatcctattggaaacaatgatctgaccatccaccggattagcggctatctcgcccgctggacactggaacatttcagagagggcgaagacgaggctcagaaagagcttatccggaccacaatcattaaccccatcgccgaatccaatgggattcactgggctaacggagccgagatctacctgagctttttccctggcaccgaaatgtttctcgaggcgttcaagttttatcccctgacaattgggatctaccgcgtgaagcatggaatgatggatgcccagtatctgaaaaaggctctcagacagcggtacggcaccctgacggccgacaaatggatggctcagaagaccgttcttattacaaaatctctgaaggatgtggagcaactcaagtgggggcgcggaggcctgtccgacgccgccagaaccttcctttctaaattcggcgtcaagctgccttga

SEQ ID NO: 7512 - RNA, 708 nt, synthetic construct
  misc_feature 1..708: note = derived and/or modified CDS sequence (opt5) from SSHV__EU294510.1__N
  source 1..708: mol_type = other RNA
atgagcgacctggtgttctacgatgtcgcctccaccggcgctaacgggtttgaccccgatgccggatatatggcgttctgcgttaagtacgctgagtctgtgaatctcgccgccgtgagaatctttttcctgaacgctgccaaagctaaggccgcgcttagccggaaacctgaacgcaaggccaatccgaaatttggcgagtggcaggtcgaagtggttaacaatcacttccccgggaacagaaataaccctattaattccgacgatctgacaatccatcggctctctggatatctggctcgctgggtgcttgagcaatacaaggaaaacgaggacgagagcagacgggaactgattaagacgaccatcattaatcccatcgccgagtccaacggcgtccgctgggattctggggctgaaatctatctcagctttttccctggaacagagatgtttctggagaccttcaaattttaccccctgacaattggcatctatagagtgaagcagggcatgatggaccctcagtacctcaaaaaggccctgcggcagcgctacgggtcccttaccgcggataaatggatgagccaaaaggttacagccattgctaagtctctgaaagaagtggagcagctcaagtggggaagaggcgggctgtccgacaccgcccggagcttccttcagaaatttggaatccgcctgccgtga

SEQ ID NO: 7513 - RNA, 708 nt, synthetic construct
  misc_feature 1..708: note = derived and/or modified CDS sequence (opt5) from SSHV(F10838)__KM215563.1__N
  source 1..708: mol_type = other RNA
atgagcgacctggtgttctacgatgtcgcctccaccggcgctaacgggtttgaccccgatgccggatatatggcgttctgcgttaagtacgctgagtctgtgaatctcgccgccgtgagaatctttttcctgaacgctgccaaagctaaggccgcgcttagccggaaacctgaacgcaaggccaatccgaaatttggcgagtggcaggtcgaagtggttaacaatcacttccccgggaacagaaataaccctattaattccgacgatctgacaatccatcggctctctggatatctggctcgctgggtgcttgagcaatacaaggaaaacgaggacgagagcagacgggaactgattaagacgaccatcattaatcccatcgccgagtccaacggcgtccgctgggattctggggctgaaatctatctcagctttttccctggaacagagatgtttctggagaccttcaaattttaccccctgacaattggcatctatagagtgaagcagggcatgatggaccctcagtacctcaaaaaggccctgcggcagcgctacgggtcccttaccgcggataaatggatgagccaaaaggttacagccattgctaagtctctgaaagaagtggagcagctcaagtggggaagaggcgggctgtccgacaccgcccggagccttctgcagaaattcggaatccgcctcccgtga

SEQ ID NO: 7514 - RNA, 708 nt, synthetic construct
  misc_feature 1..708: note = derived and/or modified CDS sequence (opt5) from SORV(SORV-252)__GU018050.2__N
  source 1..708: mol_type = other RNA
atgggcgacctggtgttctacgatgtcgccagcaccggggctaacggatttgaccccgatgccggcttcgttgcgtttatggctgaccacggggagtccatctctctcagcgccgtgagaattttctttctgaatgccgctaaggccaaagctgcccttgcgcggaagcctgaacgcaaagccaacccgaagttcggagagtggcaagtggaaatcgtcaataaccattttcccggcaatagaaacaatcctattgggaacaatgatctgacaatccaccggctctccggatatctggctcgctgggtgcttgagcatttcacggaagacgaggatgagtctcagagagaactgattcggagcaccatcatcaaccccattgccgagtccaatggcatccgctggaacaatggccctgaaatttacctcagctttttccccgggacagagatgtttctggaggctttcaaattttatcctctgaccatcggaatttacagagttaagcacggcctcatggacccgcagtatctgaagaaagcccttcggcagcgctacgggacactgaccgcggaaaagtggatggcccagaaaacagtgctcatcgctaagtctctgaaagatgtcgagcaacttaagtggggaagaggcgggctgtccgacgccgctcggaccttcctcattaagttcggagtgaaactgccctga

SEQ ID NO: 7515 - RNA, 708 nt, synthetic construct
  misc_feature 1..708: note = derived and/or modified CDS sequence (opt5) from SORV(NJO 94F)__U47141.1__N
  source 1..708: mol_type = other RNA
atgggcgacctggtgttctacgatgtcgccagcaccggggctaacggatttgaccccgatgccggcttcgttgcgtttatggctgaccacggggagtccatcaatctctctgccgtgagaattttctttctgaacgccgctaaggccaaagctgcccttgcgcggaagcctgaacgcaaagccaatccgaagttcggagagtggcaagtggaaatcgtcaacaatcattttcccggcaacagaaataaccctattgggaataacgatctgacaatccaccggctcagcggatatctggctcgctgggtgcttgagcatttcacggaagacgaggatgagtcccagagagaactgattcggtctaccatcatcaatcccattgccgagagcaacggcatccactggaataacggccctgaaatttacctctcctttttccccgggacagagatgtttctggaggctttcaaattttatcctctgaccatcggaatttaccgcgttaagcatggcatgatggacccgcagtatctcaagaaagccctgagacagcggtacgggacacttaccgcggaaaagtggatggcccagaaaacagtgctgatcgctaagtctctcaaagatgtcgagcaactgaagtggggacgcggcgggcttagcgacgccgctagaaccttcctgattaagttcggagtgaaactcccctga

SEQ ID NO: 7516 - RNA, 708 nt, synthetic construct
  misc_feature 1..708: note = derived and/or modified CDS sequence (opt5) from SORV(NJO-94F)__KX817338.1__N
  source 1..708: mol_type = other RNA
atgggcgacctggtgttctacgatgtcgccagcaccggggctaacggatttgaccccgatgccggcttcgttgcgtttatggctgaccacggggagtccatcaatctctctgccgtgagaattttctttctgaacgccgctaaggccaaagctgcccttgcgcggaagcctgaacgcaaagccaatccgaagttcggagagtggcaagtggaaatcgtcaacaatcattttcccggcaacagaaataaccctattgggaataacgatctgacaatccaccggctcagcggatatctggctcgctgggtgcttgagcatttcacggaagacgaggatgagtcccagagagaactgattcggtctaccatcatcaatcccattgccgagagcaacggcatccactggaataacggccctgaaatttacctctcctttttccccgggacagagatgtttctggaggctttcaaattttatcctctgaccatcggaatttaccgcgttaagcatggcctcatggacccgcagtatctgaagaaagcccttagacagcggtacgggacactgaccgcggaaaagtggatggcccagaaaacagtgctcatcgctaagtctctgaaagatgtcgagcaacttaagtggggacgcggcgggctgagcgacgccgctagaaccttcctcattaagttcggagtgaaactgccctga

SEQ ID NO: 7517 - RNA, 708 nt, synthetic construct
  misc_feature 1..708: note = derived and/or modified CDS sequence (opt5) from TAHV__Z68497.1__N
  source 1..708: mol_type = other RNA
atgagcgacctggtgttctacgatgtcgcctccaccggcgctaacgggtttgaccccgatgccggatatgttgacttctgcatcaagcacggcgaggcgattaatctccattctgtgagaatctttttcctgaacgctgccaaagccaaggctgcccttgctcggaaacctgaacgcaaggccagcccgaaatttggggagtggcaagtggaagtcgtgaattaccacttccccggaaacagaaataaccctattgataataacgacctgacaatccatcggctctatggctacctggcgcgctgggttcttgagcagtttaaggaaaatgaggatgccgctcagagagagctgattaagacgaccgtgatcaaccccatcgccgaatccaatgggattcggtgggacaacggagctgagatctatctcgccttctttcctggcacagaaatgttcctggagacctttaatttctaccccctgacaattggcatctatcgcgtcaaacaggggatgatggatcctcagtacctcaagaaagcgctgagacaacggtacggatctcttaccgccgacaagtggatgagccagaaaacaaccgctattgccaagtccctgaaggatgtggagcagctcaaatggggccgcgggggactgtctgacacggctagaacctttcttcagaagttcggcatccggctgccgtga

SEQ ID NO: 7518 - RNA, 708 nt, synthetic construct
  misc_feature 1..708: note = derived and/or modified CDS sequence (opt5) from TAHV(22595-6)__HM036217.1__N
  source 1..708: mol_type = other RNA
atgagcgacctggtgttctacgatgtcgcctccaccggcgctaacgggtttgaccccgatgccggatatgttgacttctgcatcaagcacggcgaggcgattaatctccattctgtgagaatctttttcctgaacgctgccaaagccaaggctgcccttgctcggaaacctgaacgcaaggccagcccgaaatttggggagtggcaagtggaagtcgtgaataaccacttccccggaaatagaaacaatcctattgataacaatgacctgacaatccatcggctctccggctacctggcgcgctgggttcttgagcagtttaaggaaaacgaggatgccgctcagagagagctgattaagacgaccgtgatcaatcccatcgccgaatctaacgggattcggtgggacaatggagctgagatctatctcgccttctttcctggcacagaaatgttcctggagacctttaacttctaccccctgacaattggcatctatcgcgtcaaacaggggatgatggatcctcagtacctcaagaaagcgctgagacaacggtatggaagccttaccgccgacaagtggatgtcccagaaaacaaccgctattgccaagtctctgaaggatgtggagcagctcaaatggggccgcgggggactgagcgacacggctagaacctttcttcagaagttcggcatccggctgccgtga

SEQ ID NO: 7519 - RNA, 708 nt, synthetic construct
  misc_feature 1..708: note = derived and/or modified CDS sequence (opt5) from TAHV(NM08003)__HQ541823.1__N
  source 1..708: mol_type = other RNA
atgagcgacctggtgttctacgatgtcgcctccaccggcgctaacgggtttgaccccgatgccggatatgttgacttctgcatcaagcacggcgaggcgattaatctccattctgtgagaatctttttcctgaacgctgccaaagccaaggctgcccttgctcggaaacctgaacgcaaggccagcccgaaatttggggagtggcaagtggaagtcgtgaataaccacttccccggaaatagaaacaatcctattgataacaatgacctgacaatccatcggctctccggctacctggcgcgctgggttcttgagcagtttaaggaaaacgatgacgccgctcagagagagctgattaagacgaccgtgatcaatcccatcgccgagtctaacgggattcggtgggataatggagctgaaatctatctcgccttctttcctggcacagagatgttcctggaaacctttaacttctaccccctgacaattggcatctatcgcgtcaaacaggggatgatggaccctcagtacctcaagaaagcgctgagacaacggtatggaagccttaccgccgataagtggatgtcccagaaaacaaccgctattgccaagtctctgaaggacgtggagcagctcaaatggggccgcgggggactgagcgatacggctagaacctttcttcagaagttcggcatccggctgccgtga

SEQ ID NO: 7520 - RNA, 708 nt, synthetic construct
  misc_feature 1..708: note = derived and/or modified CDS sequence (opt5) from TAHV(XJ0625)__EU622820.2__N
  source 1..708: mol_type = other RNA
atgagcgacctggtgttctacgatgtcgcctccaccggcgctaacgggtttgaccccgatgccggatatgttgacttctgcgtgaagtacggcgaggcgatcaatctccactctgtgagaatctttttcctgaacgctgccaaagccaaggctgcccttgctcggaaacctgaacgcaaggccagcccgaaatttggggagtggcaggtcgaagtggttaataaccatttccccggaaatagaaacaatcctattgataacaatgacctgacaattcaccggctctccggctatctggcgcgctgggtgcttgagcaatttaaggaaaacgaggatgccgctcagagagagctgatcaagacgaccgtcattaatcccatcgccgaatctaacgggatccggtgggacaatggagctgagatttacctcgccttctttcctggcacagaaatgttcctggagacctttaacttctatcccctgacaatcggcatttaccgcgtgaaacaggggatgatggatcctcagtatctcaagaaagcgctgagacaacggtacggaccgcttaccgccgacaagtggatgagccagaaaacagttgctatcgccaagtccctgaaggatgtggagcagctcaaatggggccgcgggggactgtctgacaccgctagaacgtttcttcagaagttcggcattcggctgccctga

SEQ ID NO: 7521 - RNA, 708 nt, synthetic construct
  misc_feature 1..708: note = derived and/or modified CDS sequence (opt5) from TAHV(XJ0708)__HM243139.1__N
  source 1..708: mol_type = other RNA
atgagcgacctggtgttctacgatgtcgcctccaccggcgctaacgggtttgaccccgatgccggatatgttgacttctgcgcgaagtacggcgaggctatcaatctccactctgtgagaatctttttcctgaacgccgccaaagctaaggccgctcttgcccggaaacctgaacgcaaggcgagcccgaaatttggggagtggcaagtggaagtcgtgaataaccatttccccggaaatagaaacaatcctattgataacaatgacctgacaattcaccggctctccggctatctggcccgctgggttcttgagcagtttaaggaaaacgaggatgctgcccagagagagctgatcaagacgaccgtgattaatcccatcgctgaatctaacgggatccggtgggacaatggagccgagatttacctcgcgttctttcctggcacagaaatgttcctggagacctttaacttctatcccctgacaatcggcatttaccgcgtcaaacaggggatgatggatcctcagtatctcaagaaagccctgagacaacggtacggaccgcttaccgctgacaagtggatgagccagaaaacagtggccatcgctaagtccctgaaggatgttgagcagctcaaatggggccgcgggggactgtctgacaccgccagaacgtttcttcagaagttcggcattcggctgccctga

SEQ ID NO: 7522 - RNA, 708 nt, synthetic construct
  misc_feature 1..708: note = derived and/or modified CDS sequence (opt5) from TVTV(AR42)__KX891323.1__N
  source 1..708: mol_type = other RNA
atgagcgagctggtgttctacgacgccccctccaccggcgctaacgggtttgatcctgacgccggatatgtcgcgttcatcgctgcccacgccggctcttacgatctcagcgctgttagaatctttttcctgaatgccgctaaggccaaaaacgcgctttcccggaagccggaagggaaagtgtctattaagtttggagagtggagcgtggaagtcgtgaataaccatttccccggcaatcgcaacaatcctattgggaacaatgacctgacaatccacagaatttccggatatctcgcccggtgggttctggaggaatttaaaggccaggatgacgaggctcaaaaggatatcatccgctctacgattgtgaaccccatcgccgagagcaatggcattcattgggactccggggctgatgcctaccttagcttctttcctggaaccgaaatgttcctggagtcttttgacttcctccccctggcgatcggcatttatagagtcaagaacgggatgatggatgtgcagtacctgaaaaaggccctccggcagcgctatggaacaatgaccgctgacaaatggatgtccacaaagaccacagttatcgccaaaaccctgaagagagtggagagctttaagtggggcaaagggggactttctgaagctgcccgggccttcctgtccaagttcaatgtcaaaattccttga

SEQ ID NO: 7523 - RNA, 708 nt, synthetic construct
  misc_feature 1..708: note = derived and/or modified CDS sequence (opt5) from TVTV(ND3374)__KM215564.1__N
  source 1..708: mol_type = other RNA
atgagcgagctggtgttctacgacgccccctccaccggcgctaacgggtttgatcctgacgccggatatgtcgcgttcatcgctgcccacgccggctcttacgatctcagcgctgttagaatctttttcctgaatgccgctaaggccaaaaacgcgctttcccggcgcccggaagggaaggtgtctattaaatttggagagtggagcgtggaagtcgtgaataaccatttccccggcaatagaaacaatcctattgggaacaatgacctgacaatccaccggatttccggatatctcgcccgctgggttctggaggaatttaagggccaggatgacgaggctcaaaaagatatcatcagatctacgattgtgaaccccatcgccgagagcaatggcattcattgggactccggggctgatgcctaccttagcttctttcctggaaccgaaatgttcctggagtcttttgacttcctccccctggcgatcggcatttatcgggtcaagaacgggatgatggatgtgcagtacctgaagaaagccctccgccagagatatggaacaatgaccgctgacaagtggatgtccacaaaaaccacagttatcgccaagaccctgaaacgggtggagagctttaagtggggcaaagggggactttctgaagctgcccgcgccttcctgtccaagttcaatgtcaagattccttga

SEQ ID NO: 7524 - RNA, 708 nt, synthetic construct
  misc_feature 1..708: note = derived and/or modified CDS sequence (opt5) from JCV(3324-04)__HM007356.1__N
  source 1..708: mol_type = other RNA
atgggcgacctggtgttctacgatgtcgccagcaccggggctaacggatttgaccccgatgccggcttcgttgcgtttatggctgaccacggggagtccgtgtctctcagcgccgtgagaatcttctttctgaatgccgctaaggccaaagctgcccttgcgcggaagcctgaacgcaaagccacaccgaagttcggagagtggcaggtcgaaattgtgaacaatcattttcccggcaacagaaataaccctatcgggaataacgatctgacgattcaccggctctccggatatctggctcgctgggttcttgagcatttcaccacagacgatgacgaatctcaaagagagctgatccggagcaccattatcaatcccatcgccgagtccaacggcattcactggaataacggccctgaaatctacctcagctttttccccgggacagagatgtttctggaaattttcaaattttatcctctgaccatcggaatttaccgcgtgaagcatggcatgatggatccgcagtatctcaagaaagctctgagacagcggtacgggacacttaccgccgagaagtggatggcgcagaaaacggtcctgatcgccaagtctctcaaagacgtggagcaactgaagtggggacgcggcgggctttccgatgctgccagaaccttcctgattaagttcggagttaaactcccctga

SEQ ID NO: 7525 - RNA, 708 nt, synthetic construct
  misc_feature 1..708: note = derived and/or modified CDS sequence (opt5) from JCV(61v2235)__U12796.1__N
  source 1..708: mol_type = other RNA
atgggcgacctggtgttctacgatgtcgccagcaccggggctaacggatttgaccccgatgccggcttcgttgcgtttatggctgaccacggggagtccatcaatctctctgccgtgagaattttctttctgaacgccgctaaggccaaagctgcccttgcgcggaagcctgaacgcaaagccacaccgaagttcggagagtggcaagtggaaatcgtcaataaccattttagcggcaatagaaacaatcccattgggaacaatgatctgacgatccaccggctctccggatatctggctcgctgggtgcttgagcatttcaactctgacgatgacgaaagccagagagagctgattcggtccaccatcatcaatcctattgccgagtctaacggcatccactggaataacggccccgaaatttacctcagctttttccctgggacagagatgtttctggaaatcttcaaattttatcccctgaccattggaatctaccgcgttaagcatggcatgatggatcctcagtatctcaagaaagctctgagacagcggtacgggacacttaccgccgagaagtggatggcgcagaaaacagtgctgattgccaagtccctcaaagacgtcgagcaactgaagtggggacgcggcgggcttagcgatgctgccagaaccttcctgatcaagttcggagtgaaactcccgtga

SEQ ID NO: 7526 - RNA, 708 nt, synthetic construct
  misc_feature 1..708: note = derived and/or modified CDS sequence (opt5) from JCV(1064-03)__EF681816.1__N
  source 1..708: mol_type = other RNA
atgggcgacctggtgttctacgatgtcgccagcaccggggctaacggatttgaccccgatgccggcttcgttgcgtttatggctgaccacggggaggccatcaatctcgccgctgtgagaattttctttctgaacgccgctaaggccaaagcggcccttgctcggaagcctgaacgcaaagccacaccgaagttcggagagtggcaagtggaaatcgtcaataaccattttcccggcaatagaaacaatcctattgggaacaatgatctgacgatccaccggctctccggatatctggctcgctgggtgcttgagcatttcaccgaagacgatgacgagtctcagagagagctgattcggagcacaatcatcaaccccattgccgaatccaatggcatccactggaacaatggccctgagatttacctcagctttttccccgggaccgaaatgtttctggaggttttcaaattttatcctctgacaatcggaatttaccgcgtgaagcatggcatgatggatccgcagtatctcaagaaagcgctgagacagcggtacgggacccttacagccgagaagtggatggctcagaaaaccgtcctgatcgccaagtctctcaaagacgtggaacaactgaagtggggacgcggcgggctttccgatgctgccagaacgttcctgattaagttcggagttaaactcccctga

SEQ ID NO: 7527 - RNA, 708 nt, synthetic construct
  misc_feature 1..708: note = derived and/or modified CDS sequence (opt5) from JCV(33909)__EF681853.1__N
  source 1..708: mol_type = other RNA
atgggcgacctggtgttctacgatgtcgccagcaccggggctaacggatttgaccccgatgccggcttcgttgcgtttatggctgaccacggggaggtgatcaatctcgccgccgtgagaattttctttctgaacgctgccaaggctaaagccgcgcttgcccggaagcctgaacgcaaagctacaccgaagttcggagagtggcaggtcgaaatcgtgaataaccattttcccggcaatagaaacaatcctattgggaacaatgatctgacgatccaccggctctccggatatctggcccgctgggttcttgagcatttcaccgaagacgatgacgagtctcaaagagagctgattcggagcacaatcatcaaccccattgctgaatccaatggcatccactggaacaatggccctgagatttacctcagctttttccccgggaccgaaatgtttctggaggtgttcaaattttatcctctgacaatcggaatttaccgcgtcaagcatggcatgatggatccgcagtatctcaagaaagccctgagacagcggtacgggacccttacagcggagaagtggatggcccagaaaaccgtgctgatcgctaagtctctcaaagacgttgaacaactgaagtggggacgcggcgggctttccgatgccgctagaacgttcctgattaagttcggagtgaaactcccctga

SEQ ID NO: 7528 - RNA, 708 nt, synthetic construct
  misc_feature 1..708: note = derived and/or modified CDS sequence (opt5) from JCV(2179-00)__EF681808.1__N
  source 1..708: mol_type = other RNA
atgggcgacctggtgttctacgatgtcgccagcaccggggctaacggatttgaccccgatgccggcttcgttgcgtttatggctgaccacggggagtccgtgtctctcagcgccgtgagaatcttctttctgaatgccgctaaggccaaagctgcccttgcgcggaagcctgaacgcaaagccacaccgaagttcggagagtggcaggtcgaaattgtgaacaatcattttcccggcaacagaaataaccctatcgggaataacgatctgacgattcaccggctctccggatatctggctcgctgggttcttgagcatttcaccacagacgatgacgaatctcaaagagagctgatccggagcaccattatcaatcccatcgccgagtccaacggcattcactggaataacggccctgaaatctacctcagctttttccccgggacagagatgtttctggaaattttcaaattttatcctctgaccatcggaatttaccgcgtgaagcatggcatgatggatccgcagtatctcaagaaagctctgagacagcggtacgggatccttacagccgagaagtggatggcgcagaaaaccgtcctgattgccaagtctctcaaagacgtggagcaactgaagtggggacgcggcgggctttccgatgctgccagaacgttcctgatcaagttcggagttaaactcccctga

SEQ ID NO: 7529 - RNA, 708 nt, synthetic construct
  misc_feature 1..708: note = derived and/or modified CDS sequence (opt5) from JCV(2989-06)__EF681849.1__N
  source 1..708: mol_type = other RNA
atgggcgacctgatcttctacgatgtggccagcaccggggctaacggatttgaccccgatgccggcttcgtcgcgtttatggctgaccacggggagtccgtttctctcagcgccgtgagaattttctttctgaatgccgctaaggccaaagctgcccttgcgcggaagcctgaacgcaaagccacaccgaagttcggagagtggcaagtggaaatcgtcaacaatcattttcccggcaacagaaataaccctattgggaataacgatctgacgatccaccggctctccggatatctggctcgctgggtgcttgagcatttcaccacagacgatgacgaatctcagagagagctgattcggagcaccatcatcaatcccattgccgagtccaacggcatccactggaataacggccctgaaatttacctcagctttttccccgggacagagatgtttctggaaatcttcaaattttatcctctgaccattggaatctaccgcgttaagcatggcatgatggatccgcagtatctcaagaaagctctgagacagcggtacgggacacttaccgccgagaagtggatggcgcagaaaacggtgctgattgccaagtctctcaaagacgtcgagcaactgaagtggggacgcggcgggctttccgatgctgccagaaccttcctgatcaagttcggagtgaaactcccctga

SEQ ID NO: 7530 - RNA, 708 nt, synthetic construct
  misc_feature 1..708: note = derived and/or modified CDS sequence (opt5) from JCV(5592-02)__EF681804.1__N
  source 1..708: mol_type = other RNA
atgggcgacctggtgttctacgatgtcgccagcaccggggctaacggatttgaccccgatgccggcttcgttgcgtttatggctgaccacggggagtccgtgtctctcagcgccgtgagaatcttctttctgaatgccgctaaggccaaagctgcccttgcgcggaagcctgaacgcaaagccacaccgaagttcggagagtggcaggtcgaaattgtgaacaatcattttcccggcaacagaaattcccctatcgggaacaatgatctgacgattcaccggctctctggatatctggctcgctgggttcttgagcatttcaccacagacgatgacgaaagccaaagagagctgatccggtccaccattatcaaccccatcgccgagtctaatggcattcactggaacaatggccctgaaatctacctcagctttttccccgggacagagatgtttctggaaattttcaaattttatcctctgaccatcggaatttaccgcgtgaagcatggcatgatggatccgcagtatctcaagaaagctctgagacagcggtacgggacacttaccgccgagaagtggatggcgcagaaaacggtcctgatcgccaagtccctcaaagacgtggagcaactgaagtggggacgcggcgggcttagcgatgctgccagaaccttcctgattaagttcggagttaaactcccctga

SEQ ID NO: 7531 - RNA, 708 nt, synthetic construct
  misc_feature 1..708: note = derived and/or modified CDS sequence (opt5) from JCV(F5609)__KM215546.1__N
  source 1..708: mol_type = other RNA
atgggcgacctggtgttctacgatgtcgccagcaccggggctaacggatttgaccccgatgccggcttcgttgcgtttatggctgaccacggggagtccgtgtctctcagcgccgtgagaatcttctttctgaatgccgctaaggccaaagctgcccttgcgcggaagcctgaacgcaaagccacaccgaagttcggagagtggcaggtcgaaattgtgaacaatcattttcccggcaacagaaataaccctatcgggaataacgatctgacgattcaccggctctccggatatctggctcgctgggttcttgagcatttcaccacagacgatgacgaatctcaaagagagctgatccggagcaccattatcaatcccatcgccgagtccaacggcattcactggaataacggccctgaaatctacctcagctttttccccgggacagagatgtttctggaaattttcaaattttatcctctgaccatcggaatttaccgcgtgaagcatggcatgatggatccgcagtatctcaagaaagctctgagacagcggtacgggacacttaccgccgagaagtggatggcgcagaaaacggtcctgatcgccaagtctctcaaagacgtggagcaactgaagtggggacgcggcgggctttccgatgctgccagaaccttcctgacaaagttcggagttaaactcccctga

SEQ ID NO: 7532 - RNA, 708 nt, synthetic construct
  misc_feature 1..708: note = derived and/or modified CDS sequence (opt5) from JCV(F6577)__KM215557.1__N
  source 1..708: mol_type = other RNA
atgggcgacctggtgttctacgatgtcgccagcaccggggctaacggatttgaccccgatgccggcttcgttgcgtttatggctgaccacggggagtccgtgtctctcagcgccgtgagaatcttctttctgaatgccgctaaggccaaagctgccctttcccggaagcctgaacgcaaagcgacaccgaagttcggagagtggcaggtcgaaattgtgaacaatcattttcccggcaacagaaataaccctatcgggaataacgatctgacgattcaccggctctctggatatctggcccgctgggttcttgagcatttcaccacagacgatgacgaaagccaaagagagctgatccggtccaccattatcaatcccatcgctgagtctaacggcattcactggaataacggccctgaaatctacctcagctttttccccgggacagagatgtttctggaaattttcaaattttatcctctgaccatcggaatttaccgcgtgaagcatggcatgatggatccgcagtatctcaagaaagccctgagacagcggtacgggacacttaccgctgagaagtggatggcccagaaaacggtcctgatcgcgaagtccctcaaagacgtggagcaactgaagtggggacgcggcgggcttagcgatgccgctagaaccttcctgattaagttcggagttaaactcccctga

SEQ ID NO: 7533 - RNA, 708 nt, synthetic construct
  misc_feature 1..708: note = derived and/or modified CDS sequence (opt5) from JCV(W13135)__KM215552.1__N
  source 1..708: mol_type = other RNA
atgggcgacctggtgttctacgatgtcgccagcaccggggctaacggatttgaccccgatgccggcttcgttgcgtttatggctgaccacggggagtccgtgaatctctctgccgtgagaatcttctttctgaacgccgctaaggccaaagctgcccttgcgcggaagcctgaacgcaaagccacaccgaagttcggagagtggcaggtcgaaattgtgaataaccattttcccggcaatagaaacaatcctatcgggaacaatgatctgacgattcaccggctcagcggatatctggctcgctgggttcttgagcatttcaccacagacgatgacgaatcccaaagagagctgatccggtctaccattatcaaccccatcgccgagagcaatggcattcactggaacaatggccctgaaatctacctctcctttttccccgggacagagatgtttctggaaattttcaaattttatcctctgaccatcggaatttaccgcgtgaagcatggcatgatggatccgcagtatctcaagaaagctctgagacagcggtacgggacacttaccgccgagaagtggatggcgcagaaaacggtcctgatcgccaagtctctcaaagacgtggagcaactgaagtggggacgcggcgggcttagcgatgctgccagaaccttcctgattaagttcggagttaaactcccctga

SEQ ID NO: 7534 - RNA, 708 nt, synthetic construct
  misc_feature 1..708: note = derived and/or modified CDS sequence (opt5) from JCV(W18393)__KM215559.1__N
  source 1..708: mol_type = other RNA
atgggcgacctggtgttctacgatgtcgccagcaccggggctaacggatttgaccccgatgccggcttcgttgcgtttatggctgaccacggggagtccatcaatctctctgccgtgagaattttctttctgaacgccgctaaggccaaagctgcccttgcgcggaagcctgaacgcaaagccacaccgaagttcggagagtggcaagtggaaatcattaataaccattttcccggcaatagaaacaatcctatcgggaacaatgatctgacgattcaccggctcagcggatatctggctcgctgggtccttgagcatttcaccgccgacgatgacgaatcccagagagagctgatccggtctacaatcattaaccccatcgctgagagcaatggcattcactggaacaatggccctgaaatctacctctcctttttccccgggaccgagatgtttctggaaattttcaaattttatcctctgacaatcggaatttaccgcgtgaagcatggcatgatggatccgcagtatctcaagaaagccctgagacagcggtacgggacccttacagcggagaagtggatggcccagaaaaccgttctgatcgctaagtctctcaaagacgtggagcaactgaagtggggacgcggcgggcttagcgatgccgctagaacgttcctgatcaagttcggagtcaaactcccctga

SEQ ID NO: 7535 - RNA, 708 nt, synthetic construct
  misc_feature 1..708: note = derived and/or modified CDS sequence (opt5) from KEYV(KEYV/Ochlerotatus atlanticus/USA/KEYVLK01/2005)__KT630290.1__N
  source 1..708: mol_type = other RNA
atgggcgacctggtgttctacgatgtcgccagcaccggggctaacggatttgaccccgatgccggctatgttgcgttcatggctaatcacggggagtccatctctctcagcacagtgagaatctttttcctgaacgccgccaaggctaaagccgctcttacgcggaagcctgaacgcaaagccaccccgaagtttggagagtggcaagtggaaattgtcaataaccatttccccggcaatagaaacaatcctattgggaacaatgacctgacactccaccggatctccggatacctggcgcgctgggtgcttgagcattttggcgaaggcgaggatgagtctcagaaagaactgattaagagcaccgttatcaaccccatcgccgagtccaatgggattagatggggaaacggcgtggaaatctatctctctttctttcctgggacagagatgttcctggagctgtttaagttctaccccctcaccattggaatctatcgggtcaaacacggcatgatggacgctcagtacctgaagaaagcccttcgccagagatatgggacactgaccgctgataagtggatggcccagaaaacgagcatgattaccaagtccctcaaggacgtggaacaactgaaatggggaaagggcggccttagcgatacagcgcgggcctttctggctaaattcggggttcgcctcccttga

SEQ ID NO: 7536 - RNA, 708 nt, synthetic construct
  misc_feature 1..708: note = derived and/or modified CDS sequence (opt5) from KEYV(KEYV/Ochlerotatus atlanticus/USA/KEYVLK02/2005)__KT630293.1__N
  source 1..708: mol_type = other RNA
atgggcgacctggtgttctacgatgtcgccagcaccggggctaacggatttgaccccgatgccggctatgttgcgttcatggctaatcacggggagtccatctctctcagcacagtgagaatctttttcctgaacgccgccaaggctaaagccgctcttacgcggaagtccgaacgcaaagccacccctaagtttggagagtggcaagtggaaattgtcaataaccatttcccgggcaatagaaacaatcccattgggaacaatgacctgacactccaccggatctctggatacctggcgcgctgggtgcttgagcattttggcgaaggcgaggatgagagccagaaagaactgattaagtccaccgttatcaaccctatcgccgagtctaatgggattagatggggaaacggcgtggaaatctatctcagcttctttcccgggacagagatgttcctggagctgtttaagttctaccctctcaccattggaatctatcgggtcaaacacggcatgatggacgctcagtacctgaagaaagcccttcgccagagatatgggacactgaccgctgataagtggatggcccagaaaacgtccatgattaccaagagcctcaaggacgtggaacaactgaaatggggaaagggcggcctttctgatacagcgcgggcctttctggctaaattcggggttcgcctcccctga

SEQ ID NO: 7537 - RNA, 708 nt, synthetic construct; identical to SEQ ID NO: 7535
  misc_feature 1..708: note = derived and/or modified CDS sequence (opt5) from KEYV(C14031-33)__U12801.1__N
  source 1..708: mol_type = other RNA

SEQ ID NO: 7538 - RNA, 708 nt, synthetic construct
  misc_feature 1..708: note = derived and/or modified CDS sequence (opt5) from LACV(Human/78)__NC_004110.1__N
  source 1..708: mol_type = other RNA
atgagcgacctggtgttctacgatgtcgcctccaccggcgctaacgggtttgaccccgatgccggatatatggacttctgcgttaagaatgcggagctcctgaaccttgctgccgtgagaatctttttcctgaatgccgctaaagccaaggctgccctctctcggaaacctgaacgcaaggcgaacccgaaatttggcgagtggcaagtggaagtcattaataaccacttccccgggaatagaaacaatcctatcggaaacaatgatctgacaattcatcggcttagcggctacctggcccgctgggtgctcgaccagtataacgagaatgatgacgaatcccagcacgagctgatcagaacgaccattatcaaccccatcgctgagtctaatggggttggatgggatagcggccctgaaatttacctgtcctttttccccggcacagagatgtttctcgaaaccttcaagttttatcctctgacaatcgggattcatcgggtgaagcagggaatgatggacccgcagtaccttaaaaaggccctgcgccaaagatatggcaccctcacagctgataaatggatgtctcagaaggtcgccgcgatcgccaaaagcctgaaggacgtggagcagcttaagtgggggaaaggaggcctgtccgataccgctaagacgttcctccagaaatttgggattcggctgccctga

SEQ ID NO: 7539 - RNA, 708 nt, synthetic construct
  misc_feature 1..708: note = derived and/or modified CDS sequence (opt5) from LACV__KP271107.1__N
  source 1..708: mol_type = other RNA
atgagcgacctggtgttctacgatgtcgcctccaccggcgctaacgggtttgaccccgatacaggatatatggacttctgcgttaagaatgccgagtctctcaacctggcggctgtgagaatctttttccttaatgccgccaaagctaaggccgctctgagccggaaacctgaacgcaaggccaacccgaaatttggcgagtggcaagtggaagtcattaataaccacttccccgggaatagaaacaatcctatcggaaacaatgatctcacgattcatcggctgtccggctaccttgcgcgctgggtgctggaccagtataacgagaatgatgacgaatctcagcacgagctcatcagaaccacaattatcaaccccatcgccgagagcaatggggttggatgggattccggccctgaaatttacctgagctttttccccggcaccgagatgtttctggaaacattcaagttttatcctctcaccatcgggattcatcgggtgaagcagggaatgatggacccgcagtacctgaaaaaggcccttcgccaaagatatggcacactgaccgctgataaatggatgtctcagaaggtcgctgccatcgcgaaatccctcaaggacgtggagcagctgaagtgggggaaaggaggccttagcgatacggccaagaccttcctgcagaaatttgggattcggctcccctga

SEQ ID NO: 7540 - RNA, 708 nt, synthetic construct
  misc_feature 1..708: note = derived and/or modified CDS sequence (opt5) from LACV(BEN2_Lafayette_WI_2007)__GU596386.1__N
  source 1..708: mol_type = other RNA
atgagcgacctggtgttctacgatgtcgcctccaccggcgctaacgggtttgaccccgatgccggatatatggacttctgcgttaagaatgcggagtctctcaacctggctgccgtgagaatctttttccttaatgccgctaaagccaaggctgccctgagccggaaacctgaacgcaaggcgaacccgaaatttggcgagtggcaagtggaagtcattaataaccacttccccgggaatagaaacaatcctatcggaaacaatgatctcacaattcatcggctgtccggctaccttgcccgctgggtgctggaccagtataacgagaatgatgacgaatctcagcacgagctcatcagaacgaccattatcaaccccatcgctgagagcaatggggttggatgggattccggccctgaaatttacctgagctttttccccggcacagagatgtttctggaaaccttcaagttttatcctctcacaatcgggattcatcgggtgaagcagggaatgatggacccgcagtacctgaaaaaggcccttcgccaaagatatggcaccctgacagctgataaatggatgtctcagaaggtcgccgcgatcgccaaatccctcaaggacgtggagcagctgaagtgggggaaaggaggccttagcgataccgctaagacgttcctgcagaaatttgggattcggctcccctga

SEQ ID NO: 7541 - RNA, 708 nt, synthetic construct
  misc_feature 1..708: note = derived and/or modified CDS sequence (opt5) from LACV(Dallas/TX/2009)__GU591164.1__N
  source 1..708: mol_type = other RNA
atgagcgacctggtgttctacgatgtcgcctccaccggcgctaacgggtttgaccccgatgccggatatatggacttctgcgttaagaatgcggagtctctcaacctggctgccgtgagaatctttttccttaatgccgctaaagccaaggctgccctgagccggaaacctgaacgcaaggcgaacccgaaatttggcgagtggcaagtggaagtcgtgaataaccacttccccgggaatagaaacaatcctattggaaacaatgatctcacaatccatcggctgtccggctaccttgcccgctgggttctggaccagtataacgagaatgatgacgaatctcagagagagctcattcggacgaccatcattaaccccatcgctgagagcaatggggtgcgctgggattccggacctgaaatctacctgagctttttccccggcacagagatgtttctggaaaccttcaagttttatcctctcacaattggcatccacagagtcaagcaggggatgatggacccgcagtacctgaaaaaggcccttcggcaacgctatggaaccctgacagctgataaatggatgtctcagaaggtggccgcgattgccaaatccctcaaggacgttgagcagctgaagtggggcaaagggggacttagcgataccgctaagacgttcctgcagaaatttggcatcagactcccctga

SEQ ID NO: 7542 - RNA, 708 nt, synthetic construct
  misc_feature 1..708: note = derived and/or modified CDS sequence (opt5) from LACV(Fort Bend County/TX/2009)__GU591167.1__N
  source 1..708: mol_type = other RNA
atgagcgacctggtgttctacgatgtcgcctccaccggcgctaacgggtttgaccccgatgccggatatatggacttctgcgttaagaatgcggagtctctcaacctggctgccgtgagaatctttttccttaatgccgctaaagccaaggctgccctgagccggaaacctgaacgcaaggcgaacccgaaatttggcgagtggcaagtggaagtcattaataaccacttccccgggaatagaaacaatcctatcggaaacaatgatctcacaattcatcggctgtccggctaccttgcccgctgggtgctggaccagtataacgagaatgatgacgaatctcagagagagctcatccggacgaccattatcaaccccatcgctgagagcaatggggttcgctgggattccggacctgaaatttacctgagctttttccccggcacagagatgtttctggaaaccttcaagttttatcctctcacaatcggcattcacagagtgaagcaggggatgatggacccgcagtacctgaaaaaggcccttcggcaacgctatggaaccctgacagctgataaatggatgtctcagaaggtcgccgcgatcgccaaatccctcaaggacgtggagcagctgaagtggggcaaagggggacttagcgataccgctaagacgttcctgcagaaatttggcattagactcccctga

SEQ ID NO: 7543 - RNA, 708 nt, synthetic construct
  misc_feature 1..708: note = derived and/or modified CDS sequence (opt5) from LACV(LACV/95/OH-H (CCH-MB96))__GU206135.1__N
  source 1..708: mol_type = other RNA
atgagcgacctggtgttctacgatgtcgcctccaccggcgctaacgggtttgaccccgatgccggatatatggacttctgcgttaagaatgcggagtctctcaacctggctgccgtgagaatctttttccttaatgccgctaaagccaaggctgccctgagccggaaacctgaacgcaaggcgaacccgaaatttggcgagtggcaagtggaagtcgtgaataaccacttccccgggaatagaaacaatcctattggaaacaatgatctcacaatccatcggctgtccggctaccttgcccgctgggttctggaccagtataacgagaatgatgacgaatctcagcacgagctcattaagacgaccatcattaaccccatcgctgagagcaatggggtgggatgggattccggccctgaaatctacctgagctttttccccggcacagagatgtttctggaaaccttcaagttttatcctctcacaattgggatccatagagtcaaacagggaatgatggacccgcagtacctgaagaaagcccttcggcaacgctatggcaccctgacagctgataagtggatgtctcagaaagtggccgcgattgccaagtccctcaaggacgttgagcagctgaaatgggggaagggaggccttagcgataccgctaaaacgttcctgcagaagtttgggatcagactcccctga

SEQ ID NO: 7544 - RNA, 696 nt, synthetic construct
  misc_feature 1..696: note = derived and/or modified CDS sequence (opt5) from OROV(BeAn19991)__NC_005777.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccaccgttgtggtccccctggcggaggtgaaaggctgcacatggaatgatggggacgccatgtatctcggattcgctgccggcgctgaaatgtttctgcagaccttcacgttctttcctctggtgatcgagatgcacagagtcctcaaggatggcatggacgttaacttcatgaagaaagtgctgcggcaacgctacgggcagaagaccgccgagcagtggatgagagaagagattgtggcggtccgggccgcttttgaagccgtgggaacacttgcttgggcccgcaccggcttcagcccggccgctagagattttctgcggcagttcgggatcgacatttga

SEQ ID NO: 7545 - RNA, 696 nt, synthetic construct
  misc_feature 1..696: note = derived and/or modified CDS sequence (opt5) from OROV(AR136921)__HQ830443.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccaccgttgtggtccccctggcggaggtgaaaggctgcacatggaatgatggggacgccatgtatctcggattcgctgccggcgctgaaatgtttctgcagaccttcacgttctttcctctggtgatcgagatgcacagagtcctcaaggatggcatggacgttaacttcatgaagaaagtgctgcggcaacgctacgggcagaagaccgccgagcagtggatgagagaagagattgtggcggtccgggccgcttttgaagccgtgggaacacttgcttgggcccgcaccggcttcagcccggccgctagagattttctgcggcagttcgggatcggaatttga

SEQ ID NO: 7546 - RNA, 696 nt, synthetic construct
  misc_feature 1..696: note = derived and/or modified CDS sequence (opt5) from OROV(AR366927)__HQ830448.1__N
  source 1..696: mol_type = other RNA
atgagcgagttctttttcaacgacgtgccccagagaaccacatccacgtttgatcctgaagccgcttacgtcgccttcgaggcgcggtatggccaagttctgaatgctggggtggtgcgcgtctttttcctcaaccagaagaaagccaaggacgtgctgagaaaaacctctcggccgatggttgatcttacatttggaggcgtgcagttcgccatggtcaataaccactttccccagttccaaagcaatcctgtgcccgacaacgggctgaccctccatcgcctgtccggataccttgctagatgggcctttacacagatgcggtctcctatcaagcaggctgagttccgcgccaccgttgtggtccccctggcggaagtgaaaggctgcacatggaatgatggggacgccatgtatctcggatttgctgccggcgctgaaatgttcctgcagaccttcacgtttttccctctggtgattgagatgcacagagtcctcaaggatggcatggacgttaactttatgaagaaagtgctgcggcaaaagtacgggcagaaaaccgccgagcagtggatgcgcgaagagatcgtggcggtcagagccgctttcgaagccgtgggaacacttgcttgggcccggaccggctttagcccggccgctcgcgatttcctgagacagtttgggattggaatctga

SEQ ID NO: 7547 - RNA, 696 nt, synthetic construct
  misc_feature 1..696: note = derived and/or modified CDS sequence (opt5) from OROV(BeAn 206119)__AY993909.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccgcggttgtggtccccctggtggaggtgaaaggctgcacctggaatgatggggacgccatgtatctcggattcgctgccggcgctgaaatgtttctgcagacattcaccttctttcctctggtcatcgagatgcacagagttctcaaggatggcatggacgtgaacttcatgaagaaagtgctgcggcaacgctacgggcagaagacggccgagcagtggatgagagaagagattgtcgcggtgcgggccgcttttgaaaccgttggaacattcgcctgggctcgcaccggctttagcccggccgccagagatttccttcggcagtttgggatcggaatttga

SEQ ID NO: 7548 - RNA, 696 nt, synthetic construct
  misc_feature 1..696: note = derived and/or modified CDS sequence (opt5) from OROV(BeAn 208819)__AY993911.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccaccgttgtggtccccctggtggaggtgaaaggctgcacatggaatgatggggacgcgatgtatctcggattcgccgctggcgccgaaatgtttctgcagaccttcacgttctttcctctggtcatcgagatgcacagagttctcaaggatggcatggacgtgaacttcatgaagaaagtgctgcggcaacgctacgggcagaagaccgctgagcagtggatgagagaagagattgtcgccgtgcgggcggcctttgaagctgttggaacacttgcctgggctcgcaccggcttcagcccggccgccagagattttctgcggcagttcgggatcggaatttga

SEQ ID NO: 7549 - RNA, 696 nt, synthetic construct
  misc_feature 1..696: note = derived and/or modified CDS sequence (opt5) from OROV(BeAn 208823)__AY993912.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccaccgttgtggtccccctggtggaggtgaaaggctgcacatggaatgatggggacgcgatgtatctcggattcgccgctggcgccgaaatgtttctgcagaccttcacgttctttcctctggtcatcgagatgcacagagttctcaaggatggcatggacgtgaacttcatgaagaaagtgctgcggcaacgctacgggcagaagaccgctgagagatggatgcgggaagagattgtcgccgtgcgcgcggcctttgaagctgttggaacacttgcctgggctagaaccggcttcagcccggccgcccgggattttctgcgccagttcgggatcggaatttga

SEQ ID NO: 7550 - RNA, 696 nt, synthetic construct
  misc_feature 1..696: note = derived and/or modified CDS sequence (opt5) from OROV(H244576)__HQ830444.1__N
  source 1..696: mol_type = other RNA
atgagcgagttctttttcaacgacgtgccccagagaaccacatccacgtttgatcctgaagccgcttacgtcgccttcgaggcgcggtatggccaagttctgaatgctggggtggtgcgcgtctttttcctcaaccagaagaaagccaaggacgtgctgagaaaaacctctcggccgatggttgatcttacatttggaggcgtgcagttcgccatggtcaataaccactttccccagttccaaagcaatcctgtgcccgacaacgggctgacctttcatcgcctctccggatacctggctagatgggccttcacacagatgcggtctcctatcaagcaggctgaatttcgcgccaccgttgtggtcccccttgcggaggtgaaaggctgcacatggaatgatggggacgccatgtatctgggattcgctgccggcgctgaaatgttcctccagacctttacgttctttcctctggtgattgagatgcacagagtcctgaaggatggcatggacgttaacttcatgaagaaagtgctccggcaaaagtacgggcagaaaaccgccgagcagtggatgcgcgaagagatcgtggcggtcagagccgcttttgaagccgtgggaacactggcttgggcccggaccggcttcagcccggccgctcgcgattttcttagacagttcgggattggaatctga

SEQ ID NO: 7551 - RNA, 696 nt, synthetic construct
  misc_feature 1..696: note = derived and/or modified CDS sequence (opt5) from OROV(H355186)__HQ830446.1__N
  source 1..696: mol_type = other RNA
atgagcgagttcatcttttccgacgtgccccagagaaccacatctacgttcgatcctgaagccgcttacgtcgcctttgaggcgcggtatggccaagttctgaacgctggggtggtgcgcgtcttctttctcaatcagaagaaagccaaggacgtgctgagaaaaaccagccggccgatggttgatcttacattcggaggcgtgcagtttgccatggtcaacaatcacttcccccagtttcaatccaaccctgtgcccgacaatgggctgaccctccatcgcctgtctggataccttgctagatgggccttcacacagatgcggagccctattaagcaggctgaatttcgcgccaccgttgtggtccccctggcggaggtgaaaggctgcacatggaacgatggggacgccatgtatctcggattcgctgccggcgctgaaatgtttctgcagaccttcacgttctttcctctggtgatcgagatgcacagagtcctcaaggatggcatggacgttaatttcatgaagaaagtgctgcggcaacgctacgggcagaagaccgccgagcagtggatgagagaagagattgtggcggtccgggccgcttttgaagccgtgggaacacttgcttgggcccgcaccggcttctccccggccgctagagattttctgcggcagttcgggatcggaatttga

SEQ ID NO: 7552 - RNA, 696 nt, synthetic construct
  misc_feature 1..696: note = derived and/or modified CDS sequence (opt5) from OROV(H356898)__HQ830447.1__N
  source 1..696: mol_type = other RNA
atgagcgagttcatctttaacgacgtgccccagagaaccacatccacgttcgatcctgaagccgcttacgtctcttttgaggcccggtatggccaagttctgaatgcgggggtggtgcgcgtcttctttctcaaccagaagaaagctaaggacgtgctgagaaaaaccagccggccgatggttgatcttacattcggaggcgtgcagtttgccatggtcaataaccacttcccccagtttcaatccaatcctgtgcccgacaacgggctgaccctccatcgcctgtctggataccttgccagatgggctttcacacagatgcggagccctattaagcaggccgaatttcgcgctaccgttgtggtccccctggccgaggtgaaaggctgcacatggaatgatggggacgcgatgtatctcggattcgccgctggcgccgaaatgtttctgcagaccttcacgttctttcctctggtgatcgagatgcacagagtcctcaaggatggcatggacgttaacttcatgaagaaagtgctgcggcaacgctacgggcagaagaccgctgagcagtggatgagagaagagattgtggccgtccgggcggcctttgaagctgtgggaacacttgcctgggctcgcaccggcttctccccggccgccagagattttctgcggcagttcgggatcggaatttga

SEQ ID NO: 7553 - RNA, 696 nt, synthetic construct
  misc_feature 1..696: note = derived and/or modified CDS sequence (opt5) from OROV(H389865)__HQ830453.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacacatgcggtctcctattaagcaggctgaatttcgcgccaccgttgtggtccccctggcggaggtgaaaggctgcacatggaatgatggggacgccatgtatctcggattcgctgccggcgctgaaatgtttctgcagaccttcacgttctttcctctggtgatcgagatgcatagagtcctcaaggatggcatggacgttaacttcatgaagaaatttctgcggcagcgctacgggcaaaagaccgccgagcagtggatgagagaagagattcttgcggtgaaagccgctttcgaaagcgtgggaacactggcctgggctcggaccggcttttccccggccgcccgcgatttcctcagacagtttgctatcgggatttga

SEQ ID NO: 7554 - RNA, 696 nt, synthetic construct
  misc_feature 1..696: note = derived and/or modified CDS sequence (opt5) from OROV(H472433)__HQ830455.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcagcggagtgcagtttgccatggtcaataaccacttcccccagtttcaatccaatcctgtgcccgacaacggcctgaccctccatcgcctgtctgggtaccttgctagatgggccttcacacagatgcggagccctattaagcaggctgaatttcgcgccaccgttgtggtccccctggcggaggtgaaaggatgcacatggaatgatggcgacgccatgtatctcgggttcgctgccggagctgaaatgtttctgcagaccttcacgttctttcctctggtgatcgagatgcacagagtcctcaaggatggcatggacgttaacttcatgaagaaagtgctgcggcaacgctacggccagaagaccgccgagcagtggatgagagaagagattgtggcggtccgggccgcttttgaagccgtggggacacttgcttgggcccgcaccggattctccccggccgctagagattttctgcggcagttcggcatcgggatttga

SEQ ID NO: 7555 - RNA, 696 nt, synthetic construct
  misc_feature 1..696: note = derived and/or modified CDS sequence (opt5) from OROV(H532490)__HQ830463.1__N
  source 1..696: mol_type = other RNA
atgagcgagttcatctttaacgacgtgccccagagaaccacatccacgttcgatcctgaagccgcttacgtctcttttgaggcccggtatggccaagttctgaatgcgggggtggtgcgcgtcttctttctcaaccagaagaaagctaaggacgtgctgagaaaaaccagctccccgatggttgatcttacattcggaggcgtgcagtttgccatggtcaataaccacttcccccagtttcaatctaatcctgtgcccgacaacgggctgaccctccatcggctgagcggataccttgcccgctgggctttcacacagatgagatcccctattaagcaggccgaatttcgggctaccgttgtggtccccctggccgaggtgaaaggctgcacatggaatgatggggacgcgatgtatctcggattcgccgctggcgccgaaatgtttctgcagaccttcacgttctttcctctggtgatcgagatgcaccgcgtcctcaaggatggcatggacgttaacttcatgaagaaagtgctgagacaacggtacgggcagaagaccgctgagcagtggatgcgcgaagagattgtggccgtcagagcggcctttgaagctgtgggaacacttgcctgggctcggaccggcttctctccggccgcccgcgattttctgagacagttcgggatcggaatttga

SEQ ID NO: 7556 - RNA, 696 nt, synthetic construct
  misc_feature 1..696: note = derived and/or modified CDS sequence (opt5) from OROV(H543629)__HQ830467.1__N
  source 1..696: mol_type = other RNA
atgagcgagttcctgtttaacgacgtgccccagagaaccacatccacgttcgatcctgaagccgcttacgtcgcctttgaggcgcggtatggccaagttctcaatgctggggtggtgcgcgtcttctttctgaaccagaagaaagccaaggacgtgcttagaaaaacctctcggccgatggttgatctgacattcggaggcgtgcagtttgccatggtcaataaccacttcccccagtttcaaagcaatcctgtgcccgacaacgggctcaccctgcatcgcctttccggatacctggctagatgggccttcacacagatgcggtctcctatcaagcaggctgaatttcgcgccaccgttgtggtccccctcgcggaggtgaaaggctgcacatggaatgatggggacgccatgtatctgggattcgctgccggcgctgaaatgtttctgcagaccttcacgttctttcctctcgtgattgagatgcacagagtcctgaaggatggcatggacgttaacttcatgaagaaagtgcttcggcaacgctacgggcagaagaccgccgagcagtggatgagagaagagatcgtggcggtccgggccgcttttgaagccgtgggaacactggcttgggcccgcaccggcttcagcccggccgggagagattttctccggcagttcggaattggcatctga

SEQ ID NO: 7557 - RNA, 696 nt, synthetic construct
  misc_feature 1..696: note = derived and/or modified CDS sequence (opt5) from OROV(H543638)__HQ830468.1__N
  source 1..696: mol_type = other RNA
atgagcgagttcctgtttaacgacgtgccccagagaaccacatccacgttcgatcctgaagccgcttacgtcgcctttgaggcgcggtatggccaagttctcaatgctggggtggtgcgcgtcttctttctgaaccagaagaaagccaagaatgtgcttagaaaaacctctcggccgatggttgacctgacattcggaggcgtgcagtttgccatggtcaacaatcacttcccccagtttcaaagcaaccctgtgcccgataatgggctcaccctgcatcgcctttccggatacctggctagatgggccttcacacagatgcggtctcctatcaagcaggctgaatttcgcgccaccgttgtggtccccctcgcggaggtgaaaggctgcacatggaacgacggggatgccatgtatctgggattcgctgccggcgctgaaatgtttctgcagaccttcacgttctttcctctcgtgattgagatgcacagagtcctgaaggacggcatggatgttaatttcatgaagaaagtgcttcggcaacgctacgggcagaagaccgccgagcagtggatgagagaagagatcgtggcggtccgggccgcttttgaagccgtgggaacactggcttgggcccgcaccggcttcagcccggccgggagagactttctccggcagttcggaattggcatctga

SEQ ID NO: 7558 - RNA, 696 nt, synthetic construct
  misc_feature 1..696: note = derived and/or modified CDS sequence (opt5) from OROV(H706890)__HQ830473.1__N
  source 1..696: mol_type = other RNA
atggccgagttcatctttaacgacgtgccccagagaaccacaagcacgttcgatcctgaagctgcctacgtcgcgtttgaggctcggtatggccaagttctgaatgccggggtggtgcgcgtcttctttctcaaccagaagaaagccaaggacgtgctgagaaaaacctcccggccgatggttgatcttacattcggaggcgtgcagtttgctatggtcaataaccacttcccccagtttcaatctaatcctgtgcccgacaacgggctgaccctccatcgcctgagcggataccttgccagatgggctttcacacagatgcggtcccctattaagcaggccgaatttcgcgcgaccgttgtggtccccctggccgaggtgaaaggctgcacatggaatgatggggacgctatgtatctcggattcgccgctggcgccgaaatgtttctgcagaccttcacgttctttcctctggtgatcgagatgcacagagtcctcaaggatggcatggacgttaacttcatgaagaaagtgctgcggcaacgctacgggcagaagaccgcggagcagtggatgagagaagagattgtggccgtccgggctgcctttgaagctgtgggaacacttgcctgggcccgcaccggcttctctccggctgcgagagattttctgcggcagttcgggatcggaatttga

SEQ ID NO: 7559 - RNA, 696 nt, synthetic construct
  misc_feature 1..696: note = derived and/or modified CDS sequence (opt5) from OROV(H758669)__HQ830479.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccattctgaataaccacttcccccagtttcaaagcaatcctgtccccgacaacgggctcaccctgcatcgcctttccggatacctggctagatgggccttcacacagatgcggtctcctatcaagcaggctgaatttcgcgccaccgtggttgtgcccctcgcggaggtcaaaggctgcacatggaatgatggggacgccatgtatctgggattcgctgccggcgctgaaatgtttctgcagaccttcacgttctttcctctcgtgattgagatgcacagagtgctgaaggatggcatggacgtcaacttcatgaagaaagttcttcggcaacgctacgggcagaagaccgccgagcagtggatgagagaagagatcgtggcggtgcgggccgcttttgaagccgtcggaacactggcttgggcccgcaccggcttcagcccggccgctagagattttctccggcagttcgggattggaatctga

SEQ ID NO: 7560 - RNA, 696 nt, synthetic construct
  misc_feature 1..696: note = derived and/or modified CDS sequence (opt5) from OROV(H758687)__HQ830478.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccaccgttgtggtccccctggcggaggtgaaaggctgcacatggaatgatggggacgccatgtatctcggattcgctgccggcgctgaaatgtttctgcagaccttcacgttctttcctttcgtgatcgagatgcacagagtcctgaaggatggcatggacgttaactttatgaagaaagtgctccggcaacgctacgggcagaagaccgccgagcagtggatgagagaagagattgtggcggtccgggccgctttcgaagccgtgggaacactggcttgggcccgcaccggctttagcccggccgctagagatttccttcggcagtttgggatcggaatttga

SEQ ID NO: 7561 - RNA, 696 nt, synthetic construct
  misc_feature 1..696: note = derived and/or modified CDS sequence (opt5) from OROV(H759041)__HQ830488.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccaccgttgtggtccccctggcggaggtgaaaggctgcacatggaatgatggggacgccatgtatctcggattcgctgccggcgctgaaatgtttctgcagaccttcacgttctttcctctggtgatcgagatgcacagagtcctcaacgatggcatggacgttaatttcatgaagaaggtgctgcggcaacgctacgggcagaaaaccgccgagcagtggatgagagaagagattgtggcggtccgggccgcttttgaagccgtgggaacacttgcttgggcccgcaccggcttcagcccggccgctagagattttctgcggcagttcgggatcggaatttga

SEQ ID NO: 7562 - RNA, 696 nt, synthetic construct
  misc_feature 1..696: note = derived and/or modified CDS sequence (opt5) from OROV(BeAr473358)__AF164539.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacacatgcggtctcctattaagcaggctgaatttcgcgccaccgttgtggtccccctggcggaggtgaaaggctgcacatggaatgatggggacgccatgtatctcggattcgctgccggcgctgaaatgtttctgcagaccttcacgttctttcctctggtgatcgagatgcatagagtcctcaaggatggcatggacgttaacttcatgaagaaaattctgcggcagcgctacgggcaaaagaccgccgagcagtggatgagagaagagatcattgcggtgaaaacagcctttgaaaccgtgggaacacttgcttgggccatcaccggcttcagcccggctgcccggaattttctgcgccagttcgagatcgatatttga

SEQ ID NO: 7563 - RNA, 696 nt, synthetic construct
  misc_feature 1..696: note = derived and/or modified CDS sequence (opt5) from OROV(BeH 521086)__AY704559.1__N
  source 1..696: mol_type = other RNA
atgagcgagttcctgtttaacgacgtgccccagagaaccacatccacgttcgatcctgaagccgcttacgtcgcctttgagtctcggtatggccaagttctcaatgcgggggtggtgcgcgtcttctttctgaaccagaagaaagctaaggacgtgcttagaaaaaccagccggccgatggttgatctgacattcggaggcgtgcagtttaccatggtcaataaccacttcccccagtttcaatccaatcctgtgcccgacaacgggctcacactgcatcgcctttctggatacctggccagatgggccttcacccagatgcggagccctatcaagcaggctgaatttcgcgccacagttgtggtccccctcgctgaggtgaaaggctgcacctggaatgatggggacgccatgtatctgggattcgcggccggcgctgaaatgtttctgcagacgttcaccttctttcctctcgtgattgagatgcacagagtcctgaaggatggcatggacgttaacttcatgaagaaagtgcttcggcaacgctacgggcagaagacagccgagcagtggatgagagaagagatcgtggctgtccgggccgcgtttgaagccgtgggaaccctggcttgggcccgcacaggcttctccccggctgccagagattttctccggcagtctgggattggaatctga

SEQ ID NO: 7564 - RNA, 696 nt, synthetic construct
  misc_feature 1..696: note = derived and/or modified CDS sequence (opt5) from OROV(BeH121923)__HM470110.1__N
  source 1..696: mol_type = other RNA
atgagcgagttcatctttaacgacgtgccccagagaaccacatcctctttcgatcctgaagccgcttacgtcgcctttgaggcgcggtatggccaagttctgaatgcttgcgtggtgcgcgtcttctttctcaaccagaagaaagccaaggacgtgctgagaaaaacgagctggccgatggttgatcttaccttcgggcgggtgcagtttgccatggtcaataaccacttcccccagtttcaatccaatcctgtgcccgacaacggactggctctccatcgcctgtctggctaccttgccagatgggctttcacacagatgcggagccctattaagcaggccgaatttcgcgcgaccgttgtggtccccctggccgaggtgaaagggtgtacatggaatgatggagacgctatgtatctcggcttcgccgctggggccgaaatgtttctgcagaccttcacattctttcctctggtgatcgagatgcacagagtcctcaaggatggaatggacgttaacttcatgaagaaagtgctgcggcaacgctacggccagaagaccgcggagcagtggatgagagaagagattgtggccgtccgggctgcctttgaagctgtgggcacgcttgcctgggcccgcaccgggttctccccggctgcgagagattttctgcggcagttcggaatcgacatttga

SEQ ID NO: 7565 - RNA, 696 nt, synthetic construct
  misc_feature 1..696: note = derived and/or modified CDS sequence (opt5) from OROV(BeH379693)__AF164534.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagacggacctctcgcccgatggttgatcttacattcggaggcgtgcagtttgccatggtcaataaccacttcccccagtttcaaagcaatcctgtgcccgacaacgggctgaccctccatagactgtccggataccttgctcggtgggccttcacacagatgcgctctcctattaaacaggctgaatttagagccaccgttgtggtccccctggcggaggtgaagggctgcacatggaatgatggggacgccatgtatctcggattcgctgccggcgctgaaatgtttctgcagaccttcacgttctttcctctggtgatcgagatgcaccgggtcctcaaagatggcatggacgttaacttcatgaagaaggtgctgcgccaaagatacgggcagaaaaccgccgagcagtggatgcgggaagagattgtggcggtccgcgccgcttttgaagccgtgggaacacttgcttgggccagaaccggcttcagcccggccgctcgggattttctgcgccagttcgggatcggaatttga

SEQ ID NO: 7566 - RNA, 696 nt, synthetic construct
  misc_feature 1..696: note = derived and/or modified CDS sequence (opt5) from OROV(BeH381114)__AF164535.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccaccgttgtggtccccctggcggaggtgaaaggctgcacatggaatgatggggacgccatgtatctcggattcgctgccggcgctgaaatgtttctgcagaccttcacgttctttcctctggtgatcgagatgcacagagtcctcaaggatggcatggacgttaacttcatgaagaaagtgctgcggcaacgctacgggcagaagaccgccgagcagtggatgagagaagagattgtggcggtccgggccgcttttgaagccgtgggaacacttgcttgggcccgcaccggcttcagcccggccgctagagattttctgcggcagttcgggatctgtatttga

SEQ ID NO: 7567 - RNA, 696 nt, synthetic construct
  misc_feature 1..696: note = derived and/or modified CDS sequence (opt5) from OROV(BeH390233)__AF164536.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccaccgttgtggtccccctggcggaggtgaaaggctgcacatggaatgatggggacgccatgtatctcggattcgctgccggcgctgaaatgtttctgcagaccttcacgttctttcctctggtgatcgagatgcacagagtcctcaaggatggcatggacgttaacttcatgaagaaagtgctgcggcaacgctacgggcagaagaccgccgagcagtggatgagagaagagattgtggcggtccgggccgcttttgaagccgtgggaacacttgcttgggcccgcaccggcttcagcccggccgctagagattttctggggcagttcggaatcggcatttga

SEQ ID NO: 7568 - RNA, 696 nt, synthetic construct
  misc_feature 1..696: note = derived and/or modified CDS sequence (opt5) from OROV(BeH472204)__AF164538.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccaccgttgtggtccccctggcggaggtgaaaggctgcacatggaatgatggggacgccatgtatctcggattcgctgccggcgctgaaatgtttctgcagaccttcacgttctttcctctggtgatcgagatgcacagagtcctcaaggatggcatggacgttaacttcatgaagaaagtgctgcggcaacgctacgtgcagaagaccgccgagcagtggatgagagaagagattgtcgcggtgcgggccgcttttgaagccgttgggacacttgcttgggcccgcaccggattcagcccggccgctagagattttctgcggcagttcggcatcgggatttga

SEQ ID NO: 7569 - RNA, 696 nt, synthetic construct
  misc_feature 1..696: note = derived and/or modified CDS sequence (opt5) from OROV(BeH505442)__AF164542.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccaccgttgtggtccccctggcggaggtgaaaggctgcacatggaatgatggggacgccatgtatctcggattcgctgccggcgctgaaatgtttctgcaggccttcaccttctttcctctggtgatcgagatgcacagagtcctcaaggatggcatggacgttaacttcatgaagaaagtgctgcggcaacgctacgggcagaagacggcggagcagtggatgagagaagagattgtggccgtccgggctgcctttgaagctgtgggaacccttgcctgggcccgcacaggcttcagcccggctgcgagagattttctgcggcagttcgggatcgacatttga

SEQ ID NO: 7570 - RNA, 696 nt, synthetic construct
  misc_feature 1..696: note = derived and/or modified CDS sequence (opt5) from OROV(BeH541863)__AF164544.1__N
  source 1..696: mol_type = other RNA
atgagcgagttcatcttttccgacgtgccccagagaaccacatctacgttcgatcctgaagccgcttacgtcgcctttgaggcgcggtatggccaagttctgaacgctggggtggtgcgcgtcttctttctcaatcagaagaaagccaaggacgtgctgagaaaaaccagccggccgatggttgatcttacattcggaggcgtgcagtttgccatggtcaacaatcacttcccccagtttcaatccaaccctgtgcccgacaatgggctgaccctccatcgcctgtctggataccttgctagatgggccttcacacagatgcggagccctattaagcaggctgaatttcgcgccaccgttgtggtccccctggcggaggtgaaaggctgcacatggaacgatggggacgccatgtatctcggattcgctgccggcgctgaaatgtttctgcagaccttcacgttctttcctctggtgatcgagatgcacagagtcctcaaggatggcatggacgttaatttcatgaagaaagtgctgcggcaacgctacgggcagaagaccgccgagcagtggatgagagaagagattgtggcggtccgggccgcttttgaagccgtgggaacacttgcttgggcccgcaccggcttctccccggccgctagaaactttctgcggcagttcgggatcggaatttga

SEQ ID NO: 7571 - RNA, 696 nt, synthetic construct
  misc_feature 1..696: note = derived and/or modified CDS sequence (opt5) from OROV(BeH543033)__AF164545.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccaccgttgtggtccccctggcggaggtgaaaggctgcacatggaatgatggggacgccatgtatctcggattcgctgccggcgctgaaatgtttctgcagaccttcacgttctttcctctggtgatcgagatgcacagagtcctcaaggatggcatggacgttaacttcatgaagaaagtgctgcggcaacgctacgggcagaagaccgccgagcagtggatgagagaagagattgtggcggtccgggccgcttttgaagccgtgggaacacttgcttgggcccgcaccggcttcagcccggccgctagagagtttctgcggcagttcgggatcggaatttga

SEQ ID NO: 7572 - RNA, 696 nt, synthetic construct
  misc_feature 1..696: note = derived and/or modified CDS sequence (opt5) from OROV(BeH543618)__AF164548.1__N
  source 1..696: mol_type = other RNA
atgcaggagttcatctttaacgacgtgccccaaagaaccacaagcacgttcgatcctgaagccgcttacgtcgcctttgaggcgcggtatggccaggttctgaatgctggggtggtgcgcgtcttctttctcaaccagaagaaagccaaggacgtgctgagaaaaacctcccggccgatggttgatcttacattcggaggcgtgcagtttgccatggtcaataaccacttcccccaatttcagtctaatcctgtgcccgacaacgggctgaccctccatcgcctgagcggataccttgctagatgggccttcacacagatgcggtcccctattaagcaggctgaatttcgcgccaccgttgtggtccccctggcggaggtgaaaggctgcacatggaatgatggggacgccatgtatctcggattcgctgccggcgctgaaatgtttctgcaaaccttcacgttctttcctctggtgatcgagatgcacagagtcctcaaggatggcatggacgttaacttcatgaagaaagtgctgcggcagcgctacgggcagaagaccgccgagcagtggatgagagaagagattgtggcggtccgggccgcttttgaagccgtgggaacacttgcttgggcccgcaccggcttctctccggccgctagagattttctgcggcaattcgggatcggaatttga

SEQ ID NO: 7573 - RNA, 696 nt, synthetic construct
  misc_feature 1..696: note = derived and/or modified CDS sequence (opt5) from OROV(BeH544552)__AF164546.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccaccgttgtggtccccctggcggaggtgaaaggctgcacatggaatgatggggacgccatgtatctcggattcgctgccggcgctgaaatgtttctgcagaccttcacgttctttcctctggtgatcgagatgcacagagtcctcaaggatggcatggacgttaacttcatgaagaaagtgctgcggcaacgctacgggcagaagaccgccgagcagtggatgagagaagagattgtggcggtccgggccgcttttgaagccgtgggaacacttgcttgggcccgcaccggcttcagcccggccgctagagattttctgcggcagatcgggattggaatctga

SEQ ID NO: 7574 - RNA, 696 nt, synthetic construct
  misc_feature 1..696: note = derived and/or modified CDS sequence (opt5) from OROV(GML444911)__AF164556.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccaccgttgtggtccccctggcggaggtgaaaggctgcacatggaatgatggggacgccatgtatctcggattcgctgccggcgctgaaatgtttctgcagaccttcacgttctttcctctggtgatcgagatgcacagagtcctcaaggatggcatggacgttaacttcatgaagaaagtgctgcggcaacgctacgggcagaagaccgccgagcagtggatgagagaagagattgtggcggtccgggccgcttttgaagccgtgggaacacttgcttgggcccgcaccggcttcagcccggccgctagagattttctgcggcagttcgggatctatatttga

SEQ ID NO: 7575 - RNA, 696 nt, synthetic construct
  misc_feature 1..696: note = derived and/or modified CDS sequence (opt5) from OROV(IQT4083)__AF164552.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccaccgttgtggtccccctggcggaggtgaaaggctgcacatggaatgatggggacgccatgtatctcggattcgctgccggcgctgaaatgtttctgcagaccttcacgttctttcctctggtgatcgagatgcacagagtcctcaaggatggcatggacgttaacttcatgaagaaagtgctgcggcaacgctacgggaagaaaaccgccgagcagtggatgagagaagagattgtggcggtccgggccgcttttgaagccgtgggaacacttgcttgggcccgcaccggcttcagcccggccgctagagattttctgcggcagttcgggatcgacatttga

SEQ ID NO: 7576 - RNA, 696 nt, synthetic construct
  misc_feature 1..696: note = derived and/or modified CDS sequence (opt5) from OROV(PPS 522 H 669314)__EF467370.1__N
  source 1..696: mol_type = other RNA
atgagcgagttcatctccaacgacgtgccccacagaaccacatctacgtttgatcctgaagccgcttacgtcgccttcgaggcgcggtatggccaggttctgaatgctggggtggtgcgcgtctttttcctcaaccaaaagaaagccaaggacgtgctgagaaaaaccagccggccgatggttgatcttacatttggaggcgtgcagttcgccatggtcaataaccattttccccagttccagtccaatcctgtgcccgacaacgggctgaccctccaccgcctgtctggataccttgctagatgggcctttacacaaatgcggagccctattaagcaggctgagttccgcgccaccgttgtggtccccctggcggaagtgaaaggctgcacatggaatgatggggacgccatgtatctcggatttgctgccggcgctgaaatgttcctgcagacctttacgttcttccctctggtgatcgagatgcatagagtcctcaaggatggcatggacgttaactttatgaagaaagtgctgcggcagcgctacgggcaaaagaccgccgagcagtggatgagagaagagattgtggcggtccgggccgctttcgaagccgtgggaacacttgcttgggcccgcaccggcttttccccggccgctagagatttcctgcggcagtttgggatctgtatttga

SEQ ID NO: 7577 - RNA, 696 nt, synthetic construct
  misc_feature 1..696: note = derived and/or modified CDS sequence (opt5) from OROV(TVP-19254/GML-480914)__KP795083.1__N
  source 1..696: mol_type = other RNA
atgagcgagttcatctttaacgacgtgccccagagaaccacatccacgttcgatcctgaagccgcttacgtcgcctttgaggcgcggtatggccaagttctgtctgctggggtggtgcgcgtcttctttctcaatcagaagaaagccaaggacgtgctgagaaaaaccagccggccgatggttgatcttacattcggaggcgtgcagtttgccatggtcaacaatcacttcccccagtttcaatccaaccctgtgcccgacaatgggctgaccctccatcgcctgtctggataccttgctagatgggccttcacacagatgcggagccctattaagcaggctgaatttcgcgccaccgttgtggtccccctggcggaggtgaaaggctgcacatggaacgatggggacgccatgtatctcggattcgctgccggcgctgaaatgtttctgcagaccttcacgttctttcctctggtgatcgagatgcacagagtcctcaaggatggcatggacgttaatttcatgaagaaagtgctgcggcaacgctacgggcagaagaccgccgagcagtggatgagagaagagattgtggcggtccgggccgcttttgaagccgtgggaacacttgcttgggcccgcaccggcttctccccggccgctagagattttctgcggcagttcgggatcgacatttga

SEQ ID NO: 7578 - RNA, 696 nt, synthetic construct
  misc_feature 1..696: note = derived and/or modified CDS sequence (opt5) from OROV(TVP-19256/IQE-7894)__KP795086.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttaccatggtcaataaccacttcccccagtttcaaagcaatcctgtgcccgacaacgggctgacactccatcgcctgtccggataccttgccagatgggctttcacccagatgcggtctcctattaagcaggccgaatttcgcgctacagttgtggtccccctggccgaggtgaaaggctgcacctggaatgatggggacgcgatgtatctcggattcgccgctggcgccgaaatgtttctgcagacgttcaccttctttcctctggtgatcgagatgcacagagtcctcaaggatggcatggacgttaacttcatgaagaaagtgctgcggcaacgctacgggcagaagacagctgagcagtggatgagagaagagattgtggccgtccgggcggcctttgaagctgtgggaacccttgcctgggctcgcacaggcttcagcccggccgccagagattttctgcggcagttcgggatcgacatttga

SEQ ID NO: 7579 - RNA, 696 nt, synthetic construct
  misc_feature 1..696: note = derived and/or modified CDS sequence (opt5) from OROV(TVP-19258/IQT-4083)__KP795092.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcggcaccgttgtggtccccctggccgaggtgaaagggtgcacatggaatgatggagacgcgatgtatctcggcttcgccgctggcgccgaaatgtttctgcagaccttcacgttctttcctctggtgatcgagatgcacagagtcctcaaggatgggatggacgttaacttcatgaagaaagtgctgcggcaacgctacggacagaagaccgctgagcagtggatgagagaagagattgtggccgtccgggcggcctttgaagctgtgggcacacttgcctgggctcgcaccgggttcagcccggccgccagagattttctgcggcagttcggaatcgacatttga

SEQ ID NO: 7580 - RNA, 699 nt, synthetic construct
  misc_feature 1..699: note = derived and/or modified CDS sequence (opt5) from OROV/FPV(Aus Ch 16129)__AF362400.1__N
  source 1..699: mol_type = other RNA
atgaccgacttcgtgtttaacgatgtcccccagagagccacaagcacgttcgaccctgaggctgcctacgttgcgtttgaaaatcggttccgcgctaacctgaccgtggatgtggccagaatctttttcctcaatcaaaagaaagccaaggaccggctggctaaaacagcccgcgctaccgtcgatattacatttggcggggtggttttcccggtggtcaacaatcactatcccgagtaccagagaaaccctgtgcccgacgatggacttaccctgcatcggctctccggctatctggcccgctggcttatcgaccagtgcaatgcgtctcctgttagaatgacagaaattcggaccaaggtgatcattcccctggccgaggtcaaagggtgtacgtggaacgatggagctagcatgtacctcggctttgccgctggggccgaaatgttcctgcagtcctttaccttctatcctctggtgatcgagatgcaacgcgtgctcaaggacggaatggatgtcaattttatgagaaaggttctgcggcagcgctacggcacaaaaaccgcggagcagtggatgagagacgatatcgtggccgtgaagacagctttcgaagccattaacaccatctcttgggctcggagcggcttctccccggccgcccgcgagtttcttagacagttcgggattaatatctga

SEQ ID NO: 7581 - RNA, 696 nt, synthetic construct
  misc_feature 1..696: note = derived and/or modified CDS sequence (opt5) from OROV/IQTV(IQE3728/PER/06)__KF150535.1__N
  source 1..696: mol_type = other RNA
atgagcgagttcatctttaacgacgtgccccagagaaccacatccacgttcgatcctgaagccgcttacgtcgcctttgaggcgcggtatggccaagttctgaatgctggggtggtgcgcgtcttctttctcaaccagaagaaagccaaggacgtgctgagaaaaacctctcggccgatggttgatcttacattcggaggcgtgcagtttgccatggtcaataaccacttcccccagtttcaaagcaatcctgtgcccgacaacgggctgaccctccatcgcctgtccggataccttgctagatgggccttcacacagatgcggtctcctattaagcaggctgaatttcgcgccaccgttgtggtccccctggcggaggtgaaaggctgcacatggaatgatggggacgccatgtatctcggattcgctgccggcaccgaaatgtttctgcagacgttcaccttctttcctctggtgatcgagatgcacagagtcctcaaggatggcatggacgttaacttcatgaagaaagtgctgcggcaacgctacgggcagaagacagctgagcagtggatgagagaagagattgtggccgtccgggcggcctttgaagctgtgggaacccttgcctgggctcgcacaggcttcagcccggccgccagagattttctgcggcagttcgggatcggaatttga

SEQ ID NO: 7582 - RNA, 699 nt, synthetic construct
  misc_feature 1..699: note = derived and/or modified CDS sequence (opt5) from OROV/UTIV(Be An 84785)__KF697156.1__N
  source 1..699: mol_type = other RNA
atggccgagttcgtgtttaacgacgtcccccagagaagcacctccacattcgatcctgaagttgcttacgccacgtttgaggcggctttccggcaaaccctgaatgtgaacgtggtccgcgtgtttttcctcaatcagaagaacgccaaaaatgttctgagaaagacatctcggccgaacgtggaccttacctttggcggggccacattccccatcgtcaataaccactttcctcagttccagagcaatcccgtgcctgataacggactgaccctccatcgcctgtccggctatcttgctagatggtctatggaccaaatgcggacaaatcccattcgccaggccgaatttagagctgccgttgtggtccctctggcggagatcaaagggtgcacctggaacgatggagacgccatgtacctcgctttcgccgctggcgccgaaatgtttctgaatacgttcaccttctttccgctggtgattgagatgcaccgggtgctcaaggatgggatggacgtcaacttcatgcgcaaagttctgagacagcggtatggaacaaagaccgcggagcagtggatgaaggatgaaatcattcccatcaaagccgcttttgaggccgtgggcatgcttagctgggctcgcacaggcttctcccctgccgccagagactttctgcggcaattcgggatcaatgtgtga

SEQ ID NO: 7583 - RNA, 738 nt, synthetic construct
  misc_feature 1..738: note = derived and/or modified CDS sequence (opt5) from HRTV(TN)__KJ740146.1__N
  source 1..738: mol_type = other RNA
atgaccgactggagcgccatcgctgtggagattggcaacgaacccctggatgtccctgccctcgttgagttcgcgaaggaaatcgcttacgaggggctggacccggccgtgattcttggactgctcagagaacggggcggggagaattggcgcaacgatgtgaaatatatcattgtctttgccctgacaagaggaaataagatcgtgaaggcttgcggcaaaatgtccaaaaagggggccgagcggatgacgaaccttgctcgcgtttacgaactgaaggagaatgccgtggacagaatggcggtcacccccgtgcgggttgcccagtgtctccctacatggacctgcgctgccgctgccgcgatcaaagaatatctgcccgtgggacctgccattatgcacaacaagatccaaggctaccccctggagatgatgtgtatggctttcggctctctcattcctcaggccgatgtcagcatcgaggtgattaaagactttatggatgcttattccctgtggcaggacacattcgcccgcaccatcaatgtggatcagagaaagatgacaaaagccgaagtctacgctaagtttcgggacccgcttcatgcggccgttaactctctgttctttcccaatgctacccgcattagctggctccaagccaaggggctgcttacggccaccaaagaggcttccggatctgtgaaggccgcggctgccgcctatagaaacatgtga

SEQ ID NO: 7584 - RNA, 738 nt, synthetic construct
  misc_feature 1..738: note = derived and/or modified CDS sequence (opt5) from HRTV(Patient1)__JX005842.1__N
  source 1..738: mol_type = other RNA
atgaccgactggagcgccatcgctgtggagattggcaacgaacccctggatgtccctgccctcgttgagttcgcgaaggaaatcgcttacgaggggctggacccggccgtgatttttggacttctgagagaacggggcggggagaattggcgcaacgatgtgaaatatatcattgtcttcgccctcacaagaggaaataagatcgtgaaggcttgcggcaaaatgtccaaaaagggggccgagcggatgacgaacctggctcgcgtttacgaacttaaggagaatgccgtggacagaatggcggtcacccccgtgcgggttgcccagtgtctgcctacatggacctgcgctgccgctgccgcgatcaaagaatatctccccgtgggacctgccattatgcacaacaagatccaaggctaccccctggagatgatgtgtatggcttttggctctctgattcctcaggccgatgtcagcatcgaggtgattaaagacttcatggatgcttattccctctggcaggacacatttgcccgcaccatcaatgtggatcagagaaagatgacaaaagccgaagtctacgctaagttccgggacccgctgcatgcggccgttaactctctgtttttccccaatgctacccgcattagctggcttcaagccaaggggctcctgacggccaccaaagaggcttccggatctgtgaaggccgcggctgccgcctatagaaacatgtga

SEQ ID NO: 7585 - RNA, 738 nt, synthetic construct; identical to SEQ ID NO: 7583
  misc_feature 1..738: note = derived and/or modified CDS sequence (opt5) from HRTV(Patient2)__JX005843.1__N
  source 1..738: mol_type = other RNA

SEQ ID NO: 7586 - RNA, 732 nt, synthetic construct
  misc_feature 1..732: note = derived and/or modified CDS sequence (opt5) from PTV(PAN472868)__NC_027202.1__N
  source 1..732: mol_type = other RNA
atgagctacgaggaaatcgccgtgcagttcgcttccgagtctattgacgaacaagccgtcgcgggctgggttaccgattttgcttatcaggggttcgacgccaagagagtgatcgccctggtgaaagatcggggaggcgaggactggaagcaggatgtcaaaaagatgattgtgctcagcctgacacgcgggaacaaacccaataagatggttcttaagatgtccgacaaaggaaaggctatggtgaacgaactggtcctcaaatacaagctgaaatctggcaatcctagcagagatgaccttacgctgtcccggatcaccgccgcttttgccgggtggacatgccaggcggccgattatgtgcaagagtacctcccggttaccggacgcgctatggacgccatttctagctcctatcccagagctatgatgcaccctagcttcgccggcctgatcgatcaggagctgcccgcggacgtgctctctgaaatcacacaggcccattgtctgtttatgattcagttctccaagaccatcaaccctagccttcggggcctgtctaaggatgagattgtctccagctttgaacgccccatgcaagctgccatctcttccacattcctcaccagcgctaatagacgggccatgctgaaaacgcttgggattatcaacgacaatctgaagccttcctctagcaccgtgtccgccgctaaagtgtttcgcagcctctga

SEQ ID NO: 7587 - RNA, 732 nt, synthetic construct
  misc_feature 1..732: note = derived and/or modified CDS sequence (opt5) from PTV(Adames)__KR912210.1__N
  source 1..732: mol_type = other RNA
atgagctacgaggaaatcgccgtgcagttcgcttccgagtctattgacgaacaagccgtcgcgggctgggttaccgattttgcttatcaggggttcgacgccaagagagtgatcgccctggtgaaagagcggggaggcgaagattggaagcaggacgtcaaaaagatgattgtgctcagcctgacacgcgggaacaaacccaataagatggttcttaagatgtccgataaaggaaaggctatggtgaacgagctggtcctcaaatacaagctgaaatctggcaatcctagcagagacgatcttacgctgtcccggatcaccgccgcttttgccgggtggacatgccaggcggccgactatgtgcaagagtacctcccggttaccggacgcgctatggatacaatttctagcggctatcccagagccatgatgcacccttccttcgctggcctgatcgaccaggaactgcccgccgatgtgctcagcgagatcacccaggcgcattgtctgtttatgattcagttctctaagacaatcaacccttcccttcgggggctgagcaaggacgaaattgtctcttcctttgagcgccccatgcaagccgctatcagctctaccttcctcacgtccgccaatagacgggctatgctgaaaacccttggaattatcaacgataatctgaagcctagctcctctacagtgagcgccgccaaagtgtttcgctccctctga

SEQ ID NO: 7588 - RNA, 732 nt, synthetic construct
  misc_feature 1..732: note = derived and/or modified CDS sequence (opt5) from PTV(Balliet)__KR912211.1__N
  source 1..732: mol_type = other RNA
atgagctacgaggaaatcgccgtgcagttcgcttccgagtctattgacgaacaaaccgtcgccggctgggttacagattttgcgtatcaggggttcgacgctaagagagtgatcgccctggtgaaagatcggggaggcgaggactggaagcaggatgtcaaaaagatgattgtgctcagcctgacgcgcgggaacaaacccaataagatgatccttaagatgtccgacaaaggaaaggccatggttaacgaactggtgctcaaatacaagctgaaatctggcaatcctagcagagatgaccttaccctgtcccggattacagctgcctttgctgggtggacctgccaggccgcggattatgtccaagagtacctcccggtgacaggacgcgccatggacgctatctctagctcctatcccagagccatgatgcaccctagcttcgctggcctgatcgatcaggagctgcccgccgacgtgttttctgaaattacccaggcgcattgtctcttcatgatccagttttccaagacaattaaccctagcctgcggggcctttctaaggatgagatcgtttccagcttcgaacgccccatgcaagccgctatttcttccacctttctgacgagcgccaatagacgggctatgctcaaaaccctggggatcattaacgacaatcttaagccttcctctagcacagtctccgccgccaaagtgttccgcagcctgtga

SEQ ID NO: 7589 - RNA, 732 nt, synthetic construct
  misc_feature 1..732: note = derived and/or modified CDS sequence (opt5) from PTV(PaAR2381)__KP272006.1__N
  source 1..732: mol_type = other RNA
atgagctacgaggaaatcgccgtgcagttcgcttccgagtctattgacgaacaagccgtcgcgggctgggttaccgattttgcttatcaggggttcgacgccaagagagtgatcgccctggtgaaagatcggggaggcgacgattggaagcaggacgtcaaaaagatgattgtgctcagcctgacacgcgggaacaaacccaataagatggttcttaagatgtccgataaaggaaaggctatggtgaacgagctggtcctcaaatacaagctgaaatctggcaatcctagcagagacgatcttacgctgtcccggatcaccgccgcttttgccgggtggacatgccaggcggccgactatgtgcaagaatacctcccggttaccggacgcgctatggatgccatttctagctcctatcccagagctatgatgcaccctagcttcgccggcctgatcgaccaggagctgcccgcggatgtgctctctgagatcacacaggcccattgtctgtttatgattcagttctccaagaccatcaaccctagccttcggggcctgtctaaggacgaaattgtctccagctttgagcgccccatgcaagctgccatctcttccacattcctcaccagcgctaatagacgggccatgctgaaaacgcttgggattatcaacgacaatctgaagccttcctctagcaccgtgtccgccgctaaagtgtttcgcagcctctga

SEQ ID NO: 7590 - RNA, 732 nt, synthetic construct
  misc_feature 1..732: note = derived and/or modified CDS sequence (opt5) from PTV(GML902876)__KP272012.1__N
  source 1..732: mol_type = other RNA
atgagctacgaggaaatcgccgtgcagttcgcttccgagtctattgacgaacaagccgtcgcgggctgggttaccgattttgcttatcaggggttcgacgccaagagagtgatcgccctggtgaaagatcggggaggcgacgattggaagcaggacgtcaaaaagatgattgtgctcagcctgacacgcgggaacaaacccaataagatggttcttaagatgtccgataaaggaaaggctatggtgaacgagctggtcctcaaatacaagctgaaatctggcaatcctagcagagacgatcttacgctgtcccggatcaccgccgcttttgccgggtggacatgccaggcggccgactatgtgcaagaatacctcccggttaccggacgcgctatggatgccatttctagctcctatcccagagctatgatgcaccctagcttcgccggcctgatcgaccaggagctgcccgcggatgtgctctctgagatcacacaggcccattgtctgtttatgattcagttctccaagaccatcaaccctagccttcggggcctgtctaaggacgaaattgtctccagctttgagcgccccatgcaagctgccatctcttccacattcctcaccagcgctaatagacgggccatgctgaaaacgcttgggattatcaacgacaatctgaagccttcctctagcaccgcctccgctgcgaaagtgtttcgcagcctctga

SEQ ID NO: 7591 - RNA, 732 nt, synthetic construct
  misc_feature 1..732: note = derived and/or modified CDS sequence (opt5) from PTV(Adames)__KP272030.1__N
  source 1..732: mol_type = other RNA
atgagctacgaggaaatcgccgtgcagttcgcttccgagtctattgacgaacaagccgtcgcgggctgggttacccactttgcttatcaggggttcgatgccaagagagtgatcgccctggtgaaagagcggggaggcgaagactggaagcaggatgtcaaaaagatgattgtgctcagcctgacacgcgggaacaaacccaataagatggttcttaagatgtccgacaaaggaaaggctatggtgaacgagctggtcctcaaatacaagctgaaatctggcaatcctagcagagatgaccttacgctgtcccggatcaccgccgcttttgccgggtggacatgccaggcggccgattatgtgcaagagtacctcccggttaccggacgcgctatggacacaatttctagcggctatcccagagccatgatgcatccttccttcgctggcctgatcgatcaggaactgcccgccgacgtgctcagcgagatcacccaggcgcactgtctgtttatgattcagttctctaagacaatcaacccttcccttcgggggctgagcaaggatgaaattgtctcttcctttgagcgccccatgcaagccgctatcagctctaccttcctcacgtccgccaatagacgggctatgctgaaaacccttggaattatcaacgacaatctgaagcctagctcctctacagtgagcgccgccaaagtgtttcgctccctctga

SEQ ID NO: 7592 - RNA, 735 nt, synthetic construct
  misc_feature 1..735: note = derived and/or modified CDS sequence (opt5) from Phlebovirus(CoAr171616)__HM566153.1__N
  source 1..735: mol_type = other RNA
atgagctacgaggaaatcgccgtgaacttcgcttccgagtctattgacgaaagcaccatctccgcctgggtctctgattttgcgtatcagggcttcgacgctaagagagttattgccctgatcaaagagcgcgggggagaaaattggaaggaggatgtgaaaaagatgattgtgctcagcctgacacggggcaacaaacccgccaagatgatccttaagatgtccgacaaagggaagaaagaggtcaatgatctgatcacgagatacaagctcaaatctggaaaccctagccgggacgatctgaccctttcccgcgtggctgccgcttttgccggctggacatgccaagcggccgaatatgttcaggagtacctgccggtgaccgggagagctatggacgccttcagcgctgattttccccgggccctcatgcacccttctttcgcgggactgattgaccaggaactgccctccagcgccatgacagatatcgtccatgctcactgtctctttatgattcagttctctaagaccatcaatcctacaattcgctccgccagcaaggacgagatcgtggcttcttttgatagacccatgcaagccgccattaactccaccttcctgacgagcgctcagcggcgcgcgatgcttaaaaccctgggcgttatcaatgacaacctcaaggtgtccacagccgtctctagcgctgccaaagcctttaagaaactgcagtga

SEQ ID NO: 7593 - RNA, 735 nt, synthetic construct
  misc_feature 1..735: note = derived and/or modified CDS sequence (opt5) from Phlebovirus(CoAr171616)__EF201836.1__N
  source 1..735: mol_type = other RNA
atgagctacgaggaaatcgccattcacttcgcttccgagtctatcgacgaaagcaccatttccgcctgggtgtctgattttgcgtatcagggcttcgacgctaagagagtcatcgccctgattaaagagcgcgggggagaaaactggaaggaggatgttaaaaagatgatcgtgctcagcctgacacggggcaataaacccgccaagatgatccttaagatgtccgacaaagggaagaaagaggtgaacgatctgattacgagatacaagctcaaatctggaaatcctagccgggacgatctgaccctttcccgcgtcgctgccgcttttgccggctggacatgccaagcggccgaatatgtgcaggagtacctgccggttaccgggagagctatggacgccttcagcgctgattttccccgggccctcatgcatccttctttcgcgggactgatcgaccaggaactgccctccagcgccatgacagatattgtgcacgctcattgtctctttatgatccagttctctaagaccattaaccctacaatccgctccgccagcaaggacgagattgtcgcttcttttgatagacccatgcaagccgccatcaattccaccttcctgacgagcgctcagcggcgcgcgatgcttaaaaccctgggcgtgatcaacgacaatctcaaggtttccacagccgtgtctagcgctgccaaagcctttaagaaactgcagtga

SEQ ID NO: 7594 - RNA, 732 nt, synthetic construct
  misc_feature 1..732: note = derived and/or modified CDS sequence (opt5) from Phlebovirus(CoAr170255)__EF201840.1__N
  source 1..732: mol_type = other RNA
atgagctacgaggaaatcgccattcagttcgcttccgagtctgtggacgccaccacaatcgcggcttgggtcagcgaatttgcctatcaaggcttcgatgccagacaggttattaacctggtgaagcagcgcgggggagacgattggaaagaggacgtgaagaaaatgatcgtcctctccctgacgcggggcaataagccctctaaaatgcttaacaagatgagcgaatccgggcagaagattgtgaatgatctgatctctaaatacaagctcaaaagcggaaaccctggcagaaatgacctgaccctttcccggatcgctgccgcttttgccgggtggacatgccaagcggccgaggttgtgcaggattatctgccggtcaccggacgcgctatggacgccattagcgataagttccccagagctctcatgcacccttcttttgccggcctggtggaccccacactgcctgagggcgttgtggaagatatcgtccatgcgcactgtctcttcatgattcagttttccaaaaccatcaaccccagcctgcggtcttccagcaagtctgaggtggtgtccagcttcgaccgccctatgcaggccgctattaattccccgtttcttacagccgggaacagacgggatatcctgatgtctctcggactgattaatagcaaccttaagccctcccctgctgtcatcgccgccgctaaagtttaccgcaagctgtga

SEQ ID NO: 7595 - RNA, 732 nt, synthetic construct
  misc_feature 1..732: note = derived and/or modified CDS sequence (opt5) from Buenaventura virus(CoAr3319)__KP272003.1__N
  source 1..732: mol_type = other RNA
atgagctacgaggaaatcgccattcagttcgcttccgagtctgtggacgccaccacaatcgcggcttgggtcagcgaatttgcctatcaaggcttcgatgccagacaggttattaacctggtgaagcagcgcgggggagacgattggaaagaggacgtgaagaaaatgatcgtcctctccctgacgcggggcaataagccctctaaaatgcttaacaagatgagcgaatccgggcagaagattgtgaatgatctgatctctaaatacaagctcaaaagcggaaaccctggcagaaatgacctgaccctttcccggatcgctgccgcttttgccgggtggacatgccaagcggccgaggttgtgcaggattatctgccggtcaccggacgcgctatggacgccattagcgataagttccccagagctctcatgcacccttcttttgccggcctggtggaccccacactgcctgagggcgttgtggaagatatcgtccatgcgcactgtctcttcatgattcagttttccaaaaccatcaaccccagcctgcggtcttccagcaagtctgaggtggtgtccagcttcgaccgccctatgcaggccgctattaattccccgtttcttacagccgggaacagacgggatatcctgatgtctctcggactgattaatagcaaccttaagccctcccctaccgtcgttgctgccgccaaagtgtaccgcaagctgtga

SEQ ID NO: 7596 - RNA, 732 nt, synthetic construct
  misc_feature 1..732: note = derived and/or modified CDS sequence (opt5) from Cocle virus(GML244915)__KP272035.1__N
  source 1..732: mol_type = other RNA
atgagctacgaggaaatcgccgtgcagttcgcttccgagtctattgacgaacaagccgtcgcgggctgggttaccgattttgcttatcaggggttcgacgccagacgggtgatcgccctggtgaaggatcgcggaggcgaggactggaaacaggatgtcaagaaaatgattgtgctcagcctgacaagagggaacaagcccaataaaatggttcttaagatgtccgacaagggaaaagctatggtgaacgaactggtcctcaagtacaaactgaagtctggcaatcctagccgggatgaccttacgctgtcccgcatcaccgccgcttttgccgggtggacatgccaggcggccgattatgtgcaagagtacctcccggttaccggcagagctatggacgccatttctagcggatatccccgggctatgatgcacccttccttcgccggcctgatcgatcaggagctgcccgcggacgtgctcagcgaaatcacacaggcccattgtctgtttatgattcagttctctaaaaccatcaacccttcccttcgcgggctgggaaaggatgagattgtcagctcttttgaaagacccatgcaagctgccatctccagcacattcctcacctctgctaatcggcgcgccatgctgaagacgcttggcattatcaacgacaatctgaaaccttccagctccaccgtgtctgccgctaaggtgtttagaagcctctga

SEQ ID NO: 7597 - RNA, 732 nt, synthetic construct
  misc_feature 1..732: note = derived and/or modified CDS sequence (opt5) from Capira virus(VP-366G)__KP272044.1__N
  source 1..732: mol_type = other RNA
atgagctacgaggaaatcgccattcagttcgcttccgagtctatcgacgaaagcaccattgccgcgtgggtgtccgattttgcttatcaaggcttcgacgccaagcaggtcatcattctgatcaagaagagagggggagagaactggaaagaagatgttaagaaaatgatcgtgctctctctgacacggggcaataagcccagcaagatggtgaacaaaatgtccgacgaggggaagaaagtcgtgaatgagcttatttctaagtacaaactgaagacgggaaaccctgcccgcgatgacctcaccctgagcagaatcgctgccgcttttgccggctggacatgccaggcggccgaatatgttcaggattaccttccggtgaccgggcgggctatggacgccctgtccgataagtatccccgcgctctcatgcaccctagcttcgccggactgattgaccccacactgcctgatgacgcggtcaaagatatcgtgcatgcccactgtctctttatgattcaattctctaagaccatcaatccctccctgagaagctctacaaaaaccgagattgttaactcctttgaccggcctatgcaggctgccatcaatagcccgttccttacggctgaaaaccgcagagccatgctgaccacactcggcgtgatcaattctaacctgaagccctccgccgctgtcgtggcggccgctaaagcctaccggaaactttga

SEQ ID NO: 7598 - RNA, 732 nt, synthetic construct
  misc_feature 1..732: note = derived and/or modified CDS sequence (opt5) from Campana virus(VP-334K)__KP272042.1__N
  source 1..732: mol_type = other RNA
atgagctacgaggaaatcgccattcagttcgcttccgagtctgtggacgccaccacaatcgcggcttgggtcagcgaatttgcctatcaaggcttcgatgccagacaggttattaacctggtgaagcagcggggaggagacgattggaaagaggacgtgaagaaaatgatcgtcctctccctgacgcgcggcaataagccctctagaatggtgaccaaaatgagcgaatccgggcagaagattgttaacgatcttatctctaagtacaaactgaagtctggaaatcctggccggaacgacctcacactgtcccgcgtggctgccgcttttgccgggtggacctgccaagcggccgaggtcgtgcaggattatcttccggttacagggagagctatggacgccctgagcgataaattcccccgggctatcatgcacccttcttttgccggcctcattgaccccaccctgcctgagaatgtggtcgaagatatcgtgcatgcgcactgtctgttcatgattcagttttccaagacaatcaaccccagcctccgcagctccagcaaatctgaggtggtctccagcttcgacagacctatgcaggccgctattaattccccgtttctgaccgccgctaaccggcgcgatatgcttatgtctctgggcctcatcagctccaatctgaagcccagcgccgccgttacggctgcggccaaggcttacagaaaactttga

SEQ ID NO: 7599 - RNA, 738 nt, synthetic construct
  misc_feature 1..738: note = derived and/or modified CDS sequence (opt5) from RVFV(ZH-548)__DQ380151.1__N
  source 1..738: mol_type = other RNA
atggacaactaccaagagctggccatccaattcgctgcccaggcggtggatagaaatgaaattgagcagtgggtccgggaatttgcttatcagggcttcgacgcccgcagagttatcgagctcctgaagcaatacgggggagccgattgggaaaaagacgctaagaaaatgattgtgcttgccctgacccggggcaacaagccccgcagaatgatgatgaaaatgagcaaggaggggaaggctacagtggaggccctcatcaataaatataagctgaaagaaggaaacccttcccgggatgagcttacgctgtctcgcgtcgcggccgctctcgccggctggacctgccaggctctggtggttctgagcgaatggctcccggtgacagggaccacaatggacggactgtcccccgcctaccctagacacatgatgcatccctcttttgcgggcatggtcgatcctagccttcccggcgactatctgcgggccattctcgatgctcactccctgtaccttctgcagttctctcgcgtgatcaatcctaacctcagagggcggaccaaggaggaggttgccgctacatttacccagccgatgaatgccgccgtgaacagcaatttcatctcccatgaaaaacgcagagagtttctgaaggctttcggactggtcgacagcaacggcaagccctctgcggccgtgatggctgccgcccaggcttataaaacggccgcgtga

SEQ ID NO: 7600 - RNA, 738 nt, synthetic construct
  misc_feature 1..738: note = derived and/or modified CDS sequence (opt5) from RVFV(OV 35/74)__EF530207.1__N
  source 1..738: mol_type = other RNA
atggacaactaccaagagctggccatccaattcgctgcccaggcggtggatagaaatgaaattgagcagtgggtccgggaatttgcttatcagggcttcgacgcccgcagagttatcgagctcctgaagcaatacgggggagccgattgggaaaaagacgctaagaaaatgattgtgcttgccctgacccggggcaacaagccccgcagaatgatgatgaaaatgagcaaggaggggaaggctacagtggaggccctcatcaataaatataagctgaaagaaggaaacccttcccgggatgagcttacgctgtctcgcgtcgcggccgctctcgccggctggacctgccaggctctggtggttctgagcgaatggctcccggtgacagggaccacaatggacggactgtcccccgcctaccctagacacatgatgcatccctcttttgcgggcatggtcgatcctagccttcccgaggactatctgcgggccattctcgatgctcactccctgtaccttctgcagttctctcgcgtgatcaatcctaacctcagaggccggaccaaggaggaagttgccgctacatttacccagccgatgaatgccgccgtgaacagcaatttcatctcccatgagaaacgcagagaatttctgaaggctttcgggctggtcgacagcaacggaaagccctctgcggccgtgatggctgccgcccaggcttataaaacggccgcgtga

SEQ ID NO: 7601 - RNA, 762 nt, synthetic construct
  misc_feature 1..762: note = derived and/or modified CDS sequence (opt5) from SFNV(Toscana)__NC_006318.1__N
  source 1..762: mol_type = other RNA
atgagcgacgagaactacagagatatcgccctggctttcctcgacgaatccgccgattctggcaccattaatgcgtgggtgaacgagtttgcttatcaggggttcgaccccaagcggatcgtccaactggttaaagaacgcggaacagccaagggcagagattggaaaaaggacgtgaaaatgatgattgtgcttaatctggtccgggggaacaagcctgaggccatgatgaagaaaatgagcgaaaagggagcttccatcgtggccaatctcatttctgtttaccagctgaaagagggcaacccggggcgcgatacgatcacccttagcagagtgtccgctgcctttgtcccctggacagtgcaggcgctgcgggttctctctgagagcctgcctgtgtccggaaccacaatggacgccatcgctggcgtcacctatccccgcgccatgatgcaccctagcttcgctggcattatcgatctggacctccccaatggggccggagcgacaattgccgatgctcatggcctgtttatgatcgagttctctaagaccattaacccttcccttagaacgaaacaggccaatgaagtggctgccacctttgaaaagccgaacatggccgctatgagcgggcggttctttacacgcgaggacaagaaaaagctgctcatcgcggtgggaattatcgatgaggacctggtccttgcctctgctgttgtgagatccgccgaaaaataccgggccaaggtgggcaaatga

SEQ ID NO: 7602 - RNA, 762 nt, synthetic construct
  misc_feature 1..762: note = derived and/or modified CDS sequence (opt5) from SFNV__HM566170.1__N
  source 1..762: mol_type = other RNA
atgagcgaggaaaactacagagagatcgccctggctttcctcgacgaagccgcggattccggcacaattacagcttgggtgaatgagtttgcctatcaggggttcgaccccaagcggatcgtccaactggttaaagaacgcggaacggccaagggcagagattggaaaaaggacgtgaaaatgatgattgtgcttaacctggtccgggggaataagcctgaggctatgatgaagaaaatgtctgagaagggagccggcatcgtggctcagctcattagcgtttaccagctgaaagaagggaacccgggacgcgataccatcacactttccagagtgtctgccgcgtttgtcccctggaccatccaggccctgcgggtgctcagcgactccctgcctgttacaggcaccacaatggatgctattgccggcgtgacctatccccgcgctatgatgcacccttctttcgccgggatcattgacctggatctccccaatagagcgggagaggtcatcgccgacgctcatggcctgtttatgcttgagttcagcaagacgattaacccttccctgcggaccaaacaaccgaatgaaatcgccgctacatttgagaagcccaacatggccgccatgagcgggcgcttctttaccagagaagataagaaaaagctcctgatggctgtgggcattcttaatgaggacctggtgctcacccctgcgatcgtcaaatgcgccgaaaagtactgttctaaagttggaaagtga

SEQ ID NO: 7603 - RNA, 735 nt, synthetic construct; identical to SEQ ID NO: 7592
  misc_feature 1..735: note = derived and/or modified CDS sequence (opt5) from SFNV(Namru)__HM566168.1__N
  source 1..735: mol_type = other RNA

SEQ ID NO: 7604 - RNA, 762 nt, synthetic construct
  misc_feature 1..762: note = derived and/or modified CDS sequence (opt5) from SFNV(NAMRU 840055)__EF201828.1__N
  source 1..762: mol_type = other RNA
atgagcgaggaaaactacagagagatcgccctggctttcctcgacgaagccgcggattccggcaccattacagcttgggtgaatgagtttgcctatcaggggttcgaccccaagcggatcgtccaactggttaaagaacgcggaacggccaagggcagagattggaaaaaggacgtgaaaatgatgattgtgcttaacctggtccgggggaataagcctgaggctatgatgaagaaaatgtctgagaagggagccggcatcgtggctcagctcattagcgtttaccagctgcgcgaagggaacccgggaagagataccatcacactttcccgggtgtctgccgcgtttgtcccctggaccatccaggccctgaaagtgctcagcgactccctgcctgttacaggcaccacaatggatgctattgccggcgtggtctatccccgcgctatgatgcacccttctttcgccgggatcattgacctggatctccccaatagagcgggagaggccatcgctgacgcccatggcctgtttatgcttgagttcagcaagaccattaacccttccctgcggacgaaacaaccgaatgaaatcgctgccacctttgagaagcccaacatggccgctatgagcgggcgcttctttacaagagaagataagaaaaagctcctgatggcggtgggcattcttaatgaggacctggtgctcacccctgccatcgtcaaatgcgctgaaaagtaccggtctaaagttggaaagtga

SEQ ID NO: 7605 - RNA, 762 nt, synthetic construct
  misc_feature 1..762: note = derived and/or modified CDS sequence (opt5) from SFNV(NAMRU 840055)__EF201829.1__N
  source 1..762: mol_type = other RNA
atgagcgaggaaaactacagagagatcgccctggctttcctcgacgaagccgcggattccggcacaattacagcttgggtgaatgagtttgcctatcaggggttcgaccccaagcggatcgtccaactggttaaagaacgcggaacggccaagggcagagattggaaaaaggacgtgaaaatgatgattgtgcttaacctggtccgggggaataagcctgaggctatgatgaagaaaatgtctgagaagggagccggcatcgtggctcagctcattagcgtttaccagctgaaagaagggaacccgggacgcgataccatcacactttccagagtgtctgccgcgtttgtcccctggaccatccaggccctgcgggtgctcagcgactccctgcctgttacaggcaccacaatggatgctattgccggcgtgacctatccccgcgctatgatgcacccttctttcgccgggatcattgacctggatctccccaatagagcgggagaggccatcgctgacgcccatggcctgtttatgcttgagttcagcaagacgattaacccttccctgcggaccaaacaaccgaatgaaatcgctgccacatttgagaagcccaacatggccgctatgagcgggcgcttctttaccagagaagataagaaaaagctcctgatggcggtcggcattcttaatgaggacctggtgctcacccctgccatcgtgaaatgcgctgaaaagtactgttctaaagtcggaaagtga

SEQ ID NO: 7606 - RNA, 762 nt, synthetic construct
  misc_feature 1..762: note = derived and/or modified CDS sequence (opt5) from SFNV(P-7101795)__EF201830.1__N
  source 1..762: mol_type = other RNA
atgagcgaggaaaactacagagagatcgccctggctttcctcaatgaagccgcggactccggcaccattacagcttgggtgaacgagtttgcctatcaggggttcgatcccaagcggatcgtccaactggttaaagaacgcggaacggccaagggcagagactggaaaaaggatgtgaaaatgatgattgtgcttaatctggtccgggggaacaagcctgagaccatgatgaagaaaatgtctgagaagggagctggcatcgtggcccagctcattagcgtttaccagctgaaagaagggaatccgggacgcgacacaatcaccctttccagagtgtctgctgcctttgtcccctggacagtgcaggcgctgcgggttctcagcgattccctgcctgtgaccggcacaaccatggacgccatcgctggcgtcacgtatccccgcgccatgatgcacccttctttcgctgggattatcgatctggacctccccaacagagccggagagaccattgcggatgcccatggcctgtttatgcttgagttcagcaagacaatcaatccttccctgcggaccaaacaaccgaacgaaattgctgccacatttgagaagcccaatatggctgccatgagcgggcgcttctttaccagagaagacaagaaaaagctcctgatggccgtgggagtgcttaacgaggatctggtcctcacgcctgctatcgttaaatgcgcggaaaagtaccggtctaaagtgggcaagtga

SEQ ID NO: 7607 - RNA, 762 nt, synthetic construct
  misc_feature 1..762: note = derived and/or modified CDS sequence (opt5) from SFNV(P-7101795)__EF201832.1__N
  source 1..762: mol_type = other RNA
atgagcgaggaaaactacagagagatcgccctggctttcctcgacgaagccgcggattccggcaccattacagcttgggtgaatgagtttgcctatcaggggttcgaccccaagcggatcgtccaactggttaaagaacgcggaacggccaagggcagagattggaaaaaggacgtgaaaatgatgattgtgcttaacctggtccgggggaataagcctgaggctatgatgaagaaaatgtctgagaagggagccggcatcgtggctcagctcattagcgtttaccagctgcgcgaagggaacccgggaagagataccatcacactttcccgggtgtctgccgcgtttgtcccctggaccatccaggccctgaaagtgctcagcgactccctgcctgttacaggcaccacaatggatgctattgccggcgtgatgtatccccgcgctatgatgcacccttctttcgccgggatcattgacctggatctccccaatagagcgggagaggccatcgctgacgcccatggcctgtttatgcttgagttcagcaagaccattaacccttccctgcggacgaaacaaccgaatgaaatcgctgccacctttgagaagcccaacatggccgctatgagcgggcgcttctttacaagagaagataagaaaaagctcctgatggcggtcggcattcttaatgaggacctggtgctcacccctgccatcatcaaatgcgctgaaaagtaccggtctaaagtgggaaagtga

SEQ ID NO: 7608 - RNA, 762 nt, synthetic construct
  misc_feature 1..762: note = derived and/or modified CDS sequence (opt5) from Arrabida virus(PoSFPhlebV/126/2008)__KP863801.1__N
  source 1..762: mol_type = other RNA
atgagcgaggacaactacagaaccatcgccctggctttcctcgatgaatccgccgactctacaacgattaatgcgtgggtgaacgagtttgcttatcagggcttcgatcccaagcggatcgtccaactggttaaagaacgcgggaccgccaagggaagagactggaaaaaggatgtgaaaatgatgattgtgcttaatctggtccggggcaacaagcctgagagcatgatgaagaaaatgtccgaaaagggggccgctatcgtgacacagctcatttctacctaccagctgaaagagggaaatccgggccgcgacacaatcacccttagcagagtttccgccgcttttgtgccctggacagtccaggccctgaagaccctctctgagagcctgcctgtgacggggaccacaatggattccatcgcgggaaccacatatccccggtgcatgatgcaccctagcttcgccggcattatcgacctggaactccccaacaataccggcgctatgctggccgatgctcatgggctttttatgctggagttctctaaaacgattaacccttccctccgcacaaagcaaccgaatgaaatcgccgcgacctttgagaagcccaacatggccgctatgacaggaagattctttacccgggacgataaaaagaaactgcttattgccatcggcgttctggacgaggatctcgtgcctaatcccgctattgaaaagtgtgccgagaaatacaaggccaaagtcgggaagtga

SEQ ID NO: 7609 - RNA, 765 nt, synthetic construct
  misc_feature 1..765: note = derived and/or modified CDS sequence (opt5) from Gordil virus(Dak ANBr 496d)__KF297902.1__N
  source 1..765: mol_type = other RNA
atgagcgaggaaaactacagagagatcgccatggctttcgccaatgactccgcggattttaacatgatttctgtgtgggctaatgacttcgcctatcagggctttgatcccaagcggatcgtcgaactggttcgccaaagagggctcgccaaagctcggaactggaagcaggacgtgaaaatgatgattgtgctgaatcttatgcgcggaaacaagcctgaggccatggtcagaaaaatgcaggaaaagggccagcggatcgtgctggagctcattagcgtttacgagctgaaggaagggaatccgggacgcgataccatcacactttccagagtgtctgctgccttcgtcccctggacgatcatggcgctgcggcaactcgccgagaacattcctgtgaccggcagcatcatggactccattctggatggggctgtttatccccgcgccatgatgcacccttcttttgctggaatcattgacctggaactccccgagggcagaggcgccgagctggcggatgcccatgggcttttcatgatcgaatttagcaaaacaattaatccttccctgcggaccaagagcgctatcgagatcgccgcttctttcgaaaaaccgaacatggccgccatgacaggaaactttttcaccaaggacgataaacgcaagctcctgaagcagattggcatccttgactccgatctgaaactcacacccgtgattgagaaggctgcggccctgtacagaagcaaaaccaataagtga

SEQ ID NO: 7610 - RNA, 762 nt, synthetic construct
  misc_feature 1..762: note = derived and/or modified CDS sequence (opt5) from Granada virus(GR25)__GU135608.1__N
  source 1..762: mol_type = other RNA
atgagcgaggacaactacagaaccatcgccctggctttcctcgatgaatccgccgactctacaacgattaatgcgtgggtgaacgagtttgcttatcagggcttcgatcccaagcggatcgtccaactggttaaagaacgcgggaccgccaagggaagagactggaaaaaggatgtgaaaatgatgattgtgcttaatctggtccggggcaacaagcctgagagcatgatgaagaaaatgtccgaaaagggggccgctatcgtgacacagctcatttctacctaccagctgaaagagggaaatccgggccgcgacacaatcacccttagcagagtttccgccgcttttgtgccctggacagtccaggccctgaagaccctctctgagagcctgcctgtgacggggaccacaatggattccatcgcgggaaccacatatccccggtgcatgatgcaccctagcttcgccggcattatcgacctggaactccccaacaataccggcgctatgctggccgatgctcatgggctttttatgctggagttctctaaaacgattaacccttccctccgcacaaagcaaccgaatgaaatcgccgcgacctttgagaagcccaacatggccgctatgacaggaagattctttacccgggacgataaaaagaaactgcttattgccatcggcgttctgaatgaggacctcgtgcctaaccccgctattgaaaagtgtgccgagaaatacaaggccaaagtcgggaagtga

SEQ ID NO: 7611 - RNA, 762 nt, synthetic construct
  misc_feature 1..762: note = derived and/or modified CDS sequence (opt5) from Massilia virus(127)__KT906102.1__N
  source 1..762: mol_type = other RNA
atgagcgaggacaactacagaaccatcgccctgtccttcctcgatgaaacagctgtgtctacgagcattaatgcctgcgtcaacgagtttgcgtatcagggcttcgaccccaagcggatcgttcaactggtgaaagaacgcgggaccgctaagggaagagattggaaaaaggacgtgaaaatgatgattgtccttaatctggtgcggggcaacaagcctgagtccatgatgaagaaaatgtctgaaaagggggccgccatcgttacacagctcattagcacctaccagctgaaagagggaaatccgggccgcgatacaatcaccctttccagagtgtctgctgcctttgtcccctggacagtgcaggctctgaagaccctcagcgagtccctgcctgttacggggaccacaatggacagcatcgccggaaccacatatccccggtgtatgatgcacccttctttcgcgggcattatcgatctggaactccccaacaataccggcgccatgctggctgacgcccatgggctttttatgctggagttctccaaaacgattaaccctagcctccgcacaaagcaaccgaatgaaatcgctgccacctttgagaagcccaacatggcggccatgacaggaagattctttacccgggatgacaaaaagaaactgcttattgctatcggcgtgctggatgaggacctcgtccctaatcccgccattgaaaagtgcgctgagaaatacaaggccaaagtggggaagtga

SEQ ID NO: 7612 - RNA, 762 nt, synthetic construct
  misc_feature 1..762: note = derived and/or modified CDS sequence (opt5) from Massilia virus(130)__KT906103.1__N
  source 1..762: mol_type = other RNA
atgagcgaggacaactacagaaccatcgccctgtccttcctcgatgaaacagctgactctacgagcattaatgcctgcgtgaacgagtttgcgtatcagggcttcgatcccaagcggatcgtccaactggttaaagaacgcgggaccgctaagggaagagactggaaaaaggatgtgaaaatgatgattgtgcttaatctggtccggggcaacaagcctgagtccatgatgaagaaaatgtctgaaaagggggccgccatcgtgacacagctcattagcacctaccagctgaaagagggaaatccgggccgcgacacaatcaccctttccagagtttctgctgcctttgtgccctggacagtccaggctctgaagaccctcagcgagtccctgcctgtgacggggaccacaatggatagcatcgccggaaccacatatccccggtgtatgatgcacccttctttcgcgggcattatcgacctggaactccccaacaataccggcgccatgctggctgatgcccatgggctttttatgctggagttctccaaaacgattaaccctagcctccgcacaaagcaaccgaatgaaatcgctgccacctttgagaagcccaacatggcggccatgacaggaagattctttacccgggacgataaaaagaaactgcttattgctatcggcgttctggacgaggatctcgtgcctaatcccgccattgaaaagtgcgctgagaaatacaaggccaaagtcgggaagtga

SEQ ID NO: 7613 - RNA, 762 nt, synthetic construct
  misc_feature 1..762: note = derived and/or modified CDS sequence (opt5) from Naples virus(Yu 8/76)__JF920141.1__N
  source 1..762: mol_type = other RNA
atgagcgaggacgattaccacaagatcgccctggctttcgccgaagagtccgcggacgtgtctaccattgaaagctgggtcaacgattttgcttatcagggcttcgaccccagacggatcgttcaactcgtgaaagagcgcgggacagccaagggaagagattggaaaaaggacgtgaaaatgatgattgtcctgaatcttgtgcggggcaacaagcctgaagccatgatgaagaaaatgtccgagaagggggctgccatcgttgctcagctgatttctgtgtaccagctcaaagagggaaatccgggccgcgatacgatcaccctgagcagagtctccgccgcgtttgtgccctggacagttcaggcccttcgggtgctgtctgaccatctccctgtcaccgggacaaccatggatgctatcgccggagtgacatatccccgcgctatgatgcaccctagcttcgccggcattgtggacctggaactgcccagaaagaccggcgagatgatcgcggatgcccatgggctctttatgctggagttctccaaaacgattaaccctagccttcggaccaagcaaccgaatgaaatcgctacaacctttgagaagcccaacatggccgctatgtctggaaaattcttttcccgcgaagacaagaaaaagctgctcatgagcgtcggcattatcaatgatgacctgcttctgacagcctctgttgtgaaatgcgccgagaagtacagagctaaaaccgggaagtga

SEQ ID NO: 7614 - RNA, 762 nt, synthetic construct
  misc_feature 1..762: note = derived and/or modified CDS sequence (opt5) from Punique virus(P1_B4_2008)__FJ848987.1__N
  source 1..762: mol_type = other RNA
atgagcgaggaaaactacagagagatcgccctggctttcctcgacgaatccgccgattctggcaccattagcacatgggtgaatgactttgcgtatcaggggttcgatcccaagcggatcgtccaactggttaaagagcgcggaacggctaagggcagagactggaaaaaggatgtgaaaatgatgattgtgcttaacctggtccgggggaataagcctgaatccatgatgaagaaaatgtctgagaagggagccgccatcgtggctcagctcattgccgcttaccagctgaaagagggcaacccggggcgcgacaccatcacacttagcagagtttccgccgcgtttgtgccctggaccgtccaggccctgcggtctctcagcgattccctgcctgtgacaggaaccacaatggacagcatcgctggcgttacctatccccgctgcatgatgcacccttctttcgccggcattatcgatctggacctccccaatgatacgggggctatgctggccgacgcgcatggactttttatgctggagttctccaagaccattaaccctagcctcagaacaaaacaagccaatgaaatcgctgccacctttgaaaagccgaacatggctgccatgaatggccggttctttacacgcgaggataagaaaaagctgcttattgccatcggggtgctgaacgaggacctcattcccgtctctgctatcgcgaaatgtgccgaaaagtacagagctaaagtgggaaagtga

SEQ ID NO: 7615 - RNA, 762 nt, synthetic construct
  misc_feature 1..762: note = derived and/or modified CDS sequence (opt5) from Saint Floris virus(Dak ANB512)__JF920138.1__N
  source 1..762: mol_type = other RNA
atgagcgaggaaacctacgcccagctggctatggccttcctcgcggagcccgctgactggtccacactgtctgtgtgggtcaacgaatttgcctatcaaggcttcgatcctaagagaatcgttgagcttattatggaacgggggaaaaagtttaatcgcgagtggaaaaaggacgtgaaaatgatgatcacgctgaacctcattagaggaaataagccggaggccatgatgcggaagatgagcgataaaggccgctccatcgtgtctgaactgattagcgtctacgagcttaaggaagggaaccccggaagagacaccatcacactgtcccgggtgtctgctgccttcgttccttggaccgtgcgcgctctcgtcgccctgcagaatgatctgcccgtgacaggcgcggccatggacagcatctgcggggttacctatcctagagctatgatgcacccctcctttgccggagtgattgatctcgagctgcctaacggcgtcggcgctcagcttgccgacgcgcatgggctgttcatgctcgagtttagcaaaacaatcaatccgggactgcggaccaagcagcccaacgaaattgccgctacgttcgagaaacctaatcttgccgctatgaccggcaagtttttcacaaaggaagataaacgcaaggtgctgatctctgtgggggtcattaactccgacctccaacccaatagcgttgtgaaaacctgtgccgagctgtacagagcccgggtgatgaagtga

SEQ ID NO: 7616 - RNA, 762 nt, synthetic construct
  misc_feature 1..762: note = derived and/or modified CDS sequence (opt5) from Tehran virus(I-47)__JF939848.1__N
  source 1..762: mol_type = other RNA
atgagcgaggaagactacagagccatcgctctgtccttctctgatgagagcgccgacgtgggcattatcaccacatgggtcaacgaatttgcgtatcaggggttcgatcccaagcggattgttcaactcgtgaaagagcgcggacaggctaagggcagagactggaaaaaggatgtgaaaatgatgatcgtcctgaatcttattcgggggaacaagcctgacgccatgatgaagaaaatgtccgaaaagggagccgctacggtggcccagctggtttctgtgtaccagctcaaagagggcaatccggggcgcgataccatcacactgagcagagtctccgctgcctttgtgccctggaccgttcaagcgcttaaggtgctgtctgagagcctccctgtcacaggaaccacaatggacaccgtggccggcgtgacgtatccccgggctatgatgcacccttccttcgccggcatcattgatctggaactgcccgggcgcgctggagaggccatcgcggacgcccatggcctctttatgctggagttcagcaaaaccattaacccttctcttagaacaaagcagccgaatgaaatcgctgccacctttgagaagcccaacatggctgccatgacagggcggttctttacccgcgaagataaaaagaaactgctcattgccgtcggaatcattaatgacgatctgcttctgacgccttccatcgctaagtgcgcggagaaatacagagccaaggttggcaaatga

SEQ ID NO: 7617 - RNA, 762 nt, synthetic construct
  misc_feature 1..762: note = derived and/or modified CDS sequence (opt5) from Zerdali virus(37)__KP966618.1__N
  source 1..762: mol_type = other RNA
atgagcgaggaagactacagagccatcgctctgtccttctctgatgaggccgcggacgtgggcaccattacagcttgggtcaacgaatttgcctatcaggggttcgatcccaagcggatcgttcaactcgtgcgcgagagaggaattgccaaaggccgggactggaagaaagatgtgaagatgatgatcgtcctgaatcttattcgcgggaacaaacctgacgctatgatgaagaagatgagcgaaaaaggagccgctacggtggcccagctggtttccgtgtaccagctcaaggagggcaatccggggagagataccatcacaccctctcgggtcagcgcggcctttgtgccttggaccgttcaggctctgaaagtgctttccgagtctctgcccgtcacaggaaccacaatggacaccatcgccggcgtgagctatcctcgcgctatgatgcacccctccttcgccggcattatcgatctcgaactgcctagacgggcgggggaggtgattgccgacgctcatggactgtttatgctcgagttcagcaagacgatcaacccgtctctgcgcaccaaacaacccaatgaaattgccgctacatttgagaagcctaacatggccgccatgaccggcagattctttacacgggaagataagaaaaagctgcttatcgctgtcgggattatcaatgacgatctcctgcttgcgccctccgttgccaaatgcgctgagaagtaccgcgccaaagtgggaaagtga

SEQ ID NO: 7618 - RNA, 762 nt, synthetic construct; identical to SEQ ID NO: 7601
  misc_feature 1..762: note = derived and/or modified CDS sequence (opt5) from TOSV(9028)__KU904263.1__N
  source 1..762: mol_type = other RNA

SEQ ID NO: 7619 - RNA, 762 nt, synthetic construct
  misc_feature 1..762: note = derived and/or modified CDS sequence (opt5) from TOSV(SI-121283)__JF330274.1__N
  source 1..762: mol_type = other RNA
atgagcgacgagaactacagagatatcgccctggctttcctcgacgaatccgccgattctggcaccattaatgcgtgggtgaacgagtttgcttatcaggggttcgaccccaagcggatcgtccaactggttaaagaacgcggaacagccaagggcagagattggaaaaaggacgtgaaaatgatgattgtgcttaatctggtccgggggaacaagcctgaggccatgatgaagaaaatgagcgaaaagggagcttccatcgtggccaatctcatttctgtttaccagctgaaagagggcaacccggggcgcgatacgatcacccttagcagagtgtccgctgcctttgtcccctggacagtgcaggcgctgcgggttctctctgagagcctgcctgtgtccggaaccacaatggacgccatcgctggcgtcacctatccccgcgccatgatgcaccctagcttcgctggcattatcgatctggacctccccaatggggccggagcgacaattgccgatgctcatggcctgtttatgatcgagttctctaagaccattaacccttcccttagaacgaaacaggccaatgaagtggctgccacctttgaaaacccgaatatggccgctatgagcgggcggttctttacacgcgaggacaagaagaaactgctcatcgcggtgggaattatcgatgaggacctggtccttgcctctgctgttgtgagatccgccgaaaagtaccgggccaaagtgggcaagtga

SEQ ID NO: 7620 - RNA, 762 nt, synthetic construct
  misc_feature 1..762: note = derived and/or modified CDS sequence (opt5) from TOSV(5963930705)__KU935733.1__N
  source 1..762: mol_type = other RNA
atgagcgacgagaactacagagatatcgccctggctttcctcgacgaatccgccgattctggcaccattaatgcgtgggtgaacgagtttgcttatcaggggttcgaccccaagcggatcgtccaactggttaaagaacgcggaacagccaagggcagagattggaaaaaggacgtgaaaatgatgattgtgcttaatctggtccgggggaacaagcctgaggccatgatgaagaaaatgagcgaaaagggagcttccatcgtggccaatctcatttctgtttaccagctgaaagagggcaacccggggcgcgatacgatcacccttagcagagtgtccgctgcctttgtcccctggacagtgcaggcgctgcgggttctctctgagagcctgcctgtgtccggaaccacaatggacgccatcgctggcgtcacctatccccgcgccatgatgcaccctagcttcgctggcattatcgatctggacctccccaatggggccggagcgacaattgccgatgctcatggcctgtttatggtggagttctctaagaccatcaacccttcccttagaacgaaacaggccaatgaagtggctgccacctttgaaaagccgaacatggccgctatgagcgggcggttctttacacgcgaggacaagaaaaagctgctcattgcggtcggaatcattgatgaggacctggttcttgcctctgctgtggtgagatccgccgaaaaataccgggccaaggtcggcaaatga

SEQ ID NO: 7621 - RNA, 762 nt, synthetic construct
  misc_feature 1..762: note = derived and/or modified CDS sequence (opt5) from TOSV(MRS2010-4319501)__KC776214.1__N
  source 1..762: mol_type = other RNA
atgagcgacgagaactacagagatatcgccctggctttcctcgacgaatccgccgattctggcaccattaatgcgtgggtgaacgagtttgcttatcaggggttcgaccccaagcggatcgtccaactggttaaagaacgcggaacagccaagggcagagattggaaaaaggacgtgaaaatgatgattgtgcttaatctggtccgggggaacaagcctgaggccatgatgaagaaaatgagcgaaaagggagcttccatcgtggccaatctcatttctgtttaccagctgaaagagggcaacccggggcgcgatacgatcacccttagcagagtgtccgctgcctttgtcccctggacagtgcaggcgctgcgggttctctctgagagcctgcctgtgtccggaaccacaatggacgccatcgctggcgtcacctatccccgcgccatgatgcaccctagcttcgctggcattatcgatctgcatctccccaatggggccggagcgacaattgccgacgctcacggcctgtttatgatcgagttctctaagaccattaacccttcccttagaacgaaacaggccaatgaagtggctgccacctttgaaaagccgaacatggccgctatgagcgggcggttctttacacgcgaggataagaaaaagctgctcatcgcggtgggaattatcgacgaggatctggtccttgcctctgctgttgtgagatccgccgaaaaataccgggccaaggtgggcaaatga

SEQ ID NO: 7622 - RNA, 762 nt, synthetic construct
  misc_feature 1..762: note = derived and/or modified CDS sequence (opt5) from TOSV(TOSV/Firenze.ITA/1983/2)__KM275765.1__N
  source 1..762: mol_type = other RNA
atgagcgacgagaactacagagatatcgccctggctttcctcgacgaatgcgccgattccggcaccattaatgcgtgggtgaacgagtttgcttatcaggggttcgaccccaagcggatcgtccaactggttaaagaacgcggaacagccaagggcagagattggaaaaaggacgtgaaaatgatgattgtgcttaatctggtccgggggaacaagcctgaggccatgatgaagaaaatgtctgaaaagggagctagcatcgtggccaatctcatttccgtttaccagctgaaagagggcaacccggggcgcgatacgatcaccctttctagagtgagcgctgcctttgtcccctggacagtgcaggcgctgcgggttctctccgagtctctgcctgtgagcggaaccacaatggacgccatcgctggcgtcacctatccccgcgccatgatgcacccttccttcgctggcattatcgatctggacctccccaatggggccggagcgacaattgccgatgctcatggcctgtttatgatcgagttcagcaagaccattaacccttctcttagaacgaaacaggccaatgaagtggctgccacctttgaaaagccgaacatggccgctatgtccgggcggttctttacacgcgaggacaagaaaaagctgctcatcgcggtgggaattatcgatgaggacctggtccttgccagcgctgttgtgagatctgccgaaaaataccgggccaaggtgggcaaatga

SEQ ID NO: 7623 - RNA, 738 nt, synthetic construct
  misc_feature 1..738: note = derived and/or modified CDS sequence (opt5) from SFTSV(HB29)__NC_018137.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacagccggcgtgagcgaggcgaccacgaaaaccctgatggaagcctactccctttggcaggatgcttttacaaagaccattaatgttaagatgcgcggggccagcaaaacagaggtgtataactctttccgggaccctctgcacgctgccgtcaattccgtgtttttcccgaacgatgtgagagtcaagtggctcaaagccaagggaatcctgggccccgacggggttcctagccgggctgcggaagtggccgctgccgcctaccgcaatctgtga

SEQ ID NO: 7624 - RNA, 738 nt, synthetic construct
  misc_feature 1..738: note = derived and/or modified CDS sequence (opt5) from SFTSV(111S)__KP339904.1__N
  source 1..738: mol_type = other RNA
atgagcgagtggtccagaatcgccgtggagttcggcgaacagcaactgaacctcaccgaactggaggactttgctcgggaacttgcctacgaggggctggatcgcgcgctcattatcaagaaactgaaggagacaggaggcgacgattgggtcaaagacacgaagttcattatcgtttttgctcttaccagagggaataaaattgtgaaggcctctggaaagatgagcaactccggctctaaacggctgatggccctccaggaaaagtatgggctggtggagcgcgctgaaacaagactgagcatcacccccgtccgggtggcccagtccctccctacatggacctgcgctgccgcggccgctctgaaagagtaccttccggttggacccgccgtgatgaatctgaaggtcgagaactatcctcccgaaatgatgtgtatggctttcggctctctcatccctacagccggcgtgagcgaggcgaccacgaaaaccctgatggaagcctactccctttggcaggatgcttttacaaagaccattaatgttaagatgcgcggggccagcaaaacagaggtgtataactctttcagagaccccctgcacgctgccgtcaattccgtgtttttccctaacgatgtgcgggtcaagtggctcaaagccaagggaatcctgggcccggacggggttcccagccgcgctgcggaagtggccgctgccgcctacagaaatctgtga

SEQ ID NO: 7625 - RNA, 738 nt, synthetic construct
  misc_feature 1..738: note = derived and/or modified CDS sequence (opt5) from SFTSV(116S)__KP339905.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacagccggcgtgagcgaggcgaccacgaaaaccctgatggaagcctactccctttggcaggatgcttttacaaagaccattaatgttaagatgcggggagccagcaaaacagagatctataactctttccgcgaccctctgcacgctgccgtcaattccgtgtttttcccgaacgatgtgagagtgaagtggctcaaagccaaggggattctgggccccgacggggtccctagccgggctgcggaagttgccgctgccgcctaccgcaatctgtga

SEQ ID NO: 7626 - RNA, 738 nt, synthetic construct
  misc_feature 1..738: note = derived and/or modified CDS sequence (opt5) from SFTSV(132S)__KP339912.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcatttctgtttttgctcttacccgcgggaataaaatcgtgaaggccagcggaaagatgtccaactctggcagcaaaagactgatggccctccaggaaaagtatgggctggtggagcgggctgaaacacgcctgtccattacccctgtcagagtggcccagtctctcccgacatggacctgcgctgccgcggccgctctgaaagagtaccttcccgttggacctgccgtgatgaatctgaaggtcgagaactatccccctgaaatgatgtgtatggctttcggcagcctcatccccacagccggcgtgtccgaggcgaccacgaaaaccctgatggaagcctacagcctttggcaggatgcttttacaaagaccatcaatgttaagatgcggggagcctctaaaacagaggtgtataactccttccgcgaccctctgcacgctgccgtcaatagcgtgtttttcccgaacgatgtgagagtcaagtggctcaaagccaaggggattctgggccccgacggggttccttctcgggctgcggaagtggccgctgccgcctaccgcaatctgtga

SEQ ID NO: 7627 - RNA, 738 nt, synthetic construct
  misc_feature 1..738: note = derived and/or modified CDS sequence (opt5) from SFTSV(2014045S)__KR075923.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacagccggcgtgagcgaggcgaccacgaaaaccctgatggaagcctactccctttggcaggatgcttttacaaagaccattaatgttaagatgcgcggggccagcaaaacagaggtgtataactctttccgggaccctctgcacgctgccgtcaattccgtgtttttcccgaacgatgtgagagtcaagtggctcaaagccaagggaatcctgggccccgacggggctcctagccgggcggccgaagttgctgccgccgcttaccgcaatctgtga

SEQ ID NO: 7628 - RNA, 738 nt, synthetic construct
  misc_feature 1..738: note = derived and/or modified CDS sequence (opt5) from SFTSV(2014193S)__KR075916.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcgtcacccctgtgagagttgcccagtccctcccgacatggacctgcgctgccgcggccgctctgaaagagtaccttcccgtgggacctgccgtcatgaatctgaaggtggagaactatccccctgaaatgatgtgtatggctttcggctctctcatccccacagccggcgttagcgaggcgaccacgaaaaccctgatggaagcctactccctttggcaggatgcttttacaaagaccatcaatgtgaagatgcggggagccagcaaaacagaggtctataactctttccgcgaccctctgcacgctgccgtcaattccgtgtttttcccgaacgatgtgagagttaagtggctcaaagccaaggggattctgggccccgacggggtgcctagccgggctgcggaagtggccgctgccgcctaccgcaatctgtga

SEQ ID NO: 7629 - RNA, 738 nt, synthetic construct
  misc_feature 1..738: note = derived and/or modified CDS sequence (opt5) from SFTSV(2015SH232S)__KT736097.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacagccggcgtgagcgaggcgaccacgaaaaccctgatggaagcctactccctttggcaggatgcttttacaaagaccattaatgttaagatgcgcggggccagcaaaacagaggtgtataactctttccgggaccctctgcacgctgccgtcaattccgtgtttttcccgaacgatgtgagagtccggtggctcaaggccaaaggaatcctgggccccgacggggttcctagccgcgctgcggaagtggccgctgccgcctacagaaatctgtga

SEQ ID NO: 7630 - RNA, 738 nt, synthetic construct
  misc_feature 1..738: note = derived and/or modified CDS sequence (opt5) from SFTSV(2015SYSH33)__KT380653.1__N
  source 1..738: mol_type = other RNA
atgagcgagtggtccagaatcgccgtggagttcggcgaacagcaactcaacctgaccgaacttgaggactttgctcgggaactggcctacgaggggctcgatcccgcgctgattatcaagaaacttaaggagacaggaggcgacgattgggtcaaagacacgaagttcattatcgtttttgctctgacccgcgggaataaaattgtgaaggcctctggaaagatgagcaactccggctctaaaagactcatggccctgcaggaaaagtatgggctggtggagcgggctgaaacacgcctcagcatcacccctgtcagagtggcccagtccctgccgacatggacctgcgctgccgcggccgctcttaaagagtacctgcccgttggacctgccgtgatgaatctcaaggtcgagaactatccccctgaaatgatgtgtatggctttcggctctctgatccccacagccggcgtgagcgaggcgaccacgaaaacccttatggaagcctactccctgtggcaggatgcttttacaaagaccattaatgttaagatgcgcggggccagcaaaacagaggtgtataactctttccgggaccctctccacgctgccgtcaattccgtgtttttcccgaacgatgtgagagtcaagtggctgaaagccaagggaatcctgggccccgacggggttcctagccgggctgcggaagtggccgctgccgcctaccgcaatctctga

SEQ ID NO: 7631 - RNA, 738 nt, synthetic construct
  misc_feature 1..738: note = derived and/or modified CDS sequence (opt5) from SFTSV(2015SYSH86)__KT380657.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattatcaaggcctctggaaagatgagcaactccggctctaaaagactgatggccctccaggaaaagtatgggctggtggagcgggctgaaacacgcctgagcatcacccctgtgagagtcgcccagtccctcccgacatggacctgcgctgccgcggccgctctgaaagagtaccttcccgtgggacctgccgttatgaatctgaaggtggagaactatccccctgaaatgatgtgtatggctttcggctctctcattcccacagccggcgtcagcgaggcgaccacgaaaaccctgatggaagcctactccctttggcaggatgcttttacaaagaccatcaatgtgaagatgcggggagccagcaaaacagaggtttataactctttccgcgaccctctgcacgctgccgtcaattccgtgtttttcccgaacgatgtgagagtgaagtggctcaaagccaaggggattctgggccccgacggggtccctagccgggctgcggaagttgccgctgccgcctaccgcaatctgtga

SEQ ID NO: 7632 - RNA, 738 nt, synthetic construct
  misc_feature 1..738: note = derived and/or modified CDS sequence (opt5) from SFTSV(67S)__KP339890.1__N
  source 1..738: mol_type = other RNA
atgagcgagtggtccagaatcgccgtggagttcgctgaacagcaactgaacctcaccgaactggaggactttgcccgggaacttgcgtacgagggcctggatcccgctctcattatcaagaaactgaaggagacagggggagacgattgggtcaaagacacgaagttcattatcgtttttgcccttacccgcggcaataaaattgtgaaggcctctgggaagatgagcaactccggatctaaaagactgatggctctccaggaaaagtatggcctggtggagcgggccgaaacacgcctgagcatcacccctgtcagagtggctcagtccctcccgacatggacctgcgccgcggccgctgccctgaaagagtaccttcccgttgggcctgctgtgatgaatctgaaggtcgagaactatccccctgaaatgatgtgtatggccttcggatctctcatccccacagcgggcgtgagcgaggccaccacgaaaaccctgatggaggcttactccctttggcaggatgcctttacaaagaccattaatgttaagatgcggggcgctagcaaaacagaagtgtataactctttccgcgaccctctgcacgccgccgtcaattccgtgtttttcccgaacgatgtgagagtcaagtggctcaaagctaaggggatcctgggacccgacggcgttcctagccgggcggccgaagtggctgccgccgcttaccgcaatctgtga

SEQ ID NO: 7633 - RNA, 738 nt, synthetic construct
  misc_feature 1..738: note = derived and/or modified CDS sequence (opt5) from SFTSV(6S)__KP339927.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcttcagcatcacccctgtcagagtggcccagtccctgccgacatggacctgcgctgccgcggccgctctcaaagagtacctgcccgttggacctgccgtgatgaatcttaaggtcgagaactatccccctgaaatgatgtgtatggcttttggctctctgatccccacagccggcgtgagcgaggcgaccacgaaaaccctcatggaagcctactccctgtggcaggatgctttcacaaagaccattaatgttaagatgcgcggggccagcaaaacagaggtgtataactcttttcgggaccctcttcacgctgccgtcaattccgtgttctttccgaacgatgtgagagtcaagtggctgaaagccaagggaatcctcggccccgacggggttcctagccgggctgcggaagtggccgctgccgcctaccgcaatctgtga

SEQ ID NO: 7634 - RNA, 738 nt, synthetic construct
  misc_feature 1..738: note = derived and/or modified CDS sequence (opt5) from SFTSV(72S)__KP339891.1__N
  source 1..738: mol_type = other RNA
atgagcgagtggtccagaatcgccgtggagttcggcgaacagcaactgaccctcacagaactggaggactttgctcgggaacttgcctacgaggggctggatcccgcgctcattatcaagaaactgaaggagacgggaggcgacgattgggtcaaagacaccaagttcattatcgtttttgctcttacacgcgggaacaaaattgtgaaggcctctggaaagatgagcaattccggctctaaaagactgatggccctccaggaaaagtatgggctggtggagcgggctgaaacccgcctgagcatcacacctgtcagagtggcccagtccctcccgacctggacatgcgctgccgcggccgctctgaaagagtaccttcccgttggacctgccgtgatgaacctgaaggtcgagaattatccccctgaaatgatgtgtatggctttcggctctctcatccccaccgccggcgtgagcgaggcgacgaccaaaacactgatggaagcctactccctttggcaggatgcttttaccaagacaattaacgttaagatgcgcggggccagcaaaaccgaggtgtataattctttccgggaccctctgcacgctgccgtcaactccgtgtttttcccgaatgatgtgagagtccggtggctcaaggccaaaggaatcctgggccccgacggggttcctagccgcgctgcggaagtggccgctgccgcctacagaaacctgtga

SEQ ID NO: 7635 - RNA, 738 nt, synthetic construct
  misc_feature 1..738: note = derived and/or modified CDS sequence (opt5) from SFTSV(AP01-Korea-13)__KR612072.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtccgcgacacgaaattcattatcgtttttgctcttaccagagggaataagattgtgaaagcctctggaaagatgagcaactccggctctaagcggctgatggccctccaggaaaaatatgggctggtggagcgcgctgaaacaagactgagcatcacccctgtccgggtggcccagtccctcccgacatggacctgcgctgccgcggccgctctgaaggagtaccttcccgttggacctgccgtgatgaatctgaaagtcgagaactatccccctgaaatgatgtgtatggctttcggctctctcatccccacagccggcgtgagcgaggcgaccacgaagaccctgatggaagcctactccctttggcaggatgcttttacaaaaaccattaatgttaagatgcgcggggccagcaagacagaggtgtataactctttcagagaccctctgcacgctgccgtcaattccgtgtttttcccgaacgatgtgcgggtcaaatggctcaaggccaaaggaatcctgggccccgacggggttcctagccgcgctgcggaagtggccgctgccgcctacagaaatctgtga

SEQ ID NO: 7636 - RNA, 738 nt, synthetic construct
  misc_feature 1..738: note = derived and/or modified CDS sequence (opt5) from SFTSV(JP03-Korea-13)__KR612079.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtccgcgacacgaaattcattatcgtttttgctcttaccagagggaataagattgtgaaagcctctggaaagatgagcaactccggctctaagcggctgatggccctccaggaaaaatatgggctggtggagcgcgctgaaacaagactgagcatcacccctgtccgggtggcccagtccctcccgacatggacctgcgctgccgcggccgctctgaaggagtaccttcccgttggacctgccgtgatgaatctgaaagtcgagaactatccccctgaaatgatgtgtatggctttcggctctctcatccccacagccggcgtgagcgaggcgaccacgaagaccctgatggaagcctactccctttggcaggatgcttttacaaaaaccattaatgttaagatgcgcggggccagcaagacagaggtgtataactctttcagagaccctctgcacgctgccgtcaattccgtgtttttcccgaacgatgtgcgggtcaaatggctcaaggccaaaggaatcctgggccccgacgggattcctagccgcgctgcggaagttgccgctgccgcctacagaaatctgtga

SEQ ID NO: 7637 - RNA, 738 nt, synthetic construct
  misc_feature 1..738: note = derived and/or modified CDS sequence (opt5) from SFTSV(JP07-Korea-13)__KR612088.1__N
  source 1..738: mol_type = other RNA
atgagcgagtggtccagaatcgccgtggagttcggcgaacaccagctgaacctcaccgaactggaggactttgctcgggaacttgcctacgaggggctggatcccgcgctcattatcaagaaactgaaggagacaggaggcgacgattgggtccgcgacacgaaattcattatcgtttttgctcttaccagagggaataagattgtgaaagcctctggaaagatgagcaactccggctctaagcggctgatggccctccaagaaaaatatgggctggtggagcgcgctgaaacaagactgagcatcacccctgtccgggtggcccagtccctcccgacatggacctgcgctgccgcggccgctctgaaggagtaccttcccgttggacctgccgtgatgaatctgaaagtcgagaactatccccctgaaatgatgtgtatggctttcggctctctcatccccacagccggcgtgagcgaggcgaccacgaagaccctgatggaagcctactccctttggcaggatgcttttacaaaaaccattaatgttaagatgcgcggggccagcaagacagaggtgtataactctttcagagaccctctgcatgctgccgtcaattccgtgtttttcccgaacgatgtgcgggtcaaatggctcaaggccaaaggaatcctgggccccgacggggttcctagccgcgctgcggaagtggccgctgccgcctacagaaatctgtga

SEQ ID NO: 7638 - RNA, 738 nt, synthetic construct
  misc_feature 1..738: note = derived and/or modified CDS sequence (opt5) from SFTSV(JS2011-13-2)__KR230790.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagctcctctggcagcaaaagactgatggccctccaggaaaagtatgggctggtggagcgggctgaaacacgcctgtccatcacccctgtcagagtggcccagtctctcccgacatggacctgcgctgccgcggccgctctgaaagagtaccttcccgttggacctgccgtgatgaacctgaaggtcgagaattatccccctgaaatgatgtgtatggctttcggcagcctcatccccacagccggcgtgtccgaggcgaccacgaaaaccctgatggaagcctacagcctttggcaggatgcttttacaaagaccattaacgttaagatgcgcggggcctctaaaacagaggtgtataattccttccgggaccctctgcacgctgccgtcaacagcgtgtttttcccgaatgatgtgagagtcaagtggctcaaagccaagggaatcctgggccccgacggggttccttctcgggctgcggaagtggccgctgccgcctaccgcaacctgtga

SEQ ID NO: 7639 - RNA, 738 nt, synthetic construct
  misc_feature 1..738: note = derived and/or modified CDS sequence (opt5) from SFTSV(JS2014-15)__KR230799.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcatcacccctgtcagagtggcccagtccctcccgacatggacctgcgctgccgcggccgctctgaaagagtaccttctggttggacccgccgtgatgaatctcaaggtcgagaactatcctcccgaaatgatgtgtatggctttcggctctctgatccctacagccggcgtgagcgaggcgaccacgaaaacccttatggaagcctactccctgtggcaggatgcttttacaaagaccattaatgttaagatgcgcggggccagcaaaacagaggtgtataactctttccgggaccccctccacgctgccgtcaattccgtgtttttccctaacgatgtgagagtcaagtggctgaaagccaagggaatcctgggcccggacggggttcccagccgggctgcggaagtggccgctgccgcctaccgcaatctctga

SEQ ID NO: 7640 - RNA, 738 nt, synthetic construct
  misc_feature 1..738: note = derived and/or modified CDS sequence (opt5) from SFTSV(KASJH)__KP663733.1__N
  source 1..738: mol_type = other RNA
atgagcgagtggtccagaatcgccgtggagttcggcgaacagcaactgaacctctctgaactggaggactttgctcgggaacttgcctacgaggggctggatcccgcgctcattatcaagaaactgaaggagaccggaggcgacgattgggtcaaagacacaaagttcattatcgtttttgctcttacgcgcgggaataaaattgtgaaggccagcggaaagatgtccaactctggcagcaaaagactgatggccctccaggaaaagtatgggctggtggagcgggctgaaacccgcctgtccatcacacctgtcagagtggcccagtctctcccgacctggacatgcgctgccgcggccgctctgaaagagtaccttcccgttggacctgccgtgatgaatctgaaggtcgagaactatccccctgaaatgatgtgtatggctttcggcagcctcatccccaccgccggcgtgtccgaggcgacaaccaaaacgctgatggaagcctacagcctttggcaggatgcttttaccaagacaattaatgttaagatgcgcggggcctctaaaaccgaggtgtataactccttccgggaccctctgcacgctgccgtcaatagcgtgtttttcccgaacgatgtgagagtcaagtggctcaaagccaagggaatcctgggccccgacggggttccttctcgggctgcggaagtggccgctgccgcctaccgcaatctgtga

SEQ ID NO: 7641 - RNA, 738 nt, synthetic construct
  misc_feature 1..738: note = derived and/or modified CDS sequence (opt5) from SFTSV(YSH116)__KT721303.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacagccggcgtgagcgaggcgaccacgaaaaccctgatggaagcctactccctttggcaggatgtttttacaaagaccattaatgtgaagatgcgcggggctagcaaaacagaggtctataactctttccgggaccctctgcacgccgctgtcaattccgtgtttttcccgaacgatgtgagagttaagtggctcaaagccaagggaatcctgggccccgacggggtgcctagccgggccgctgaagtggcggccgctgcctaccgcaatctgtga

SEQ ID NO: 7642 - RNA, 738 nt, synthetic construct
  misc_feature 1..738: note = derived and/or modified CDS sequence (opt5) from SFTSV(AH-YTY/China/05/2012)__KR017811.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacaaccggcgtgagcgaggccacgaccaaaacactgatggaagcgtactccctttggcaggatgcctttaccaagacaattaatgttaagatgcgcggggctagcaaaaccgaggtgtataactctttccgggaccctctgcacgccgctgtcaattccgtgtttttcccgaacgatgtgagagtcaagtggctcaaagccaagggaatcctgggccccgacggggttcctagccgggccgctgaagtggcggccgctgcctaccgcaatctgtga

SEQ ID NO: 7643 - RNA, 738 nt, synthetic construct
  misc_feature 1..738: note = derived and/or modified CDS sequence (opt5) from SFTSV(DS02/CHN/2013)__KR698319.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtccgcgacacgaaattcattatcgtttttgctcttaccagagggaataagattgtgaaagcctctggaaagatgagcaactccggctctaagcggctgatggccctccaggaaaaatatgggctggtggagaaggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacagccggcgtgagcgaggcgaccacgaaaaccctgatggaagcctactccctttggcaggatgcttttacaaagaccattaatgttaagatgcgcggggccagcaaaacagaggtgtataactctttccgggaccctctgcacgctgccgtcaattccgtgtttttcccgaacgatgtgagagtcaagtggctcaaagccaagggaatcctgggccccgacggggttcctagccgggctgcggaagtggccgctgccgcctaccgcaatctgtga

SEQ ID NO: 7644 - RNA, 738 nt, synthetic construct
  misc_feature 1..738: note = derived and/or modified CDS sequence (opt5) from SFTSV(HB2014-13)__KU738908.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacaaccggcgtgagcgaggccacgaccaaaacactgatggaagcgtactccctttggcaggatgcctttaccaagacaattaatgttaagatgcgcggggctagcaaaaccgaggtgtataactctttccgggaccctctgcacgccgctgtcaattccgtgtttttcccgaacgatgtgagagtccggtggctcaaggccaaaggaatcctgggccccgacggggttcctagccgcgccgctgaagtggcggccgctgcctacagaaatctgtga

SEQ ID NO: 7645 - RNA, 738 nt, synthetic construct
  misc_feature 1..738: note = derived and/or modified CDS sequence (opt5) from SFTSV(HB2014-20)__KU738910.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatgacactccaggaaaagtatgggctggtggagcgggccgaaacccgcctgagcatcacacctgtcagagtggctcagtccctcccgacctggacatgcgccgctgccgcggccctgaaagagtaccttcccgttggacctgctgtgatgaatctgaaggtcgagaactatccccctgaaatgatgtgtatggccttcggctctctcatccccaccgctggcgtgagcgaggccacgaccaaaacactgatggaagcgtactccctttggcaggatgcctttaccaagacaattaatgttaagatgcgcggggctagcaaaaccgaggtgtataactctttccgggaccctctgcacgccgctgtcaattccgtgtttttcccgaacgatgtgagagtcaagtggctcaaagccaagggaatcctgggccccgacggggttcctagccgggccgctgaagtggcggccgctgcctaccgcaatctgtga

SEQ ID NO: 7646 - RNA, 738 nt, synthetic construct
  misc_feature 1..738: note = derived and/or modified CDS sequence (opt5) from SFTSV(LN2012-14)__KF887431.1__N
  source 1..738: mol_type = other RNA
atgagcgagagatcccggatcgccgtggagttcggcgaacagcaactgaacctcaccgggctggaagactttgctcgcgagcttgcctacgaaggactggatcccgcgctcattatcaagaaactgaaggagacaggcggggacgattgggtcaaagacacgaagttcattatcgtttttgctcttaccagaggaaataaaattgtgaaggcctctggcaagatgagcaactccgggtctaaacggctgatggccctccaggagaagtatggactggtggaacgcgctgagacaagactgagcatcacccctgtccgggtggcccagtccctcccgacatggacctgcgctgccgcggccgctctgaaagaataccttcccgttggccctgccgtgatgaatctgaaggtcgagaactatccccctgagatgatgtgtatggctttcggctctctcatccccacagccggggtgagcgaagcgaccacgcgcaccctgatggaggcctactccctttggcaggatgcttttacaaaaaccattaatgttaagatgagaggagccagcaagacagaagtgtataactctttccgggaccctctgcacgctgccgtcaattccgtgtttttcccgaacgatgtgcgcgtcaaatggctcaaggccaaaggcatcctggggcccgacggagttcctagcagagctgcggaggtggccgctgccgcctaccggaatctgtga

SEQ ID NO: 7647 - RNA, 738 nt, synthetic construct
  misc_feature 1..738: note = derived and/or modified CDS sequence (opt5) from SFTSV(NB31/CHN/2013)__KR698325.1__N
  source 1..738: mol_type = other RNA
atgagcgagtggtccagaatcgccgtggagttcggcgaacagcaactgaacctcattgaactggaggactttgctcgggaacttgcctacgaggggctggatcccgcgctcatcattaagaaactgaaggagaccggaggcgacgattgggtccgcgacacaaaattcatcattgtttttgctcttacgagagggaataagatcgtgaaagcctctggaaagatgagcaactccggctctaagcggctgatggccctccaggaaaaatatgggctggtggagaaggctgaaacccgcctgagcatcacacctgtcagagtggcccagtccctcccgacctggacatgcgctgccgcggccgctctgaaagagtaccttcccgttggacctgccgtgatgaatctgaaggtcgagaactatccccctgaaatgatgtgtatggctttcggctctctcattcccaccgccggcgtgagcaaacctacaaccaagacgctgatggaggcgtactccctttggcaggatgcctttaccaagacaatcaatgttaaaatgcggggagctagcaagaccgaagtgtataactctttccgcgacccgctgcacgccgctgtcaattccgtgtttttccccaacgatgtgagagtcaaatggctcaaggccaaagggattctgggccctgacggggttcccagccgggccgctgaggtggcggccgctgcctaccgcaatctgtga

SEQ ID NO: 7648 - RNA, 738 nt, synthetic construct
  misc_feature 1..738: note = derived and/or modified CDS sequence (opt5) from SFTSV(QD7)__KR706565.1__N
  source 1..738: mol_type = other RNA
atgagcgagtggtccagaatcgccgtggagttcggcgtccagcaactgaacctcaccgaactggaagactttgctcgggagcttgcctacgaagggctggatcccgcgctcattatcaagaaactgaaggagacaggaggcgacgattgggttaaagacacgaagttcattatcgtgtttgctcttacccgcgggaataaaattgtgaaggcctctggaaagatgagcaactccggctctaaaagactgatggccctccaggagaagtatgggctggtcgaacgggctgagacacgcctgagcatcacccctgtgagagttgcccagtccctcccgacatggacctgcgctgccgcggccgctctgaaagaataccttcccgtgggacctgccgtcatgaatctgaaggtggagaactatccccctgagatgatgtgtatggctttcggctctctcatccccacagccggcgttagcgaagcgaccacgaaaaccctgatggaggcctactccctttggcaggatgcttttacaaagaccattaatgtgaagatgcgcggggccagcaaaacagaagtctataactctttccgggaccctctgcacgctgccgtcaattccgtgtttttcccgaacgatgtgagagttaagtggctcaaagccaagggaatcctgggccccgacggggtgcctagccgggctgcggaggtggccgctgccgcctaccgcaatctgtga

SEQ ID NO: 7649 - RNA, 738 nt, synthetic construct
  misc_feature 1..738: note = derived and/or modified CDS sequence (opt5) from SFTSV(SDLZP06/2011)__JQ693009.1__N
  source 1..738: mol_type = other RNA
atgagcgagtggtccagaaccgccgtggagttcggcgaacagcaactgaacctcacagaactggaggactttgctcgggaacttgcctacgaggggctggatcccgcgctcatcattaagaaactgaaggagacgggaggcgacgattgggtcaaagacaccaagttcatcattgtttttgctcttacacgcgggaataaaatcgtgaaggcctctggaaagatgagcaactccggctctaaaagactgatggccctccaggaaaagtatgggctggtggagcgggctgaaacccgcctgagcattacacctgtcagagtggcccagtccctcccgacctggacatgcgctgccgcggccgctctgaaagagtaccttcccgttggacctgccgtgatgaatctgaaggtcgagaactatccccctgaaatgatgtgtatggctttcggctctctcatccccaccgccggcgtgagcgaggcgacgaccaaaacactgatggaagcctactccctttggcaggatgcttttaccaagacaatcaatgttaagatgcggggagccagcaaaaccgaggtgtataactctttccgcgaccctctgcacgctgccgtcaattccgtgtttttcccgaacgatgtgagagtcaagtggctcaaagccaaggggattctgggccccgacggggttcctagccgggctgcggaagtggccgctgccgcctaccgcaatctgtga

SEQ ID NO: 7650 - RNA, 738 nt, synthetic construct
  misc_feature 1..738: note = derived and/or modified CDS sequence (opt5) from SFTSV(ZJZHSH-FDE/China/06/2012)__KR017821.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtccgcgacacgaaattcattatcgtttttgctcttaccagagggaataagattgtgaaagcctctggaaagatgagcaactccggctctaagcggctgatggccctccaggaaaaatatgggctggtggagaaggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacagccggcgtgagcgaggcgaccacgaaaaccctgatggaagcctactccctttggcaggatgcttttacaaagaccattaatgttaagatgcgcggggccagcaaaacagaggtgtataactctttccgggaccctctgcacgctgccgtcaattccgtgctctttccgaacgatgtgagagtcaagtggctgaaagccaagggaatcctgggccccgacggggttcctagccgggctgcggaagtggccgctgccgcctaccgcaatctctga

SEQ ID NO: 7651 - RNA, 738 nt, synthetic construct
  misc_feature 1..738: note = derived and/or modified CDS sequence (opt5) from SFTSV(ZJZHSH-FZHR/China/07/2013)__KR017824.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattggatgaaagacacgaagttcattatcgtctttgctcttacccgcgggaataaaattgttaaggcctctggaaagatgagcaactccggctctaaaagactgatggccctccaggaaaagtatgggctggtggagcgggctgaaacacgcctgagcatcacccctgtgagagtcgcccagtccctcccgacatggacctgcgctgccgcggccgctctgaaagagtaccttcccgtgggacctgccgttatgaatctgaaggtggagaactatccccctgaaatgatgtgtatggctttcggctctctcatccccacagccggcgtcagcgaggcgaccacgaaaaccctgatggaagcctactccctttggcaggatgcttttacaaagaccattaatgtgaagatgcgcggggccagcaaaacagaggtttataactctttccgggaccctctgcacgctgccgtcaattccgtgtttttcccgaacgatgtgagagtgaagtggctcaaagccaagggaatcctgggccccgacggggtccctagccgggctgcggaagttgccgctgccgcctaccgcaatctgtga

SEQ ID NO: 7652 - RNA, 738 nt, synthetic construct
  misc_feature 1..738: note = derived and/or modified CDS sequence (opt5) from SFTSV(ZJZHSH-HYC/China/05/2012)__KR017809.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtccgcgacacgaaattcattatcgtttttgctcttaccagagggaataagattgtgaaagcctctggaaagatgagcaactccggctctaagcggctgatggccctccaggaaaaatatgggctggtggagaaggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacagtgggcgttagcgaggccaccacgaaaaccctgatggaagcgtactccctttggcaggatgcctttacaaagaccattaatgtgaagatgcgcggggctagcaaaacagaggtctataactctttccgggaccctctgcacgccgctgtcaattccgtgtttttcccgaacgatgtgagagttaagtggctcaaagccaagggaatcctgggccccgacggggtgcctagccgggccgctgaagtggcggccgctgcctaccgcaatctgtga

SEQ ID NO: 7653 - RNA, 738 nt, synthetic construct
  misc_feature 1..738: note = derived and/or modified CDS sequence (opt5) from SFTSV(SPL003A)__AB817996.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtccgcgacacgaaattcattatcgtttttgctcttaccagagggaataagattgtgaaagcctctggaaagatgagcaactccggctctaagcggctgatggccctccaggaaaaatatgggctggtggagcgcgctgaaacaagactgagcatcacccctgtccgggtggcccagtccctcccgacatggacctgcgctgccgcggccgctctgaaggagtaccttcccgttggacctgccgtgatgaatctgaaagtcgagaactatccccctgaaatgatgtgtatggctttcggctctctcatccccacagccggcgtgagcgaggcgaccacgaagaccctgatggaagcctactccctttggcaggatgcttttacaaaaaccattaatgttaagatgcgcggggccagcaagacagaggtgtataactctttcagagaccctctgcacgctgccgtcaattccgtgtttttcccgaacgatgtgcgggtcaaatggctcaaggccaaaggaatcctgggccccgacggggctcctagccgcgcggccgaagttgctgccgccgcttacagaaatctgtga

SEQ ID NO: 7654 - RNA, 738 nt, synthetic construct
  misc_feature 1..738: note = derived and/or modified CDS sequence (opt5) from SFTSV(SPL077A)__AB985536.1__N
  source 1..738: mol_type = other RNA
atgagcgagtggcccagaatcgccgtggagttcggcgaacagcaactgaacctcaccgaactggaggactttgctcgggaacttgcctacgaggggctggatcctgcgctcattatcaagaaactgaaggagacaggaggcgacgattgggtccgcgacacgaaattcattatcgtttttgctcttaccagagggaataagattgtgaaagcctccggaaagatgtctaacagcggctccaagcggctgatggccctccaggaaaaatatgggctggtggagcgcgctgaaacaagactgtctatcaccccggtccgggtggcccagagcctccccacatggacctgcgctgccgcggccgctctgaaggagtaccttcctgttggacccgccgtgatgaatctgaaagtcgagaactatcctcccgaaatgatgtgtatggctttcggctccctcatccctacagccggcgtgtctgaggcgaccacgaagaccctgatggaagcctacagcctttggcaggatgcttttacaaaaaccattaatgttaagatgcgcggggcctccaagacagaggtgtataacagcttcagagacccgctgcacgctgccgtcaattctgtgtttttccccaacgatgtgcgggtcaaatggctcaaggccaaaggaatcctgggccctgacggggttccctcccgcgctgcggaagtggccgctgccgcctacagaaatctgtga

SEQ ID NO: 7655 - RNA, 738 nt, synthetic construct
  misc_feature 1..738: note = derived and/or modified CDS sequence (opt5) from SFTSV(SPL106A)__AB985548.1__N
  source 1..738: mol_type = other RNA
atgagcgactggtccagaatcgccgtggagttcggcgaacagcaactgaacctcaccgagctggaagattttgctcgggagcttgcctacgaagggctggaccccgcgctcattatcaagaaactgaaggagacaggaggcgatgactgggtccgcgatacgaaattcattatcgtttttgctcttaccagagggaataagattgtgaaagcctctggaaagatgagcaactccggctctaagcggctgatggccctccaggagaaatatgggctggtggaacgcgctgagacaagactgagcatcacccctgtccgggtggcccagtccctcccgacatggacctgcgctgccgcggccgctctgaaggaataccttcccgttggacctgccgtgatgaatctgaaagtcgagaactatccccctgagatgatgtgtatggctttcggctctctcatccccacagccggcgtgagcgaagcgaccacgaagaccctgatggaggcctactccctttggcaggacgcttttacaaaaaccattaatgttaagatgcgcggggccagcaagacagaagtgtataactctttcagagatcctctgcacgctgccgtcaattccgtgtttttcccgaacgacgtgcgggtcaaatggctcaaggccaaaggaatcctgggccccgatggggttcctagccgcgctgcggaggtggccgctgccgcctacagaaatctgtga

SEQ ID NO: 7656 - RNA, 738 nt, synthetic construct
  misc_feature 1..738: note = derived and/or modified CDS sequence (opt5) from SFTSV(SPL114A)__AB985552.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtccgcgacacgaaattcattatcgtttttgctcttaccagagggaataagattgtgaaagcccctggaaagatgtctaacagcggctccaagcggctgatggccctccaggaaaaatatgggctggtggagcgcgctgaaacaagactgtctatcaccccggtccgggtggcccagagcctccccacatggacctgcgctgccgcggccgctctgaaggagtaccttcctgttggacccgccgtgatgaatctgaaagtcgagaactatcctcccgaaatgatgtgtatggctttcggctccctcatccctacagccggcgtgtctgaggcgaccacgaagaccctgatggaagcctacagcctttggcaggatgcttttacaaaaaccattaatgttaagatgcgcggggcctccaagacagaggtgtataacagcttcagagacccgctgcacgctgccgtcaattctgtgtttttccccaacgatgtgcgggtcaaatggctcaaggccaaaggaatcctgggccctgacggggttccctcccgcgctgcggaagtggccgctgccgcctacagaaatctgtga

SEQ ID NO: 7657 - RNA, 738 nt, synthetic construct
  misc_feature 1..738: note = derived and/or modified CDS sequence (opt5) from SFTSV(SPL125A)__AB985557.1__N
  source 1..738: mol_type = other RNA
atgagcgagtggtccggcgtggccgtcgagttcggggaacagcaactgaacctcaccgaactggaggactttgctagagaacttgcctacgagggactggatcccgcgctcatcattaagaaactgaaggagacaggcggggacgattgggttcgggacacgaaattcatcattgtgtttgctcttacccgcggaaataagatcgtgaaagcctctggcaagatgagcaactccgggtctaagagactgatggccctccaggaaaaatatggactggtcgagcgggctgaaacacgcctgagcattacccctgtgagagttgcccagtccctcccgacatggacctgcgctgccgcggccgctctgaaggagtaccttcccgtgggccctgccgtcatgaatctgaaagtggagaactatccccctgaaatgatgtgtatggctttcggctctctcatccccacagccggggttagcgaggcgaccacgaagaccctgatggaagcctactccctttggcaggatgcttttacaaaaaccatcaatgtgaagatgcggggagccagcaagacagaggtctataactctttccgcgaccctctgcacgctgccgtcaattccgtgtttttcccgaacgatgtgagagttaaatggctcaaggccaaaggcattctggggcccgacggagtgcctagccgggctgcggaagtggccgctgccgcctaccgcaatctgtga

SEQ ID NO: 7658 - RNA, 738 nt, synthetic construct
  misc_feature 1..738: note = derived and/or modified CDS sequence (opt5) from SFTSV(SPL160A)__AB985571.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcacaaagctgaaagagacgggaggcgacgattgggtccgcgacaccaagttcattatcgtttttgctcttacaagagggaataaaattgtgaaggcctctggaaaaatgagcaactccggctctaagcggctgatggccctccaggaaaagtatgggctggtggagcgcgctgaaaccagactgagcatcacacctgtccgggtggcccagtccctcccgacctggacatgcgctgccgcggccgctctgaaagagtaccttcccgttggacctgccgtgatgaatctgaaggtcgagaactatccccctgaaatgatgtgtatggctttcggctctctcatccccaccgccggcgtgagcgaggcgacgaccaaaacactgatggaagcctactccctttggcaggatgcttttaccaagacaattaatgttaaaatgcgcggggccagcaagaccgaggtgtataactctttcagagaccctctgcacgctgccgtcaattccgtgtttttcccgaacgatgtgcgggtcaagtggctcaaagccaagggaatcctgggccccgacggggttcctagccgcgctgcggaagtggccgctgccgcctacagaaatctgtga

SEQ ID NO: 7659 - RNA, 738 nt, synthetic construct
  misc_feature 1..738: note = derived and/or modified CDS sequence (opt5) from SFTSV(SPL163A)__AB985573.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtccgcgacacgaaattcattatcgtttttcctcttaccagagggaataagattgtgaaggcttctggaaaaatgagcaactccggctctaagcggctgatggccctccaggaaaaatatgggctggtggagcgcgccgaaacaagactgagcatcaccccggtccgggtggctcagtccctccccacatggacctgcgccgctgccgcggccctgaaggagtaccttcctgttggacccgctgtgatgaatctgaaagtcgagaactatcctcccgaaatgatgtgtatggccttcggctctctcatccctacagctggcgtgagcgaggccaccacgaagaccctgatggaagcgtactccctttggcaggatgcctttacaaaaaccattaatgttaagatgcgcggggctagcaagacagaggtgtataactctttcagagacccgctgcacgccgctgtcaattccgtgtttttccccaacgatgtgcgggtcaaatggctcaaggccaaaggaatcctgggccctgacggggttcccagccgcgccgctgaagtggcggccgctgcctacagaaatctgtga

SEQ ID NO: 7660 - RNA, 738 nt, synthetic construct
  misc_feature 1..738: note = derived and/or modified CDS sequence (opt5) from SFTSV/FTLSV(2011YPQ12)__KF711915.1__N
  source 1..738: mol_type = other RNA
atgagcaagtggtccagaatcgccgtggagttcggcgaacagcaactgaacctcaccgagctggaagactttgctcgggagcttgcctacgaagggctggatcccgcgctcattatcaaaaagctgaaagagacaggaggcgacgattgggtcaaggacacgaaattcattatcgtttttgctcttacccgcgggaataagattgtgaaggcctctggaaaaatgagcaactccggctctaagagactgatggccctccaggagaaatatgggctggtggaacgggctaagacacgcctgagcatcacccctgtcagagtggcccagtccctcccgacatggacctgcgctgccgcggccgctctgaaagagtaccttcccgttggacctgccgtgatgaatctgaaggtcgaaaactatccccctgagatgatgtgtatggctttcggctctctcatccccacagccggcgtgagcgaggcgaccacgaagaccctgatggaagcctactccctttggcaggatgcttttacaaaaaccattaatgttaagatgcgcggggccagcaaaacagaggtgtataactctttccgggaccctctgcacgctgccgtcaattccgtgtttttcccgaacgatgtgagagtcaagtggctcaaagccaagggaatcctgggccccgacggggttcctagcaaagctgcggaagtggccgctgccgcctaccggaatctgtga

SEQ ID NO: 7661 - RNA, 738 nt, synthetic construct
  misc_feature 1..738: note = derived and/or modified CDS sequence (opt5) from SFTSV/FTLSV(2011YXX9)__KF711898.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacagccggcgtgagcgaggcgaccacgaaaaccctggttgaagcctactccctttggcaggatgcttttacaaagaccattaatgtgaagatgcgcggggccagcaaaacagaggtctataactctttccgggaccctctgcacgctgccgtcaattccgtgtttttcccgaacgatgtgagagttaagtggctcaaagccaagggaatcctgggccccgacggggtgcctagccgggctgcggaagtggccgctgccgcctaccgcaatctgtga

SEQ ID NO: 7662 - RNA, 738 nt, synthetic construct
  misc_feature 1..738: note = derived and/or modified CDS sequence (opt5) from SFTSV/FTLSV(YPQ2)__KF356519.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacagccggcgtgagcgaggcgaccacgaaaaccctgatggaagcctactccctttggcaggatgcttttacaaagaccattaatgttaagatgcgcggggccagcaaaacagaggtgtataactctttccgggaccctctgcacgctgccgtcaattccgtgtttttcccgaacgatgtgagagtcaagtggctcaaagccaagggaatcctgggccccaatggggttcctagccgggctgcggaagtggccgctgccgcctaccgcaacctgtga

SEQ ID NO: 7663 - RNA, 738 nt, synthetic construct
  misc_feature 1..738: note = derived and/or modified CDS sequence (opt5) from SFTSV/Guertu virus(DXM)__KT328591.1__N
  source 1..738: mol_type = other RNA
atgagcgagtggtccaagatcgccgtggagttcggcgaacagcaactgaacgtcattgaactcgaggaatttgctagagagctggcctacgaggggcttgaccccgcgctgatcattaaaaagctcaaagaagttggaggcgatgactggatgcgggataccaagttcatcattgtgtttgctctgacacgcgggaataaaatccttaaggccgccggaaagatgtctaacagcggctccaaaagaatcatggctctgcaggagaagtatgggctcgtggaacgggccgagacgcgcctgtctattacccctgtcagagtggctcagagcctgccgacatggacctgctccgccgcggccgctctccaggagtacctgcccgttggacctgccgtgatgtctcttaaagtcagcaattttccccctgaaatgatgtgtatggctttcggctccctgatccccgccacaggcgtgcctgagagcaccacaaagattctcatggaagcgtattctctgtggcaagacgccttcaccaaaacgatcaacgttaagatgcggggagcttccaaggccgaggtgtacaatagctttcgcgatccgcttcacgctgccgtcaactctgtgttctttcccaatgacgtgagactgcggtggctcaaatccaaggggattctgggccctgatgggctgcccagcaaagccgtcgaaaccgctgcggccgcttatcgcaacctctga

SEQ ID NO: 7664 - RNA, 738 nt, synthetic construct
  misc_feature 1..738: note = derived and/or modified CDS sequence (opt5) from SFTSV/Huaiyangshan virus(2010-FQM)__HQ419240.1__N
  source 1..738: mol_type = other RNA
atgagcgagtggtccagaatcgccgtgaagttcggcgaacagcaactgaacctcaccgagctggaagactttgctcgggagcttgcctacgaagggctggatcccgcgctcattatcaaaaagctgaaagagacaggaggcgacgattgggtcaaggacacgaaattcattatcgtttttgctcttacccgcgggaataagattgtgaaggcctctggaaaaatgagcaactccggctctaagagactgatggccctccaggagaaatatgggctggtggaacgggctgagacacgcctgagcatcacccctgtcagagtggcccagtccctcccgacatggacctgcgctgccgcggccgctctgaaggaataccttcccgttggacctgccgtgatgaatctgaaagtcgagaactatccccctgagatgatgtgtatggctttcggctctctcatccccacagccggcgtgagcgaagcgaccacgaagaccctgatggaggcctactccctttggcaggatgcttttacaaagaccattaatgttaaaatgcgcggggccagcaagacagaagtgtataactctttccgggaccctctgcacgctgccgtcaattccgtgtttctcccgaacgatgtgagagtcaaatggctgaaggccaaaggaatcctgggccccgacggggttcctagccgggctgcggaggtggccgctgccgcctaccgcaatctctga

SEQ ID NO: 7665 - RNA, 738 nt, synthetic construct
  misc_feature 1..738: note = derived and/or modified CDS sequence (opt5) from SFTSV/Huaiyangshan virus(2010-ZGQ)__HQ419241.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatgagcctccaggaaaagtatgggctggtggagcgggccgaaacacgcctgtccatcacccctgtcagagtggctcagtctctcccgacatggacctgcgccgctgccgcggccctgaaagagtaccttcccgttggacctgctgtgatgaatctgaaggtcgagaactatccccctgaaatgatgtgtatggccttcggcagcctcatccccacagctggcgtgtccgaggccaccacgcggaccctgatggaagcgtacagcctttggcaggatgcctttacaaaaaccattaatgttaagatgcgcggggcttctaagacagaggtgtataactccttcagagaccctctgcacgccgctgtcaatagcgtgtttttcccgaacgatgtgcgggtcaaatggctcaaggccaaaggaatcctgggccccgacggggttccttctcgcgccgctgaagtggcggccgctgcctacagaaatctgtga

SEQ ID NO: 7666 - RNA, 738 nt, synthetic construct
  misc_feature 1..738: note = derived and/or modified CDS sequence (opt5) from SFTSV/Huaiyangshan virus(S-HGX)__HQ171192.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcatcacccctgtcagagtggcccagtccctcccgacatggacctgcacagctgccgcggccctgaaagagtaccttcccgttggacctgctgtgatgaatctgaaggtcgagaactatccccctgaaatgatgtgtatggccttcgagtctctcatccccaccgctggcgtgagcgaagccacgaccaaaacactgatggaggcgtactccctttggcaggatgcctttaccaagacaattaatgttgaaatgcggggcgctagcaagaccgaggtgtataactctttccgcgaccctctgcacgccgctgtcaattccgtgtttttcccgaacgatgtgagagtcaaatggctcaaggccaaagggatcctgggacccgacggcgttcctagccgggccgctgaggtggcggccgctgcctaccgcaatctgtga

SEQ ID NO: 7667 - RNA, 738 nt, synthetic construct
  misc_feature 1..738: note = derived and/or modified CDS sequence (opt5) from SFTSV/Huaiyangshan virus(S-HZM)__HQ171193.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacggagttcattatcgtttttgctcttacccgcgggaataagattgtgaaagcctctggaaagatgagcaactccggctctaagagactgatggccctccaggaaaaatatgggctggtggaacgggctgagacacgcctgagcatcacccctgtcagagtggcccagtccctcccgacatggacctgcgctgccgcggccgctctgaaggagtaccttcccgttggacctgccgtgatgaatctgaaagtcgaaaactatccccctgagatgatgtgtatggctttcggctctctcatccccacaaccggcgtgagcgaagccacgaccaagacactgatggaggcgtactccctttggcaggatgcctttaccaaaacaattaatgttaagatgcgcggggctagcaagaccgaagtgtataactctttccgggaccctctgcacgccgctgtcaattccgtgtttttcccgaacgatctcagagtgaaatggctgaaggccaaaggaatcctgggccccgacggggtccctagccgggccgctgaggttgcggccgctgcctaccgcaatctctga

SEQ ID NO: 7668 - RNA, 738 nt, synthetic construct
  misc_feature 1..738: note = derived and/or modified CDS sequence (opt5) from SFTSV/Huaiyangshan virus(S-WJ)__HQ171191.1__N
  source 1..738: mol_type = other RNA
atgagcgagtggtccagaatcgccgtggagttcggcgaacagcaactgaacctcaccgaactggaggactttgctcgggaacttgcctacgaggggctgggacccgcgctcattatcaagaaactgaaggagacaggcggggatgactgggtcaaagatacgaagttcattatcgtttttgctcttacccgcggaaataaaattgtgaaggcctctggcaagatgagcaactccgggtctaaaagactgatggccctccaggaaaagtatggactggtggagcgggctgaaacacgcctgagcatcacccctgtcagagtggcccagtccctcccgacatggacctgcgctgccgcggccgctctgaaagagtaccttcccgttggccctgccgtgatgaatctgaaggtcgagaactatccccctgaaatgatgtgtatggctttcggctctctcatccccacagccggggtgagcgaggcgaccacgaaaaccctgatggaagcctactccctttggcaggacgcttttacaaagaccattaatgttaagatgcggggagccagcaaaacagaggtgtataactctttccgcgatcctctgcacgctgccgtcaattccgtgtttttcccgaacgacgtgagagtcaagtggctcaaagccaagggcatcctggggcccgatggagttcctagccgggctgcggaagtggccgctgccgcctaccgcaatctgtga

SEQ ID NO: 7669 - RNA, 738 nt, synthetic construct
  misc_feature 1..738: note = derived and/or modified CDS sequence (opt5) from SFTSV/Phlebovirus(JS2010-019)__JQ317180.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacagccggcgtgagcgaggcgaccacgaaaaccctgatggaagcctactccctttggcaggatgcttttacaaagaccattaatgttaagatgcgcggggccagcaaaacagaggtgtataactctttccgggaccctctgcacgctgccgtcaattccgtgtttttcccgaacgatgtgagagtcaagtggctcaaagccaagggaatcctgggccccgacggggttcctagccgggctgcggaagccgctgccgccgcttaccgcaatctgtga

SEQ ID NO: 7670 - RNA, 738 nt, synthetic construct
  misc_feature 1..738: note = derived and/or modified CDS sequence (opt5) from SFTSV/Phlebovirus(SD24/China/2010 strain SD24)__HM802205.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacagccggcgtgaccgaggcgacgaccaaaacactgatggaagcctacagcctttggcaggatgcttttaccaagacaattaatgttaagatgcgcggggcctccaaaaccgaggtgtataacagcttccgggaccctctgcacgctgccgtcaattctgtgtttttcccgaacgatgtgagagtcaagtggctcaaagccaagggaatcctgggccccgacggggttccttcccgggctgcggaagtggccgctgccgcctaccgcaatctgtga

SEQ ID NO: 7671 - RNA, 738 nt, synthetic construct
  misc_feature 1..738: note = derived and/or modified CDS sequence (opt5) from SFTSV/Phlebovirus(ZJ1/China/2011)__HE663216.1__N
  source 1..738: mol_type = other RNA
atgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtccgcgacacgaaattcattatcgtttttgctcttaccagagggaataagattgtgaaagcctctggaaagatgagcaactccggctctaagcggctgatggccctccaggaaaaatatgggctggtggagaaggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacagccggcgtgagcgaggcgaccacgaaagccctgatggaggcttactccctttggcaggatgcctttaccaagacaattaatgttaagatgcgcggggctagcaaaaccgaagtgtattcttccttccgggaccctctgcacgccgccgtcaacagcgtgtttttcccgaatgatgtgagagtcaagtggctcaaagctaagggaatcctgggccccgacggggttccttctcgggcggccgaagtggctgccgccgcttaccgcaacctgtga

SEQ ID NO: 7672 - RNA, 1287 nt, synthetic construct
  misc_feature 1..1287: note = derived and/or modified CDS sequence (opt11) from ANDV(Chile-9717869)__AF291702.1__N
  source 1..1287: mol_type = other RNA
atgtccaccctccaagaactccaagaaaacatcacagcacacgagcaacaactcgtaactgcccgtcaaaaactcaaagacgcggaaaaagccgtcgaagtcgaccccgacgacgtcaataaatccaccctccaatcacgccgcgccgcagtcagcaccctcgaaaccaaactcggcgaactcaaacgacaactagccgacctcgtagcagcccaaaaactcgcaaccaaacccgtagaccccaccggactagaacccgacgaccacctcaaagaaaaatcctccctaagatacggcaacgtcctcgacgtcaacagcatcgacctagaggaaccaagcggccaaacagcagactggaaagccatcggcgcctacatcctaggattcgccatcccaatcatactcaaagccctctacatgctttccacacgcggacgccaaacggttaaagacaacaaaggcacacgaataagatttaaagacgacagctccttcgaagaagtcaacggcatccgcaaacccaaacacctctacgtatcaatgcccaccgcccaatccaccatgaaagccgaagaaatcacacccggccgattcagaacaatcgcctgcggactcttcccggcccaagtcaaagcccgaaacatcatatcccccgtcatgggagtcatcggcttcggcttcttcgtcaaagactggatggaccgcatcgaagagttcctcgccgccgaatgcccattcttaccaaaaccgaaagtcgcctccgaggctttcatgtctacgaacaaaatgtacttcctcaacagacaacgccaagtcaacgaatcaaaagtccaagacataatcgacttaatcgaccatgcagaaacagaatccgccaccctcttcaccgaaatagccacaccccacagcgtctgggtcttcgcctgcgcccccgaccgatgcccaccaaccgccctatatgtagccggcgtacccgaactcggcgccttcttctcaatcctccaagacatgaggaacaccatcatggcatccaaatcagtaggcaccgccgaagaaaagctaaagaagaaaagcgcattctaccaaagctacctacgacgcacccaatcaatgggaatccaactcgaccagaaaatcataatcctatacatgctctcctggggaaaagaagcagtaaaccacttccacctaggcgacgacatggaccccgaactccgccaactcgcccaatcactcatcgacactaaagtaaaagagatatccaaccaagaaccactcaaactataa

SEQ ID NO: 7673 - RNA, 1287 nt, synthetic construct
  misc_feature 1..1287: note = derived and/or modified CDS sequence (opt11) from ANDV(Nort)__AF325966.1__N
  source 1..1287: mol_type = other RNA
atgtccaccctccaagaactacaagaaaacatcacagcccacgagcaacaactcgtcacagcccgacaaaaactcaaagacgctgagaaaaccgtcgaagtagaccccgacgaagtcaacaaaagcaccctccaaagccgccgtgccgccgtaagcacactcgaaaccaaactcggcgaacttaaacgccaactagccgacctagtcgccgcccaaaaactcgccaccaaacccgtcgacccaaccggcctcgaacccgacgaccacctaaaagagaaaagctcactccgctacggaaacgttctagacgtcaactcaatcgacctcgaagaaccctccggacaaaccgccgactggaaagccatcggagcctacatactaggattcgcaatccccatcatactcaaagcactatacatgctatcaacccgcggacgacaaaccgtcaaagataacaaaggcacccgcattagattcaaagacgacagcagcttcgaagaagtaaacggcatccgcaaaccaaaacatctttacgtctcaatgccaaccgcccagtcaacaatgaaagccgaagaaatcacacccggacgcttcaggaccatagcctgcggacttttccccgcccaagtcaaggcacgcaacataataagccccgtcatgggagtcatcggcttttccttcttcgtcaaagactggatggaacgaatcgaagacttcctagccgccgaatgcccattcctccccaaacccaaagcactctccgaagcattcatggcaactaacaaggcctacttcctcaaccggcaacgacaagtaaacgacagtaaggtccaagacatagtagacctcatcgaccacgccgaaatcgaatccgccactctcttcaccgacatcgccacaccccacagcgtctgggtattcgcctgcgcacccgacagatgcccacccaccgccctatacgtcgccggcgtccccgaactcggcgccttcttcgccatcctacaggacatgcgcaacaccatcatggcctccaaatccgtcggcaccgccgaagaaaaactcaaaaagaaaagcgcgttctaccaatcatacctccgccgcacacaatacatgggcatccaactcgaccagaaaatcatcatactctacatgctatcctggggcaaagaagccgtaaaccatttccacctaggcgacgacatggacccggagctcagacaactagcccaatccctaatcgacacaaaagtaaaagaaataagcaaccaagaaccactcaaactctaa

SEQ ID NO: 7674 - RNA, 1287 nt, synthetic construct
  misc_feature 1..1287: note = derived and/or modified CDS sequence (opt11) from ANDV(CHI-7913)__AY228237.1__N
  source 1..1287: mol_type = other RNA
atgtccactctccaagaactccaagaaaacatcacagcccacgaacaacaactcgttacagcccgccaaaaactaaaagatgcagaaaaagccgtagaagtcgacccagacgacgtaaacaaatcaaccctacaaaaccgtcgagccgccgtctccaccctcgaaaccaaactaggagagctcaaaagacaactagccgacctcgtcgccgcccaaaaactcgctacaaaacccgtggatcccaccggactcgagccagacgaccacctcaaagaaaaatcatccctccgctacggaaacgtactcgacgtaaactcaatcgacctcgaagaaccaagcggacaaacagcagactggaaagccatcggcgcctacatcctcggattcgccatccccatcatcctaaaagccctctacatgctctcaacccgaggccgacaagcagtaaaagacaacaaaggcacccgcataagattcaaagacgattcatccttcgaagaagtcaacggcatccgcaaacccaaacacctctacgtatcaatgccaaccgcccaatccaccatgaaagccgaagaaatcacgccaggccgattcagaaccattgcctgcggcctcttccccgcacaagtcaaagcacgcaacatcatctcacccgtcatgggagtcattggcttcggcttcttcgtcaaagactggatggaccgcatcgaagagttcctcgccgccgaatgcccgttcctccccaaaccgaaagtcgcctccgaagccttcatgtcaaccaacaaaatgtacttcctaaaccgccagcgccaagtcaatgaatccaaagtccaagacataatcgacctcatcgaccacgcagaaacagaatcagccaccctcttcacagaaatcgcaacaccccactccgtctgggtattcgcctgcgcacccgaccgctgcccacccaccgccctctacgtagcgggcgtcccagaactcggcgccttcttctccatcctacaagacatgcgcaataccataatggcctcaaaatccgtcggcaccgctgaagaaaaactaaagaagaaatccgccttctaccaatcatacctccgtcgaacacaatccatgggcatacaactcgaccagaaaatcatcatcctctacatgctctcctggggaaaagaggcagtcaaccacttccacctcggcgacgacatggacccagaactccgccaactagcacaatccctaatcgacacaaaagtcaaagaaatttcaaaccaagaaccactcaaactataa

SEQ ID NO: 7675 - RNA, 1287 nt, synthetic construct
  misc_feature 1..1287: note = derived and/or modified CDS sequence (opt11) from ANDV(9718133)__AF482712.1__N
  source 1..1287: mol_type = other RNA
atgtccaccctccaagaactccaagaaaacatcacagcacacgaacaacaactcgtaacagcacgccaaaaactcaaagacgccgaaaaagcagtcgaagtagaccccgacgacgtaaacaaaagcaccctccaaaaccgccgcgccgcagtctccacactcgaaacaaaactcggagagctcaaaagacaactagcagacctcgtcgccgcccaaaaactcgccaccaaacccgtcgacccaacaggcctcgaacccgacgaccacctcaaagaaaaatcatcactccgatacggcaacgtgctagacgtcaactccatcgacctcgaagaaccctccggccaaaccgccgactggaaagccataggcgcctacatcctcggctttgccatccccatcatcctcaaagccctatacatgctatccacgcgcggccgccaaaccgtgaaagacaacaagggaacacgcatccgcttcaaagacgactcctccttcgaagaagtcaacggcatacgaaaacccaaacacctctacgtctccatgcccaccgcccagtctaccatgaaagcagaagaaataaccccaggacgcttccgcaccatagcctgcgggctattcccagcacaagtaaaagcccgaaacatcatctcccccgtgatgggagtcatcggcttcggcttcttcgtcaaagactggatggaccgcatcgaagagttcctagcagccgaatgcccattcctacccaaacccaaggtagcgtccgaagccttcatgtcaacaaacaaaatgtacttcctcaaccgccagcgccaagtcaacgaatccaaagtccaagacatcatcgacctgatcgatcacgccgaaaccgaatcggccaccctattcaccgaaatagccacgccccacagcgtctgggtattcgcctgcgcaccagaccgctgcccacccaccgccctatacgtcgccggagtccccgaactcggcgccttcttcagcatactacaagacatgcgaaacaccataatggcatccaaaagcgtaggcaccgccgaagaaaaacttaaaaagaaaagcgcattctaccaatcctacctgcgcagaacccaaagcatgggcatacaactcgaccagaaaatcataatactatacatgctatcctggggcaaagaagcagtcaaccacttccatctaggcgacgacatggaccccgaactgagacaacttgcccaaagtctcatcgacacgaaagtaaaagaaatctccaaccaagaaccactcaaactataa

SEQ ID NO: 7676 - RNA, 1278 nt, synthetic construct
  misc_feature 1..1278: note = derived and/or modified CDS sequence (opt11) from Araraquara virus(9480)__KP202360.1__N
  source 1..1278: mol_type = other RNA
atgtccaacctccaagaactccaagaaaacatcacagcccacgaacaacagctagtcacagcacgccaaaaactcaaagacgccgaaaaagcagtcgacgtcgaccccgacgaagtcaacaaatcaacactgcaaggcagacgcgccgcagtctccaccctcgaaaccaaactcggcgagctaaaacgtcaactagccgacttagtcgccgcacaacgcctagcctccaaaccggtagacccaaccggcatcgaacccgacgaccacctaaaagaaaagtccagcctccgctacggcaacgtactcgacgtcaactccatcgacctcgaagaaccatccggccaaaccgcagactggaaagcaatcggcgcctacatcctcggcttcgccatccccataatcctcaaagcactctacatgctatccacccgcggccgccaaaccgtcaaagacaacaaaggcacccggatccgattcaaagacgactccagcttcgaagaagtaaacggcatccgcaagcccaaacacctctacatctccatgcccaccgcccaatccaccatgaaggccgaagaaatcaccccaggcagattccgaaccatcgcctgcggactctttcccgcacaagtaaaagcccgaaacatcatctccccagtgatgggcgtcataggcttcgcctttttcgtcaaagactggatggaaagaatcgaagacttcctagcctccgaatgccccttcctacccaaacccaaaaacccctccgaagcattcatggcaaccaacaaagcctacttcctcaaccgacagaaacaggtagacgaatcccaagtccccgacatcgtcgacctcatcgaccacgccgaagcagaatccgcaaccctcttcaaagaaatcgcgtccccacattccgtatgggtcttcgcatgcgctcccgacagatgcccacccaccgccctctacgtggccggcatgcccgaactaggagccttcttcgccatactccaagacatgcgcaacaccatcatggcctccaagagcgtcggcaccgccgaagaaaaactcaaaaagaaatccgccttctaccaatcctatctccgccgaacccagtctatgggaatccagctagaccagaaaatcatcatcctctacatgctgtcctggggcaaagaagcagtcaaccacttccacctcggcgacgacatggaccccgaattgcgccaattagcccaatccctaatcgacaccaaagtaaaagaatcccaaaccaaatccctataa

SEQ ID NO: 7677 - RNA, 1287 nt, synthetic construct
  misc_feature 1..1287: note = derived and/or modified CDS sequence (opt11) from Araraquara-like virus(P5/Cajuru)__EF571895.1__N
  source 1..1287: mol_type = other RNA
atgtcaaaccttcaagaactccaagaaaacatcacagcccacgaacaacaactcgtaaccgcccgacaaaaactcaaagacgccgaaaaagccgtcgatgtcgacccagacgaagtcaacaaatccacactccaaggtcgccgcgcagccgtatccactctcgaaaccaaactcggcgaactcaaacgccaactcgccgacctggtcgcggcccaaagactcgcctccaaacccgtcgacccaaccggcatagaaccagacgaccacctaaaagaaaaatcaagccttagatacggcaacgtcctcgacgtcaaccccattgacctagaggaaccgtcagggcaaacagccgactggaaagccatcggcgcctacatactaggcttcgccatccccatcatcctcaaagcactatacatgctctccacccgaggccgccaaaccgtcaaagacaacaaaggaacaagaatccgattcaaagacgacagctccttcgaagaagtcaacggcatacgcaaacccaaacacctctacatatcaatgcccaccgcccaatccaccatgaaagcagaagaaatcacccccggccggttccgcaccatcgcctgcggcctcttccccgcgcaagtcaaagcacgcaacatcatctcacccgtcatgggcgtcatcggattcggattcttcgtaaaagactggatggaacgcatcgaagacttcctcgcctccgaatgcccattcctccctaaacccaaaaacccctccgaagcattcatggccaccaacaaagcctacttcctcaaccgacaaaaacaagtcgacgaatcccaggtacccgacatcgtcgacctcatcgaccacgcagaagccgaatccgcaacactcttcaaggaaatagcctcaccccactcagtctgggtcttcgcctgcgccccagaccgatgcccacccaccgcactatacgtcgccggcctccctgaactaggtgccttcttcgccatactacaagacatgcgcaacaccataatggcgtccaaatccgtcggcaccgccgaagaaaaactaaagaagaaatcagccttctaccaaagctacctccgccgcacacaatcaatgggcatccaactcgaccagaaaataatcatactatacatgctgtcctggggaaaagaagcagtcaatcacttccacctaggcgacgatatggaccccgaactcagacaactcgcccaatccctcatcgacacaaaagtcaaagaaatctccaaccaaggccccctcaaactataa

SEQ ID NO: 7678 - RNA, 1287 nt, synthetic construct
  misc_feature 1..1287: note = derived and/or modified CDS sequence (opt11) from BMJV(Oc22531)__AF482713.1__N
  source 1..1287: mol_type = other RNA
atgtccaccctacaagaactacaagaaaatataacagcccacgaacaacaactcgtaaccgcacgccaaaaactaaaagacgctgagaaaactgtcgaagtagaccccgacgaagtcaacaaaagcacactccaatctcgtcgcgccgccgtctcaacactagaaacaaaacttggagaactcaaacgccaactcgcagacctagtagcagcccaaaaactcgcaaccaaacccgtcgaccccactggcctcgaaccagacgaccatctcaaagaaaaatctagcctccgatacggtaacgtactagacgtcaactccatcgacctcgaagaaccctccggccaaaccgccgactggcgttccatcggagcatacatactaggtttcgccatccccatcatcctcaaagcactctacatgctatccacccgaggccgccaaacagtcaaagacaacaaaggaacccgaatccgcttcaaagacgactcctccttcgaggaagtaaacggcatcagaaaacccaaacacctctacgtctcaatgcccacagcccaatcaaccatgaaagccgaagaaatcactccaggccgattccgcaccatcgcatgcggcctcttcccagcacaagtcaaagcccgcaacatcatcagccccgtaatgggcgtcatcggcttctccttcttcgtcaaagactggatggaacgaatcgaagacttcctcgccgccgaatgccccttcctccccaaaccaaaggctccatcagaggctttcatggcaaccaacaaagcatacttcctcaaccgtcaacgccaagtaaacgaatcaaaagtccaagacatcgtcgacctcatcgaccacgcagaaacagaatccgccaccctattcacagacatagccactccccactccgtatgggtcttcgcatgcgcacccgaccgatgcccacccaccgcactatacgtcgcaggcgtcccagaactcggcgcattcttcgctattctccaagacatgcgcaacacaatcatggcatcaaagtcagtcggaaccgccgaagaaaaactcaaaaagaaatccgccttctaccaatcctacctacgccgcacccaatcaatggggatccaactcgaccagaaaattatcatcctatacatgctctcttggggcaaagaagcagtaaaccacttccacctcggcgacgacatggacccagaactacgccaactagcccaatcgctcatcgacacaaaagtcaaagaaataagcaaccaagaacctctcaaactctag

SEQ ID NO: 7679 - RNA, 1287 nt, synthetic construct
  misc_feature 1..1287: note = derived and/or modified CDS sequence (opt11) from LECV(22819)__AF482714.1__N
  source 1..1287: mol_type = other RNA
atgtcaacactacaagaactccaagaaaacatcacagcccacgagcaacagctcgtcaccgcacgccaaaaactcaaagacgccgagaaaaccgtcgaagtagaccccgacgaagtaaacaaatcaacactccagtcccgacgcgccgccgtatcaaccctcgaaaccaaactaggcgaactcaagcgccaactcgccgacctagtcgccgcccaaaaactcgccaccaagcccgtcgaccccaccggcctcgaacccgacgaccacctcaaagaaaagtcgtcgctcagatacggcaacgtcctcgacgtcaacagcatagacctcgaagaaccatcaggccaaacagccgactggcgctccatcggagcttacattctcggattcgccatccctataatcctcaaagccctatatatgctctccacacgcggacgccaaaccgtcaaagacaacaaaggcacccgtatccgctttaaagacgactcttcattcgaagaagttaacggcatacgaaagcccaaacacctatacgtctccatgcccaccgctcaatccaccatgaaagccgaagaaatcacccccggccgctttcgcacaatcgcctgcggcctcttccccgcccaagtcaaggcacgaaacattatctcccccgtcatgggcgtcatcggattctccttcttcgtaaaagactggatggaacgcatagaagacttcctcgccgccgaatgcccattcctcccaaaacccaaagcaccctccgaagcctttatggcaaccaataaagcctacttcctaaacagacaacgccaagtcaacgaatccaaagtacaagaaatcgtagacctcatagaccacgccgaaaccgaatccgccaccctattcaccgacatcgcaacaccccacagcgtctgggttttcgcttgcgcccccgaccgctgcccacccaccgccctctacgtcgccggagtccccgaactcggcgctttcttcgccatactacaagacatgcgcaacaccatcatggcttcgaaatccgtcggcaccgccgaagaaaaactcaagaagaaaagcgcattctaccaatcatacctacgccgaacccaatccatgggcatacaacttgaccagaaaataataatcctatacatgctttcatggggcaaagaggccgtcaaccacttccacctcggcgacgacatggaccccgaactcagacaactagcccaatccctaatcgacaccaaagtaaaagagatatccaaccaagaacccctcaaactataa

SEQ ID NO: 7680 - RNA, 1287 nt, synthetic construct
  misc_feature 1..1287: note = derived and/or modified CDS sequence (opt11) from MCLV(13796)__AF482716.1__N
  source 1..1287: mol_type = other RNA
atgtccaacctccaagaactccaagaaaacattaccgcccacgaacaacaactcgtcaccgcccggcaaaaacttaaagacgccgaaaaagcagtagacgtcgacccagacgaagtcaacaaaagcaccctgcaaggcagacgagccgccgtcagcaccctggaaaccaaacttggcgaactcaaacgccaactcgccgacctagtcgcagcccaaaaactggccaccaaacccgtcgacccaaccggcatcgaacccgacgaccacctcaaagaaaaatcaagcctacgatacggcaacgtactagacgtcaactcaatcgacctcgaagaaccctccggccaaaccgccgactggaaagccatcggcgcctacatactcggcttcgcaatccccatcatcctaaaagcactatacatgctttccacccgcggccgacaaacagttaaagacaacaaaggcacacgcatccgcttcaaagacgactcctcattcgaagaggtcaacggcatacgcaaaccaaaacacctttacatcagcatgcccaccgcacaatcaaccatgaaggcagaagaaatcacacccggccgcttccgcaccatcgtatgcggcctcttccccgcccaagtcaaagcacgcaacataatctccccagtaatgggcgtcatcggcttctccttcttcgtaaaagactggatggaacgcatcgaaggcttcctcgccgccgaatgcccattcctgcccaaaccgaaaacagccgccgaaaccttcatggccaccaacaaagcctacttcttcaacagacaacgccaagtcgacgaatcccaagtcccggacatcgtagaactaatagaccaggccgaatccgaatcagcaacactcttcacagaaatcgccagccctcactccgtatgggtcttcgcctgcgcaccagaccgctgcccacccaccgccctatacgtagcaggagtccccgaactcggcgccttcttcgccatcctacaagacatgcgaaacaccatcatggcctcaaaatcagtcggcaccgccgaagaaaaactcaagaaaaagtcagcattctaccagtcatacctccgacgaacccaatcaatgggaatccagctagaccagaagatcatcatcctgtacatgctctcgtggggaaaagaagccgtaaaccacttccacctaggcgacgatatggaccccgagctccgacaactcgcccaggccctcatcgacaccaaagtcaaagaaatctccaaccaggagcccctcaaactctaa

SEQ ID NO: 7681 - RNA, 1287 nt, synthetic construct
  misc_feature 1..1287: note = derived and/or modified CDS sequence (opt11) from Neembucu(Neembucu)__DQ345763.1__N
  source 1..1287: mol_type = other RNA
atgagcactctccaagaactccaagaaaacatcaccgcacacgaacaacaactcgtcacagcccgccaaaaactcaaagacgcagagaaaaccgtcgaagtagaccccgacgaagtaaacaaatccaccctccaatcccgtcgcgcagccgtaagcaccctcgaaaccaaactcggagaactcaaacgccaactcgcagacctggtcgccgcccaaaaactagccacacgccccgtcgaccccaccggcctcgaaccagacgaccacctcaaagaaaaatcctccctgcgatacggaaacgttctcgacgtcaacagcatcgacctagaagaaccatcaggccaaaccgcagactggcgctccatcggcgcatacatcctcggcttcgctattcccataatcctaaaagccctctacatgctatccactcgcggacgacaaacagtcaaagacaacaaaggaacacgcatacgctttaaagacgactcctccttcgaagaagtaaacggaatacgcaagcccaaacacctctacgtatccatgcccacagcccaaagcacaatgaaagcagaagaaataacccccggacgcctccgaacaatcgcctgcgggttattcccagcccaagtcaaggcccgcagcatcatatccccagtcatgggcgtcatcggattcagcttcttcgtcaaggactggatggaaagaatcgaagacttcctagcagccgaatgccccttcctgccgaaacccaaagccccctccgaagccttcatggcaaccaacaaagcatacttcctcaaccgccaacgccaagtcaacgaatcaaaggtgcaagacatagtcgacctaatagaccacgccgaaaccgaatccgccaccctcttcaccgacatagcaactccccactccgtctgggtattcgcctgcgccccagaccgctgcccacccaccgcactctatgtcgccggcgtcccagaactcggcgcgttcttcgccatactacaagacatgcgcaacaccatcatggcctccaagtccgtcggcaccgccgaagaaaagctaaagaagaaatctgcattctaccagtcatacctccgccgaacccaatccatgggcatccaactcgaccagaaaataataatcctgtacatgctgtcatggggtaaagaagctgtcaaccacttccacctaggagacgacatggacccagaactacgccaactcgcccaatcactaatagacacaaaagtcaaggaaatcagcaaccaagaacccctcaaactctaa

SEQ ID NO: 7682 - RNA, 1287 nt, synthetic construct
  misc_feature 1..1287: note = derived and/or modified CDS sequence (opt11) from ORNV(22996)__AF482715.1__N
  source 1..1287: mol_type = other RNA
atgtcaaccctccaagaactgcaagaaaacatcaccgcacacgagcaacaactcgtcaccgctcgacaaaaactcaaagacgcagagaaaaccgtagaagtcgaccccgacgaagtcaacaaatcaacgctccaaagccggcgagccgccgtctccaccctcgaaacaaaactaggcgaactcaaaagacagctagccgacctcgtcgccgcccaaaaactagccacaaaacccgtcgaccccaccggactagaaccagacgatcacctcaaagagaaaagctctctccgctacggcaacgtcctagacgtcaacagcatcgacctcgaagaaccctccggccaaacagcagactggaaagcaattggagcctacatactcggcttcgccatacctatcatactcaaagcactatacatgctctcaacacgcggccgccaaaccgtaaaagacaacaaaggcaccagaatccgcttcaaagacgactccagctttgaagaagtaaacggcatacgcaaacccaaacacctctacgtgtccatgcccacagcccaatccacaatgaaagccgaagaaatcacccccggacgcttcagaaccatagcatgcggactcttcccagcccaggtcaaagcccgcaacatcatatcacccgtcatgggcgtcatcggattcagcttcttcgtaaaagactggatggaacgcatcgaagacttcctcgcggccgaatgccccttcctccccaaacccaaagccctaagcgaagcattcatggccaccaacaaagcatacttcctaaaccgccaacgccaggtcaacgattcaaaagtccaagacatcgtagacctaatcgatcacgcagaaatcgaatcagccaccctcttcaccgacatcgccactccccactccgtctgggtctttgcatgcgcaccagaccggtgcccacccaccgccctttacgtcgccggagtcccagaactcggcgcattcttcgcaatactccaagacatgcgcaacaccatcatggccagcaaatcagtcggaaccgccgaagaaaagctcaaaaagaaatccgccttctaccagtcctacctacgccggacccaatccatgggcatccaactagaccagaaaatcatcatactctacatgctctcctggggcaaagaagccgtcaatcacttccacctaggcgacgacatggacccagaactacgacaactcgcacaatctctcatcgacaccaaagtaaaagaaatcagcaaccaagaaccactaaaactctaa

SEQ ID NO: 7683 - RNA, 1287 nt, synthetic construct
  misc_feature 1..1287: note = derived and/or modified CDS sequence (opt11) from PRGV(14403)__AF482717.1__N
  source 1..1287: mol_type = other RNA
atgtccaccctacaagaactccaagaaaacataacggcacatgaacaacacctcgtcaccgcccgccaaaaactcaaagacgccgagaaaacagttgaagtcgaccccgacgaagtaaacaaatccacactccaatcacgccgcgccgcagtctccaccctagaaaccaaactcggagaactcaaacgccaactagccgacctcgtcgcagcacagaaactcgccgccaaacccgtcgaccccacgggtctcgagcccgacgaccacctaaaagaaaaatccagcctacgctacggtaacgtactcgacgtaaactccatcgatttagaagaaccctccggccaaaccgccgactggaaagccatcggagcctacatcctcggtttcgccatccccataatcctcaaagccctctacatgctctctacacgcggacgtcaaaccgtcaaagacaacaaaggcacccgcataaggttcaaagacgactcctccttcgaagaagtgaacggtatcaggaaaccaaaacacctctatgtctccatgcccaccgctcaatccactatgaaagccgaagaaatcacccccggacgcttccgcaccatagcctgcggcctcttccccgcccaagtcaaagcccgaaacataatctcccctgtcatgggagtcatcggcttcagcttcttcgtaaaagactggatggaacgcatagaagacttcctcgcagccgaatgccccttcctccccaaacccaaaacaacctccgaagccttcatgtcaaccaacaaagcctacttcctaaaccgccaaaggcaagtcgacgaatctcaggtccccgacatcgccgaactcatcgaacaagccgaatccgaatccgccacactcttcaccgaaatcgcctcaccacacagcgtctgggtcttcgcctgcgccccggatcgatgcccacccacagccctctacgtcgctggagtccccgaactcggtgccttctttgccatcctccaagacatgcgaaacacaataatggcctccaaatctgtgggcaccgccgaagaaaaactcaaaaagaaatccgccttctaccaatcctacctccgccgcacccaatccatgggcatccagctcgaccagaaaatcatcatcctctacatgctttcctggggcaaagaagccgtcaaccacttccacctaggagacgacatggaccccgaactccgccaacttgcacaagccctaatcgacacaaaagtcaaagaaatctcaaaccaagagcccctaaaactatga

SEQ ID NO: 7684 - RNA, 1287 nt, synthetic construct
  misc_feature 1..1287: note = derived and/or modified CDS sequence (opt11) from TUNV(FVB554)__JF750419.1__N
  source 1..1287: mol_type = other RNA
atgtccaatctccaagaactacaagaaaacatcaccgcacacgagcaacagctagtaaccgcccgccaaaaactaaaagacgcagaaaaagcagtcgaaatggaccccgacgacgttaacaaaagcaccctccaatccagacgcgccgccgtaagcaccctagaaaccaaactaggcgaactaaaacgccaactcgccgacatggtcgccgcacaaaaactcgccaccaaaccggtcgaccccaccggcctggaaccagacgaccacctcaaagagaaaagctccctacgatacggtaacgtactagacgtgaacagcatcgacctcgaagaaccaagcggccaaacagcagactggaaatccataggcgcctacatcctaggattcgccatcccaatcattctgaaagctctctacatgctctccacccgcggacgccaaaccgtcaaagacaacaaaggaacacgaatccgcttcaaagacgactcatccttcgaagaagtaaacggaatccgcaaacccaaacacctatacgtaagcatgccaacagcacaatccacaatgaaagcagaggaaatcacccccggccggttccgcaccatcgcatgcggcctcttcccagcacaagttaaagcccgaaacataatatcccccgtcatgggcgtcatcggattctctttcttcgtaaaagactggatggaacgaatcgaagacttcctcgccgacgaatgcccattcctcccaaaacccaaatccccaagcgaagcattcatggcgacaaacaaagcatatttcctcaaccgacaaagacaggtaaacgactccaaggtccaagacatcgtagacctcatcgaccacgcagaaaccgaaagcgccaccctcttcacagacatcgcaacaccccacagcgtctgggtattcgcctgcgcccccgaccgatgcccacccaccgcactctacgtcgccggcgtccccgaactcggcgccttcttcgccatcctgcaggacatgcgcaacaccattatggcatcaaagtccgtcggcaccgccgaagaaaaactcaaaaagaaaagcgccttctaccaaagctacctccgccgcacccaatccatgggcatccagctagaccagaaaatcatcatcctctacatgctatcctggggtaaagaagcagtaaaccactttcaccttggcgacgacatggaccccgaactccgccaactcgcccaagcacttatagacaccaaagtaaaagagatcagcaaccaagaacccctgaaactctaa

SEQ ID NO: 7685 - RNA, 1287 nt, synthetic construct
  misc_feature 1..1287: note = derived and/or modified CDS sequence (opt11) from BCCV(BCCV)__AB689163.1__N
  source 1..1287: mol_type = other RNA
atgtcaaacctaaaagaggttcaagacaacataacaacccacgaacaacagctagtagcagcccgacaaaaactcaaagacgcagaacgaaccgtcggcgtagacccggacgacgtcaataaatccaccctacaaaacagacgtgccgccgtctcggcactcgaagctaaaataggcgaactaaaacgccaactcgcagacctcgtcgccgcccaaaaactcgccacaaaaagcgtagaccccaccggaatagaaccagacgaccacctcaaggaaaaatcctccctcagatacggaaacgtcctagacgtcaactcaattgacctagaagaaccctcaggccaaaccgcagactggaaagccatcggcacctacatcctatccttcgtcctccccatcgtcctaaaagccctatacatgctctcaacccgcggacgccaaactgtcaaagaaaacaagggcacacgcatcagattcaaagacgacagttcctacgaagacgtcaacgggattcgcaaacccaaacacctctacgtcagcctcccaaccgcccaatccacaatgaaagccgacgaaataacccccggccgcttcagaaccatcgtctgtggcctcttccccgcccaaataaaagcccgcaacatcatcagccccgtcatgggagtcatcggcttctcattcttcgtcaaagactgggtcgacaaaatcgaagacttcctcagagccgaatgccccttcctcccaaaaccccgcgcccaagccgaatccttcctctcgaccaacggcgcctacttcatgaaccgccaaacccaagtcgaagaatccaaggtccaagacatcctcgacctcattgacacagccgaatccggcggcgccaccctattcgacaacatcgcctctccccaatccgcctggatcttcgcctgcgcaccagaccgatgcccacccaccgccctgtacgtcgccggcgtcccagaactcggtgcattcttctccatactccaggacatgcgcaacacaatcatggccagcaaaagcgtcggaaccgccgaagaaaaactcaaaaagaaatcagccttctaccaatcctacctacgccgaacgcagtctatgggcatccaactcgaccagaaaataatcatcctctacatgataaactggggaaaagaagccgtaaaccacttccacctcggcgacgacatggaccccgaactccggcaactagcccaagccctagtcgacacaaaagtcaaagaaatctcaaaccaagaacccctcaaaatctaa

SEQ ID NO: 7686 - RNA, 1287 nt, synthetic construct
  misc_feature 1..1287: note = derived and/or modified CDS sequence (opt11) from BCCV(BCCV)__L39949.1__N
  source 1..1287: mol_type = other RNA
atgagcaacctcaaagaagtccaggacaacataaccacccacgaacaacaactcgtagcagcgcgccaaaaactaaaagacgcagaacgcaccgtcgaagttgatccagacgacgtcaacaaaagcaccctccagaaccgacgcgcggcagtctcagccctcgaggccaaaatcggagaactcaaacgccaactcgcagatctcgtagccgcccaaaaactcgcaaccaaatccgtcgatccaaccggcatcgaacccgatgaccacctcaaagagaaaagctcgctccgctacggcaacgtcctcgacgtcaactccatcgacctagaagaaccctccggccaaacagcagactggaaagctatcggcacctacatactctccttcgtactacccatagtcctaaaagccctatacatgctcagcacacgcggccgccaaacagtaaaagaaaacaaaggcactcgaatacgcttcaaagatgactcatcctacgaagacgtaaacggcatccgcaaacccaaacacctctacgtctccctgccaaccgcccaatccaccatgaaagcagacgaaatcacacccggccgattcagaaccatcgtctgcggcctcttccccgcccaaatcaaagccagaaacatcatctcccccgtcatgggggtaataggtttctccttcttcgtaaaagattgggtggacaaaatcgaagacttcctccgcgccgaatgcccgttcctgcccaaaccccgcgcccaagccgagagcttcctctccaccaacggcgcctacttcatgaaccgacaaacccaagtagaagaatccaaagtacaagatatcctagacctcatagacacagccgaatccggcggcgcaacactattcgacaacatcgcttccccacaatccgcatggatcttcgcctgcgcccccgaccgctgcccacccaccgcactctacgttgccggcgtccccgaactaggcgcattcttcagcatcctgcaagacatgcgaaacacaatcatggcatccaaaagcgtaggcaccgccgaagaaaaactcaaaaagaaatccgccttctaccaatcctacctacgacgcacccaatcgatgggcatccaactagaccagaaaatcatcatcctgtacatgatcaactggggaaaagaagccgtcaaccacttccacttgggcgacgacatggacccagaactacggcaactcgcacaagcacttgtcgacaccaaagtcaaagaaatctcaaaccaagaacccctcaaaatctag

SEQ ID NO: 7687 - RNA, 1290 nt, synthetic construct
  misc_feature 1..1290: note = derived and/or modified CDS sequence (opt11) from DOBV(DOBV/Ano-Poroia/Afl9/1999)__NC_005233.1__N
  source 1..1290: mol_type = other RNA
atggccaccctagaagaactccaaaaagaaatcaacaaccacgaaggacaactcgtaatcgcacgccaaaaagtcaaagacgccgaaaaacaatacgaaaaagaccccgacgatcttaacaaacgagcactctcagaccgcgaaagcatcgcccaaagcatccaaggaaaaatagacgaactccgccgtcaactcgcagaccgagtcgcagcaggcaaaaacatcggaaaagaacgcgaccctaccggccttgacccaggcgaccacctgaaagaaaaatcaatgctaagctacggcaacgtcatcgaccttaaccacctagacattgacgagccaacaggccaaaccgccgactggctatccatcgtcgtatacctgacctcattcgtagtccccatcctcctaaaagccctctacatgctcaccacccgcggcagacaaacaaccaaagacaacaaaggcatgagaatacgcttcaaagacgacagttccttcgaagacgttaacggcatcagaaaacccaaacacctctttctctccatgcccaacgcacaatcctcaatgaaagccgacgaaatcacacctggccgcttccgaaccgccatctgcggactctaccccgcacaagtcaaagccagaaacctcatctcccccgtcatgtccgtcataggattcctcgccctcgccaaaaactggacagaacgcgtcgaagaatggctagacctaccctgcaaactcttatccgagcccagccccacctccctcacaaaaggcccctcaacaaaccgcgactacctcaaccaacgccaaggtgcactcgcaaaaatggaaactaaagaagcccaagccgtccgcaaacacgccatcgacgccggctgcaacctcatcgaccacatcgacagcccgagctccatctgggtcttcgccggcgcaccagaccgctgcccaccaacctgcctcttcatcgccggcatggcagaactcggcgccttcttcgccgtactccaagacatgcgtaacaccatcatggcaagcaagaccatcggaacctccgaagaaaaacttaagaaaaagtcatcattctaccaatcctacctccgccgaacccaaagcatgggcatccaactagaccagcgcataatcgtcctcttcatggtcgactggggaaaagaagcagtcgattccttccacctcggagacgacatggacccagagctacgaggcctcgcgcaagccctcatagaccaaaaagtaaaagagatctccaatcaagaaccactcaaactctaa

SEQ ID NO: 7688 - RNA, 1290 nt, synthetic construct
  misc_feature 1..1290: note = derived and/or modified CDS sequence (opt11) from DOBV(DOB/Saaremaa/160V)__AJ009773.1__N
  source 1..1290: mol_type = other RNA
atggctacactcgaagaactccagaaagaaataaactcccacgaaggccaactcgtcatcgcccgacaaaaagtcaaagacgccgaaaaacaatacgaaaaagaccccgacgacctcaacaaacgcgcactcagcgaccgcgagtctatcgcccaatccatacaaggcaaaatagacgaactaagaagacaactcgccgaccgcgtagccgccggcaaaaacataggaaaagaacgcgaccccacaggcctcgatcccggcgaccacctcaaagaaaaatcaatgctctcctacggcaacgtcatcgacctcaaccacctcgacatcgacgaacccaccggccaaaccgccgactggttatccatcgtcatctaccttacctccttcgtcgtccctatactactcaaagccctctacatgctcaccacccgaggccgccaaacaaccaaagacaacaaaggcatgcgaatccgcttcaaagacgacagctcattcgaggacgtaaacggaatccggaaacccaaacacctcttcctctccatgccaaacgcccaatccagcatgaaagccgacgaaatcacccccggccgcttccgcaccgccgtctgcggcctctaccccgcacaagtaaaagcccgtaacctaatatcccccgtaatgtcagtaatcggattcctcaccctcgccaaaaactggaccgaacgcgtcgaagaatggctagacctcccctgcaaactactatccgaaccatcccccacctccctcacaaaaggcccctccaccaaccgcgattacctctcccagcgacagggcgccctcgccaaaatggaaaccaaagaagcccaagtcgttcgaaaacacgccatcgacgccggatgcaacatcatagaccacatcgatagcccctcctcaatttgggtcttcgccggagcacccgacagatgcccaccaacctgcctcttcattgcaggcatggcagaactaggcgccttcttcgccgtactacaagacatgcgcaacaccatcatggccagcaaaaccatcggaacaagcgaagaaaaactccgcaagaaatcgagcttctaccaaagctacctccgccgtacccaaagcatgggcatacaactagaccagcgaataatcgtcctcttcatgatcgaatggggaaaagaagcagtagactccttccatctcggtgacgacatggaccccgaaatccgaagcctcgcccaagcactcatcgaccaaaaagtaaaagaaatatccaaccaagaacccctaaaactataa

SEQ ID NO: 7689 - RNA, 1290 nt, synthetic construct
  misc_feature 1..1290: note = derived and/or modified CDS sequence (opt11) from DOBV(Slovakia/400Af/98)__AY168576.1__N
  source 1..1290: mol_type = other RNA
atggccaccctagaagaactccaaaaagaaataaacaaccacgaaggacaactcgtcatagcccgccagaaagtcaaagacgccgagaaacaatacgagaaagaccccgacgacctaaacaaaagagccctctccgaccgcgaatccatcgcacagtccatacaaggtaaaatagacgaactccgccgccaactagccgacagagtagccgccggcaaaaatataggcaaagaaagagaccccacaggcctcgacccaggagaccacctcaaagaaaaatccatgctgagctacggcaacgtcatcgacctcaaccacctagacatagacgaacccacaggacaaacagccgactggctatccatagtagtttacctaaccagcttcgtcgtgccgatactactcaaagcactatacatgctcaccactagaggccgccaaaccacaaaagacaacaaaggcatgcgcatccgcttcaaagacgactcctcattcgaggacgtcaacggcatccgcaaaccaaaacaccttttcctctccatgccaaacgcccaatcctccatgaaagccgacgaaatcacccccggccgcttccgcaccgcaatttgcggactctaccccgcacaagtcaaagcccgcaacctaatcagcccagtaatgtcagtcataggatttctcgccctcgccaaaaactggaccgaacgcgtcgaagaatggctcgacctcccctgcaaacttctgagcgaaccctcaccaacaagcctcacaaaaggcccctccaccaaccgcgactacctaaaccaacgccaaggagcactcgccaaaatggaaacaaaagaagcccaagccgtccgcaaacacgccatagacgccggctgcaacctaatcgaccacatcgacagccccagctccatatgggtgttcgccggcgcccccgacagatgccctcccacatgcctcttcatagctggcatggccgaactcggcgccttcttcgccgtactgcaagacatgcgaaacaccatcatggcctccaaaacaattggaacatccgaagaaaaactcaaaaagaaatccagcttctaccaatccctactccgacgcacccaatcaatgggaatccaactcgaccaacgcataattgtcctcttcatggtcgactggggcaaagaagcagtcgacagcttccacctcggcgatgacatggaccccgaactacgaggactcgcccaagcactcatagaccaaaaagtcaaagaaatatccaaccaagaaccccttaaactctaa

SEQ ID NO: 7690 - RNA, 1290 nt, synthetic construct
  misc_feature 1..1290: note = derived and/or modified CDS sequence (opt11) from DOBV(Slovakia-856-Aa)__AJ269549.1__N
  source 1..1290: mol_type = other RNA
atggcaacactagaagaactccaaaaagaaatcaactcccacgaaggccagctagtcatagcccggcaaaaagtaaaagacgcagaaaaacaatacgaaaaagacccagacgacctaaacaaacgagccctctccgaccgagaatccgtcgcccaatccatacaatcaaaaatcgacgaactccgacgccaactcgccgaccgcgtcgcagccggcaaaaacatcggaaaagaacgcgacccaacaggactcgaccccggagaccacctcaaagagaaaagcatgctatcatacggcaacgtcatcgacctcaaccacctcgatatcgacgaacccaccggccaaaccgcagactggctctccatcgttgtctacctaacctccttcgtcgtccccatcctcctaaaagccctttacatgctcactacccgcggtcgacaaaccacaaaagacaacaaaggcatgcgcatcagattcaaagacgactccagcttcgaagacgtgaacggaatccgcaaacctaagcacctattcctctctatgcctaacgcccaatccagcatgaaagccgacgaaatcaccccgggccgcttccgcaccgccatctgcggcctctaccccgcacaagtcaaagccagaaacctcgtgagccccgtcatgtcagtaataggattcatggcactcgccaaaaactggaccgaacgggttgaagagtggctggacctgccctgcaaactactatccgaaccaagcccaacctccctcaccaaaggcccctcaacaaaccgcgactacctaaaccaacgccaaggcgccctagcaaaaatggaaaccaaagaagcccaagccgtacgaaaacacgccatcgacgccggatgcaacatcatcgaccacattgacagcccctcctccatatgggtcttcgcccccgcccccgaccgctgcccacctacatgcctattcatcgcaggcatggcagaattgggagcgttcttttccgtactacaagacatgcgaaacaccataatggcctcaaaaaccatcggcacctcagaagaaaagctccgcaagaaatcatccttctaccaatcctatctaagacgaacccaatccatgggcatccaactggaccaacgcataatcgtcctcttcatggtcgactggggcaaagaagccgtcgactccttccacctcggagacgacatggaccctgaactccgcggcctagcccaagccctaatcgaccaaaaagtcaaagaaatctccaaccaggaacccctcaaactctaa

SEQ ID NO: 7691 - RNA, 1290 nt, synthetic construct
  misc_feature 1..1290: note = derived and/or modified CDS sequence (opt11) from DOBV(Slovakia-862-Aa)__AJ269550.1__N
  source 1..1290: mol_type = other RNA
atggccacactcgaagaactacaaaaagaaatcaacagccacgaaggacagctagtcatcgcccgccaaaaagttaaagatgccgaaaaacaatacgaaaaagacccggacgacctcaacaaacgagccctaagcgacagagaatccgtagcccaatcaattcaatccaaaatcgacgaactacgacgccaactcgcagaccgcgtcgccgccggcaagaacatcggaaaggaacgcgacccaaccggcctcgacccaggagaccacctaaaagaaaagtcaatgctaagctacggcaacgtcatcgaccttaatcacctagacatcgacgaacccacaggccaaaccgctgactggctatcaatcgtagtatacctcacctcattcgtcgtccccatcctcctaaaagcactctacatgctaaccacaagagggcgccaaaccacaaaggacaacaaaggcatgcgcataagattcaaggacgactcctccttcgaagacgtcaacggcatccgcaagcccaaacacctattcctctcaatgcccaacgcccaatcaagcatgaaagccgacgaaataacgccaggccgattccgaaccgcaatctgcggcctctaccccgcacaagtcaaagcccgcaacctagtctcaccagtcatgagcgttatcggcttcatggccctagccaaaaactggaccgaacgcgtcgaagaatggctcgacctgccctgcaaactcctctcagaaccctccccaacatccctaacaaaaggaccctccacaaaccgagactacctcaaccagcgacagggcgcattagcaaaaatggaaacaaaagaagcacaagcagtacgaaaacacgccatcgacgccggctgcaatatcatcgaccacatcgactcacccagctcaatctgggtcttcgccggccgccccgaccgctgcccacccacttgcctcttcatcgcaggcatggccgaactcggagcattcttctcagtcctccaggacatgcgaaacaccatcatggcctccaaaaccataggcaccagcgaagaaaaactccgcaagaaaagctccttctatcaaagctacctacgacgtactcaatccatgggcatccaactcgaccaacgcataatcgtactcttcatggtcgactggggcaaagaagcagtcgactccttccacctaggcgacgacatggacccggaactacgaggcctcgcccaagcgctaatcgaccaaaaagtcaaagaaataagcaaccaggaacccctaaaactataa

SEQ ID NO: 7692 - RNA, 1290 nt, synthetic construct
  misc_feature 1..1290: note = derived and/or modified CDS sequence (opt11) from DOBV(Esl/29Aa/01)__AY533118.2__N
  source 1..1290: mol_type = other RNA
atggccaccctcgaagaactccaaaaagaaattaattcccacgaaggccagctagtcatcgccagacaaaaagtcaaagacgccgaaaaacaatacgaaaaagaccccgacgacctcaacaaacgcgccctctcagaccgcgagtccgtagcacaaagcatccaatcaaaaatcgacgaactacgccgccaactcgccgaccgtgtcgccgccggcaaaaacatcggaaaagaacgcgaccccacaggcctcgaccccggagaccacctcaaagaaaaatcaatgctctcctacggcaacgtcatcgacctcaaccacctagacatcgacgaacccacaggccaaaccgccgactggctatcaatagtcgtctacctaacctctttcgtcgtccccatcctcctcaaagccctctacatgctaacaaccagaggccgccaaaccaccaaagacaacaaaggcatgaggatacgcttcaaagacgactcatcattcgaagacgtcaacggcatacgaaaacccaaacacctcttcctatcaatgcccaacgcccaaagctccatgaaagcagacgaaataacccccggacgcttccgcaccgcaatctgtggcctataccccgcacaagtaaaagcacgcaacctcgtatcaccagtcatgtccgtaattggattcctagctctcgccaaaaactggaccgaacgcgtcgaagaatggctagacctcccctgcaaactcctctccgaaccctcccccaccagcctaaccaaaggcccctcaaccaaccgggactacctcaaccaacgccaaggagcgctagccaaaatggaaaccaaagaagcacaagcagtacgaaaacacgcaatagacgccggctgcaacataatcgaccacatcgactcaccctcctccatctgggtcttcgccggcgcaccagaccgatgcccaccgacctgcctatttatcgccggcatggccgaactcggagccttcttctccgtcctccaagacatgcgcaacaccataatggccagcaaaaccataggcacctccgaagaaaaactccgcaagaaatccagcttctaccagtcatacctccgccgcacacaatctatgggcatccaactagaccagcgaatcatcgtcctattcatggtagactggggcaaagaagccgtcgactcctttcacctaggcgacgacatggaccccgaactccgcggcctcgcacaagccctcatcgaccaaaaagtaaaagaaatctccaaccaagagcccctcaaactctaa

SEQ ID NO: 7693 - RNA, 1290 nt, synthetic construct
  misc_feature 1..1290: note = derived and/or modified CDS sequence (opt11) from DOBV(Kurkino/44Aa/98)__AJ131672.1__N
  source 1..1290: mol_type = other RNA
atggcaacactagaagaactacagaaagagataaactcacacgaaggacaactggtaatcgcaagacaaaaagtcaaggacgcagagaaacaacacgaaaaagaccccgacgacctcaacaaacgcgccctctccgacagagaatccgtcgcacaatccatccaaagcaaaatcgacgagctcagacgacaactcgccgaccgagtagcagcaggcaaaaacatcggcaaagaacgcgacccaaccggcctcgatcccggagaccacctcaaagagaaaagcatgctcagctacggcaacgtgatagacctcaaccacctcgacatagacgagcccaccggccaaaccgcagactggctctccatcgtagtatacctaaccagctttgtagtacccatactcctaaaagcactatacatgctcaccacgcgcggccgacaaaccaccaaagacaacaaaggcatgcgcatccgcttcaaagacgattcctccttcgaagacgtcaacggaatcagaaagcccaaacacctcttcctcagcatgcccaatgcccaaagctccatgaaagccgacgaaatcactcccggccgcttccgcacggcaatatgcggactataccccgcccaagtcaaagcccgcaacctcgtctcaccagtcatgtctgtaatcggattcctagcactggcaaagaactggaccgagcgcgtagaagaatggctcgatctcccctgcaaactcctctctgaaccctccccaacatccctcacgaaaggaccctccaccaaccgcgactacctcaaccaaagacaagccgccctcgccaaaatggaaacaaaagaagcacaagccgtacgcaaacacgcaatagacgccggctgcacaatcatcgactacatcgactccccctcatccatctgggtcttcgccggagccccagaccgctgcccaccaacctgcctctttatcgccggcatggccgaactcggcgcattcttctccgtcctccaagacatgcgcaacaccatcatggcctccaaaaccgtcggaacttccgaagagaaactacgcaagaaatcctcgttctaccaatcctacctaagacgcacccaatccatgggaatccagcttgaccaacgcatcatcgtcctattcatggtcgactggggcaaagaagcagtcgactcctttcacctgggagacgacatggaccctgaactcagaggcttagcacaagcactaatcgaccaaaaagtcaaagaaatctccaaccgagaacccctcaaactataa

SEQ ID NO: 7694 - RNA, 1290 nt, synthetic construct
  misc_feature 1..1290: note = derived and/or modified CDS sequence (opt11) from DOBV(Kurkino/53Aa/98)__AJ131673.1__N
  source 1..1290: mol_type = other RNA
atggcaactctcgaagaactccaaaaagaaatcaactcccacgaaggccaactcgtcatcgcccgacaaaaagtaaaagacgccgaaaaacaatacgaaaaagacccagacgacctaaacaaacgagccctaagcgatcgcgagtctgtggcacagagcatccaatctaaaatcgacgaactccgccgccaactagccgaccgagtcgccgccggcaaaaacatcggcaaagaacgcgaccccaccggcctggacccaggagaccacctaaaagaaaaatcaatgctctcttacggcaacgtcatcgacctgaaccacttggacatcgacgagccaaccggccaaacagcagactggctcagcatcgtcgtatacctcacatccttcgtcgttcccatcctcctcaaagcactatacatgctaaccacacgaggccgacaaacaaccaaggataataaaggcatgcgcatccgcttcaaagacgactcctcattcgaggacgtcaacggcatccgaaaacccaaacacctcttcctctctatgcccaacgctcaatcctccatgaaagccgacgaaataaccccaggcaggttccgaacagccatctgcggcctctacccagcccaagtaaaagcccgaaacctagtctcccccgtaatgtcagtcatcggcttcctagccctcgccaaaaactggacagaacgcgtagaagaatggcttgacctcccatgcaaactcctctccgaaccctcccccacctccctcaccaaaggcccctccaccaaccgcgactacctcaaccaacgccaagccgccctcgccaaaatggaaaccaaggaagcccaggccgtccgcaaacacgcaatagacgccggctgcaccatcatcgaccacatcgacagcccaagcagcatctgggtcttcgccggcgcccccgacaggtgcccaccaacctgcctattcatcgccggaatggcagagctaggcgctttcttctcagtactccaagacatgcgcaacaccatcatggcatccaaaaccgtcggcacctccgaagaaaaacttcgaaagaaaagctcattctaccaaagctacctccgccgaacccaatccatgggcatacaactcgaccaaaggataatagtcctattcatggtcgactggggcaaagaagccgtcgactcattccacctaggcgacgacatggaccccgaactcagaggccttgctcaagccctcatcgaccaaaaagtcaaagaaatctcaaaccgcgaaccccttaaactctaa

SEQ ID NO: 7695 - RNA, 1290 nt, synthetic construct
  misc_feature 1..1290: note = derived and/or modified CDS sequence (opt11) from DOBV(Saar/90Aa/97)__AJ009775.1__N
  source 1..1290: mol_type = other RNA
atggccacactcgaagaactccaaaaagagatcaactcccacgaaggtcaactcgtcatagcccgacaaaaagtaaaagacgccgaaaaacaatacgaaaaagaccccgacgacctaaacaaacgagccctctccgaccgcgaatccatcgcccaatcaatccaaggaaaaatcgacgaactccgccgacaactcgccgaccgcgtcgccgcaggcaaaaacatcggacgcgagcgagaccccacaggcctcgaccccggagaccacctcaaagaaaaatccatgctcagctacggcaacgtaatagacttaaaccaccttgacatcgacgaaccaaccggccaaacagcagactggctaagcatcgtcatttacctaacctccttcgtcgtccccatcctactcaaagccctatatatgctcaccacccgcggccgccaaaccaccaaagacaacaaaggtatgcgcatcagattcaaagacgactcctccttcgaagacgtcaatgggatccgcaaacccaaacacctcttcctatccatgccaaacgcacaatcctcaatgaaggccgacgaaatcacccccggacgcttccgaactgcagtctgcggcctctaccccgcccaagtcaaagccagaaacctcatatcccctgtaatgtccgtcatcggcttcctcaccctagccaaaaactggaccgaacgcgtagaagaatggctcgacctaccctgcaaactactctccgaacccagccccacatcactaaccaaaggcccatccaccaaccgcgactacctctcacaacgccaaggcgcactcgctaaaatggaaactaaagaggcccaagccgtccgcaaacacgccatcgacgccggatgcaatataatcgaccacatagactccccatcctcaatctgggtattcgccggggcgcccgaccgatgcccacccacatgcctcttcatagccggcatggccgaactcggagcctttttcgccgtcctccaagacatgcgaaacaccatcatggcctctaaaacaataggcaccagcgaagaaaaactcagaaagaaatcctccttctaccaatcctacttacgccgcacccaaagcatgggcatacaactcgaccaacgcatcatcgtcctcttcatgatagaatggggcaaagaagccgtcgactccttccacctaggcgacgacatggatcccgaaatccgctcactcgcccaagccctcatcgaccaaaaagtcaaagaaatctccaatcaagaacccctaaaactctaa

SEQ ID NO: 7696 - RNA, 1290 nt, synthetic construct
  misc_feature 1..1290: note = derived and/or modified CDS sequence (opt11) from DOBV(SK/Aa)__AY961615.1__N
  source 1..1290: mol_type = other RNA
atggccaccctcgaggaactacaaaaagaaatcaactcacacgaaggccaactcgtcatagcccgacaaaaagtcaaagacgccgaaaaacaatacgaaaaagaccccgacgacctaaataaaagaaccctcagcgaccgcgaaagcgtggcccagtccatccaatcaaaaatcgacgaactacgacgccaactcgccgaccgcgtcgcggccggcaaaaacataggaaaagaacgcgaccccaccggcctcgaccccggggaccacctcaaagaaaaatcaatgctgagctacggtaacgtaatcgacctcaaccacctcgacatcgacgaaccaacaggccaaaccgcagactggctcagcatagtagtctacctcacatccttcgtcgtacccatcctcctcaaggccctatacatgctcaccaccagaggaaggcaaacaaccaaagacaacaaaggaatgcgcatacgtttcaaggacgactcctccttcgaagacgtaaacggcatccgcaaacccaaacacctattcctctcaatgccaaacgcccagagctcaatgaaagcagacgaaatcacacccggccgcttccgtaccgccatatgcggactctaccccgcacaagtcaaggcccgcaacctcgtatccccagtaatgtcagtcatcggcttcctcgcactcgccaaaaactggaccgaacgcgtcgaagaatggctagacctcccatgcaaactcctatcagaaccctcgcccacatcactcaccaaaggcccctccacaaaccgagactacctcaaccaacgccaaggagccctcgccaaaatggaaaccaaagaagcccaggccgtccgcaaacacgcaatcgacgccggctgcaacatcatcgaccacatcgactccccttcatcaatctgggtcttcgccggcgcccccgacagatgcccaccaacctgcctattcatagccggaatggcagaactaggagccttcttctccgtactccaagacatgcgtaacaccatcatggccagcaaaaccattggcacgtccgaagaaaaactccgcaagaagtccagtttctaccaatcctacctccgccgcacccaatccatgggcatccaactcgaccaacgaatcattgtccttttcatggtcgactggggaaaagaagcagtagactccttccacctaggagacgacatggaccccgaactacgcggcctcgcccaagcccttatcgaccaaaaagtaaaagaaatctcaaaccaggaacccctaaaactctaa

SEQ ID NO: 7697 - RNA, 1290 nt, synthetic construct
  misc_feature 1..1290: note = derived and/or modified CDS sequence (opt11) from DOBV(A35)__GU904030.1__N
  source 1..1290: mol_type = other RNA
atggcaaccctagaagaactccaaaaagaaatcaacaaccacgaaggacaactggtcatcgcccgacaaaaagtcaaagacgccgaaaaacaatacgaaaaagacccagacgacctcaacaaacgcgccctctccgacagagaatccatcgcccaatccatacaaggaaaaatagacgaactcagacgccaactcgccgaccgcgtcgccgccggcaagaacatcggcaaagaacgcgatccaacaggcctcgaccccggcgaccatctcaaagaaaaatccatgctctcctacggaaacgtcatcgacctcaaccacctagacatcgacgaacccaccggccaaaccgcagactggctctccatcgtcatctacctcacatccttcgtcgttccaatccttctaaaagccctctacatgctcaccacccgcggccgacaaacaacaaaagacaacaaaggcatgcgaatacgcttcaaagacgacagcagcttcgaagatgtaaacggcatccgcaaacccaaacacctcttcctaagcatgccaaacgcccaatccagcatgaaggccgacgaaatcacccccggccgcttccgcaccgccatatgcggcctctaccccgctcaagtcaaagcccgcaacctcatatcccctgtcatgtccgtcatcggcttcgtagccctagccaaaaactggacagaacgcgtcgaagaatggctcgacctaccatgcaaactactatccgaaccctcccctacttccctcacaaaaggaccaagcacaaaccgcgactacctcaaccaaagacaaggcgctctcgccaaaatggaaaccaaagaggcacaagcagtccgcaaacacgccatcgacgcaggctgcaacctcatagaccacatcgacagccccagctctatctgggtattcgccggtgcaccagaccgatgcccacccacatgcctcttcatcgcaggcatggccgagctaggagcattcttcgccgtcctccaagacatgcgaaacacaatcatggccagcaaaaccatcggcacgtccgaagaaaaactcaagaagaaatcctccttctatcaatcctacctacgacgcacccaatccatgggcatccaactagaccagcggataatagtactcttcatggtcgactggggaaaagaagccgtggactccttccacctcggagacgacatggaccccgaactccgaggcctcgcccaagcactcatcgatcaaaaagtcaaagaaatctccaaccaagagccactaaaactataa

SEQ ID NO: 7698 - RNA, 1290 nt, synthetic construct
  misc_feature 1..1290: note = derived and/or modified CDS sequence (opt11) from DOBV(3970/87)__L41916.1__N
  source 1..1290: mol_type = other RNA
atggccacactcgaagaactccaaaaagaaatcaacaaccacgaaggacaactcgtaatcgccagacaaaaagtcaaagacgcagaaaaacaatacgaaaaagaccctgacgacctcaataaacgcgcccttagcgaccgagaatcaatcgcgcaatcaatacaaggcaaaatcgacgaactacgccgccagcttgccgatagggtagcagccggcaaaaacataggcaaagaacgcgaccccaccggtctagaccctggcgaccacctaaaagaaaaatccatgctctcctacggcaacgtaatcgacctcaatcacctcgacatcgacgaacccaccggacaaacagccgactggctctcaatcgtcatttacctcaccagcttcgtcgtcccaatcctcctcaaagccctatacatgctcaccacccgcggcaggcaaaccaccaaagacaacaaagggatgagaatccgctttaaagacgactcctcattcgaagatgtcaacggcatacgcaaacccaaacacctcttcctctccatgccaaacgcacaatcatccatgaaagccgacgaaatcacacccggccggttccgcaccgccatctgcggcctctacccggcacaagtaaaagcacgaaacctcatatcccccgtcatgtcagtaatcggcttcgtcgccctcgccaaaaactggactgaacgcgtcgaagagtggctcgacctaccctgcaaactactcagcgagccatcacccacctcactcacaaaaggcccctccactaaccgcgactacctcaaccaacgacagggcgctctcgccaaaatggaaaccaaagaggcccaagccgtacgcaaacacgccatcgacgcgggatgcaaccttatcgaccacatcgactccccctcctccatctgggtattcgcaggagcccccgaccgatgcccgccaacctgcctattcatagccggcatggccgaactcggagccttcttcgcatgcctacaggacatgcgaaacacaatcatggcctccaaaaccatcggcaccagcgaagaaaaacttaaaaagaaatcctccttctaccaatcctacctaagaagaacacaatccatgggcatccaactagaccaacgcatcatcgtcctcttcatggttgactggggaaaagaagccgtagactccttccacctcggcgacgacatggaccccgaactccgcggcctcgcacaagccctaatagaccaaaaagtaaaagaaatctctaaccaagaaccactcaaactataa

SEQ ID NO: 7699 - RNA, 1290 nt, synthetic construct
  misc_feature 1..1290: note = derived and/or modified CDS sequence (opt11) from DOBV(Klyuch-2000)__AF442622.1__N
  source 1..1290: mol_type = other RNA
atggccaccctcgaagaactccaaaaagaaatcaactcccacgaaggccaactcgtcatagcccgacgcaaagtcaaagacgccgaaaaacaatacgaaaaagacccagacgacctaaacaaacgagcactcagcgaccgcgaaagcgtcgcccagtccatacaaggaaaaatagacgaactcagacgccaactagccgaccgggtcgcagcaggcaaaaacattggcaaagaacgcgaccccaccggcctagacccaggcgaccacctcaaagaaaaatccatgctatcatacggaaacgtcatcgacctcaaccaccttgacatcgacgaaccaaccggacaaacggctgactggctaagcatagtcgtatacctcacctcattcgtcgtaccaatattactcaaagccctatacatgctaacaacacggggacgacaaacaaccaaagacaacaaaggaatgcgaatccgcttcaaagacgactcctcattcgaggacgtaaacggaatcagaaaacccaaacacctcttcctgtccatgcccaacgcacaatcctccatgaaagccgacgaaatcacccccggccgcttccgcacagcagtctgcggcctctaccccgcccaagtaaaagcccgaaacctagtaagccccgttatgagcgtcatcggattcgtgagcctagccaaaaactggacagaacgagtcgaagaatggctagatctcccctgcaaactccttagcgaaccgagccccacctcgctaacaaaaggcccctccacaaaccgcgactacctcaaccaacgacaaggcgccctcgccaaaatggaaacaaaagaagcccaggccgtcagaaaacacgccataaacgccggctgcaacctcgtcgaccacattgacagcccaagctccatatgggtattcgccggcgccccagaccgctgcccaccaacctgcctattcgtcgcaggcatggccgaactaggcgcattcttcgccgtcctccaagacatgcgaaacacaatcatggctagcaaaaccataggaacaagcgaagaaaaactccgcaaaaagtcatcattctatcaatcatacctacgacgaacacaatccatgggcatacaactagaccaaagaataatagtcctattcatggtcgactggggcaaagaagccgtcgacagcttccacctaggcgacgacatggaccccgaactacgcggactagcgcaagccctcatcgaacaaaaagtcaaagaaatcagcaaccaagaacccctaaaactctaa

SEQ ID NO: 7700 - RNA, 1290 nt, synthetic construct
  misc_feature 1..1290: note = derived and/or modified CDS sequence (opt11) from DOBV(10636/Ap)__KP878311.1__N
  source 1..1290: mol_type = other RNA
atggccaccctagaagaactccaaaaggaaatcaacaaccacgaaggccagctcgtcatcgcccgtcaaaaagtcaaagacgccgaaaaacaatacgaaaaagaccccgacgacctaaacaaacgagcactatccgaccgcgaaagcgtcgcacaaagcatccaaggcaaaatagacgaactacggcgccaactcgccgacagagtcgcggcaggcaaaaacatcggaaaagaacgcgacccaacaggcctcgaccccggcgaccacctaaaagaaaaatccatgctgtcctacggcaacgtgatagacctaaaccacctcgatatcgacgaaccgaccggacaaaccgcagactggctaagcatcgtcgtatacctaaccagcttcgtagtcccaattctactcaaagccctatacatgctaacaacccgaggaagacaaaccaccaaagacaacaaaggaatgcgaatccgattcaaagacgactccagcttcgaggacgtcaacggaatacggaagccaaaacacctcttcctatccatgcccaacgcacaatcaagcatgaaagcggacgaaataacccccggccgattccgaaccgcagtatgcggtctctaccccgcccaagtcaaagcccgcaacctcgtatcccccgtcatgagcgtaataggcttcgtaagcctcgccaagaactggaccgaacgcgtagaagaatggctggacctcccctgcaaactcctctccgaacccagccccacctcactaacaaaaggcccctccaccaaccgagactacctcaaccaacgacaaggcgccctagccaagatggaaaccaaggaagcccaagccgtccgcaaacacgccatcgacgccggatgcaacctagtcgaccatatcgacagcccatcctcaatctgggtcttcgccggcgcacccgacagatgcccaccaacctgcctcttcgtcgccggcatggcagaactaggcgcattcttcgcagtactacaagacatgcgaaacaccatcatggcttccaaaacaataggcaccagtgaagaaaaacttagaaagaaaagcagcttctaccaatcctacctgcgcagaacccaatccatgggcatccaactcgaccaacgcatcatcgtactcttcatggtcgactggggtaaggaagccgtcgacagcttccacctcggcgacgacatggaccccgaactacgcagcctagcccaagcgctaatagaccaaaaagtaaaagaaatatcaaaccaagaacccctcaaactctaa

SEQ ID NO: 7701 - RNA, 1290 nt, synthetic construct
  misc_feature 1..1290: note = derived and/or modified CDS sequence (opt11) from DOBV(10645/Ap)__KP878312.1__N
  source 1..1290: mol_type = other RNA
atggccacactcgaggaactacaaaaagaaatcaacaaccacgaaggccaactcgtcatcgccagacagaaagtcaaagacgcagaaaaacaatacgaaaaagacccagacgacctcaacaaaagagcactatccgaccgcgagtcagtagcccaatccatccaaggcaaaattgacgaactcagacgccaactagcagacagagtagccgccggcaaaaacatcggaaaagaacgagacccaaccggcctcgaccccggcgaccacctgaaagaaaaatccatgctctcctatggcaacgtcatcgacctcaaccacctagacatagacgaacccaccggccaaaccgctgactggctctccatcgtcgtctacctaacctcattcgtcgtccccatactcctcaaagctctctacatgctaaccacacgtggccgccaaaccacaaaagacaacaaaggaatgcgcatccgattcaaagacgactcctcattcgaagacgtaaacggaatcagaaaacctaaacacctcttcctatcaatgcccaacgcacaaagttccatgaaagctgacgagatcacccccggccgctttcgcaccgccgtatgcggactctatccagcccaagtcaaagcacgcaacctcgtctcccccgtaatgtccgtaataggcttcgtaagcctcgccaaaaactggaccgaaagagtcgaagaatggctcgacctcccctgcaaactactctcagaacccagccccacctcactcaccaagggccccagcaccaaccgagactacctaaaccaaagacaaggtgccctcgccaaaatggaaaccaaagaagcccaagccgtacgcaaacacgccatcgacgccggctgcaatctagtcgaccacatagacagcccatcctcaatatgggtgttcgcaggagcccccgaccgctgcccacccacgtgcctcttcgtcgcaggcatggccgaactcggcgccttcttcgcagtactacaggacatgcgcaacaccatcatggcctccaaaaccatcggcacaagcgaagagaaactccgcaagaaatcatccttctaccaatcctaccttcgccgcacacaaagcatgggcatccaactcgaccaacgcatcatagtactattcatggttgactggggcaaagaagcagtcgactccttccacctcggcgacgacatggaccccgaactccgcggcctagcacaggccctcatcgaccagaaagtaaaagaaataagcaaccaagaacccctaaaactctaa

SEQ ID NO: 7702 - RNA, 1290 nt, synthetic construct
  misc_feature 1..1290: note = derived and/or modified CDS sequence (opt11) from DOBV(Aa1854/Lipetsk-02)__EU188452.1__N
  source 1..1290: mol_type = other RNA
atggccaccctagaagaactccagaaagaaatcaactcacatgaaggccaacttgtaatcgcccgccaaaaagtcaaagacgctgaaaaacaatacgaaaaagatccagacgacctaaacaaacgcgcccttagcgaccgcgaatccgtagcacaaagcatccaatccaaaatcgacgaactccgccgccaactcgccgaccgcgtcgcagcaggtaaaaacatcggcaaagaacgagaccccacaggactcgacccaggagaccacctcaaagaaaaatcgatgctatcctacggaaacgtcatagacctaaaccacctcgacatcgacgagccaaccggccaaaccgccgactggctctccatagtcgtatacctaacctcattcgtagtccccatcctactcaaagccctctacatgctcacaacgcgcggccgacaaacaaccaaagacaacaaaggaatgcgaatccgtttcaaagacgactcctcgtttgaagacgtcaacggcatacgaaaacccaaacacctattcctatctatgcccaacgcccaatccagcatgaaagccgacgagatcacccccggacgcttccgaaccgctatatgcggcctataccctgcccaagtgaaagcccgcaacctcgtctctccagtcatgtccgtcattggcttcctagccctagccaaaaactggacagaacgagtcgaagaatggctagacctaccctgcaaactcctatccgaaccctccccaacctccctaacgaaaggaccatcaaccaaccgagactacctcaaccagcgccaagcagccctagctaaaatggaaaccaaagaagcacaggccgtccgcaaacacgcgatcgacgcgggctgcaccatcatcgaccacatcgactccccctcctcaatctgggtcttcgccggagcccccgacagatgcccacctacctgcctcttcatcgcaggcatggccgaattaggcgccttcttctccgtcctccaggacatgcgcaacaccatcatggcctccaaaccagtgggcacctccgaagaaaaactccgcaagaaaagttccttctaccaatcctacctccgccgaacccaatccatgggcatccaactagaccaacgcatcatagtcctcttcatggtagactggggcaaagaagcagtggacagcttccacctcggcgacgacatggacccagaactgcgcggactcgcccaagctctcatcgaccaaaaagtaaaagagatctcaaaccaagaaccactaaaactctaa

SEQ ID NO: 7703 - RNA, 1290 nt, synthetic construct
  misc_feature 1..1290: note = derived and/or modified CDS sequence (opt11) from DOBV(Ap/Sochi/43)__JF920151.1__N
  source 1..1290: mol_type = other RNA
atggcgacactagaagaactccaaaaagaaatcaataaccacgaaggacagctagtaatcgctcgccaaaaagtcaaagacgccgaaaaacaatacgaaaaagaccccgacgacctcaacaaacgggccctcagcgaccgcgaaagcgtagcccaatccatccaaggcaaaatagacgaactccgccgccaactagccgaccgcgtcgcagccggcaaaaacatcggcaaagaacgtgaccccaccggactggaccccggtgaccacctaaaagagaaaagcatgctatcctacggcaacgtcatcgacctcaaccacctcgacatcgacgaacccaccgggcaaaccgccgactggctaagcatcgtcgtctacctaacctcattcgtcgtccccatcctcctcaaagcactatacatgctcacaacccgcggccgccaaactaccaaagacaataaaggcatgcgtatccgcttcaaagacgacagcagcttcgaagacgtcaacggaatccgcaaacccaaacacttattcctctcaatgccaaacgcacaatcctccatgaaagccgacgaaattacccccggcagattcagaaccgccgtctgcggcctataccccgcacaagtaaaagcccgcaaccttgtctccccagtaatgagcgtcataggattcgtatcccttgccaaaaactggaccgaacgcgtcgaagaatggctcgacctcccctgcaaactcctatccgaaccctcccccacatcactcaccaaaggaccttccaccaaccgcgactacctaaaccaacgccaaggcgccctcgccaaaatggaaaccaaagaagcacaagccgtacgaaaacacgccatcgacgccggctgcaacctcgtcgaccacatcgactcaccatcatccatatgggtcttcgcaggagcccccgaccgctgcccacccacatgcctatttgtagccggcatggccgaactaggagccttcttcgccgtcctccaagacatgcgaaacaccattatggcctccaaaacaatcggcaccagcgaagaaaaactccgcaagaaaagctcattctaccaaagctacctccgccgcacccacagcatgggaatacaactagaccagcgcatcatcgtcctcttcatggtcgactggggcaaagaagcagttgactccttccacctaggcgacgacatggaccccgagctacgcggcctggcgcaagcactcatcgaccaaaaagtcaaagaaatatcaaaccaggaacccctaaaactctag

SEQ ID NO: 7704 - RNA, 1290 nt, synthetic construct
  misc_feature 1..1290: note = derived and/or modified CDS sequence (opt11) from DOBV(Ap/Sochi/hu)__JF920150.1__N
  source 1..1290: mol_type = other RNA
atggccaccctcgaagaactacaaaaagaaatcaacaaccatgaagggcaactggtcatcgcccgccaaaaggtcaaagacgccgaaaagcaatacgaaaaagaccccgacgacctcaacaaacgcgccctctcagaccgcgaatcagtcgcccaatccatccaaggcaaaattgacgaactccgccgccaactcgccgatcgagtagccgccgggaaaaacatagggaaagaaagagacccaaccggactagaccccggcgaccacctgaaagaaaaatccatgttaagctacggcaacgtaatcgacctcaaccacctggacatcgacgaaccgactggccaaaccgccgattggctaagcatagtcgtctacctcacctccttcgtagtcccaatcctcctaaaagccctatacatgctcacaacccgcggaagacaaacaaccaaagacaacaaaggaatgagaatcagattcaaagacgacagctccttcgaggacgtaaacggaatccgcaaaccaaaacacctgttcctcagcatgcccaacgcccaatccagcatgaaagccgacgaaataacccccggacggttccgaaccgctgtctgcggcctttacccagcccaagtcaaagcacgcaacctcgtaagccccgtcatgagcgtcatcggattcctatccctcgccaaaaactggaccgaacgcgtagaagaatggctcgacctcccctgcaaactgctctcagaacccagccccaccagcctcacaaaaggcccctcaaccaaccgcgactatctcaaccaacgccaaggcgcactcgcaaaaatggaaacaaaagaggcacaagcagtccgcaaacacgcgatcgacgcaggctgcaacctcgtagaccacatcgacagccccagctcaatctgggtcttcgcaggagccccagacagatgcccaccaacctgcctcttcgtcgcaggaatggccgaactgggcgcattcttcgccgtactacaagacatgcgcaacacgattatggccagcaagaccataggcaccagcgaagaaaaactaagaaagaaaagcagcttctaccaatcatacctccgcagaacccacagcatgggcatccaactcgaccaaagaataatcgtactcttcatggtggactggggcaaggaagccgtagacagcttccacctgggcgacgacatggacccagaactccgcggcctagcccaggcactaatagaccaaaaagtgaaagaaatatccaaccaagaaccactcaagctatag

SEQ ID NO: 7705 - RNA, 1290 nt, synthetic construct
  misc_feature 1..1290: note = derived and/or modified CDS sequence (opt11) from DOBV(Ap1584/Sochi-01)__EU188449.1__N
  source 1..1290: mol_type = other RNA
atggccacactcgaagaactcaagaaagaaatcaacaaccatgaaggacaactcgtaatcgcccgacaaaaagtaaaggacgccgaaaaacaatacgaaaaagaccccgatgacctcaacaaacgcgcactcagcgaccgcgaaagtgtcgcccagtccatccaagggaaaatcgacgaactccgccggcaacttgcagaccgcgtcgccgccggcaaaaacatcgggaaagaacgcgaccccacgggccttgaccccggcgaccacctaaaagaaaagtccatgctaagctacggcaacgtaatcgacctcaaccacctcgacatcgacgaacccacaggccagacagccgactggctctccatagtcgtctacctcacatccttcgtcgtccccatcctactcaaagcactgtacatgctaaccaccagaggccgccaaacgaccaaagacaacaaaggcatgcgaatcagattcaaagacgactcctcattcgaagacgtcaacggcatacgaaaacccaaacatctcttcctctccatgcccaacgcacaatcttccatgaaagcagacgaaataacacccggaaggttccgcacagcagtctgcggcctataccccgcccaagtcaaagcacgcaacctagtaagccccgttatgtccgtgatcggattcgtctcactggccaagaactggaccgaacgcgtcgaagaatggctagacctcccctgcaagctactaagcgaaccctcccccaccagcctcacgaaaggcccctccaccaaccgcgactacctcaaccaacgacaaggcgccctagccaaaatggaaacaaaagaagcccaagcagtccgcaaacacgccatcgacgcaggctgcaacctcgtcgaccatatcgactccccctcatccatctgggtctttgccggcgcaccggaccgatgcccaccaacctgcctcttcgtagccggcatggcagaactcggagcattcttcgccgttctccaagacatgcgaaacacaatcatggcatccaaaaccataggcaccagcgaagaaaaactccgcaagaaaagctcattctaccaaagctacctccgacgcacccaaagcatgggcatacaactcgaccaacgcatcatcgtactattcatggtagactggggcaaagaagcagtcgactccttccacctaggagacgacatggaccccgaactaagaggcctagcccaagccctcatagaccaaaaagtcaaagaaatctctaaccaagaacccctaaaactctaa

SEQ ID NO: 7706 - RNA, 1290 nt, synthetic construct
  misc_feature 1..1290: note = derived and/or modified CDS sequence (opt11) from DOBV(DOB/Gola/235Af/07)__KC848495.1__N
  source 1..1290: mol_type = other RNA
atggccaccctcgaagaactacaaaaggaaataaacaaccacgaaggccaacttgtcatcgcaaggcaaaaagtcaaagacgccgaaaaacaatacgaaaaagaccccgacgacctaaacaaacgagccctttcagaccgagaatccatcgcccaatcaatccaaggcaaaatagacgaattacgtcgacaactagccgaccgagtagcagccggcaaaaacatcggcaaagaaagagacccaacaggactcgaccccggagaccacctcaaagaaaaatcaatgctatcctacggcaacgtcattgacctcaaccacctcgacatcgacgaacccaccggccaaaccgccgactggctatccatcgtcgtatacctaaccagcttcgtcgtccccatcctcctcaaagcactctacatgctaaccacacgcggacgccaaaccaccaaagacaacaaaggcatgcgaatccgcttcaaagacgactcctccttcgaagacgtcaacgggatccgcaaacccaaacacctcttcctcagcatgcccaacgcacaatcatcccgcaaagctgacgaaatcaccccgggaagattccgcactgccatctgcggactgtaccctgctcaagtcaaagcccgcaacctcatctcccccgtcatgtctgtaataggcttcctcgccctagccaaaaactggacagaacgcgtagaagaatggctcgacctcccgtgcaaactcctatccgaaccatccccaacttcactaaccaaaggccccagcaccaaccgagactacctcaaccaacgccaaggagccctcgctaaaatggaaaccaaagaagcccaagccgttagaaaacatgccatcgacgccggctgcaacctaatcgaccacatagactccccatcatccatatgggtcttcgccggcgcccccgaccgatgcccacccacatgcctcttcatcgccggcatggcagaactcggagccttcttcgccgtcctccaggatatgcgcaacaccataatggccagcaaaaccataggcacctcggaagaaaaactaaagaagaaaagcagcttctaccaatcctacctccgccgaacccaatcaatgggcatacaactcgaccaacgcataatcgtactcttcatggtcgactggggcaaagaagccgtcgactcattccacctcggcgacgacatggaccccgagctccgcggactcgcacaagccctaatcgaccaaaaagtaaaagaaatctcaaaccaagaaccactcaaactataa

SEQ ID NO: 7707 - RNA, 1290 nt, synthetic construct
  misc_feature 1..1290: note = derived and/or modified CDS sequence (opt11) from DOBV(DOB/Gola/343Af/07)__KC848498.1__N
  source 1..1290: mol_type = other RNA
atggcaaccctagaagaactccaaaaagaaatcaacaaccacgaaggccagctagttatagctcggcaaaaagtcaaagacgccgaaaaacaatacgaaaaagaccccgacgaccttaacaaacgagccctcagcgaccgcgaatccatcgcccaaagcatccaaggcaaaatcgacgagctccgccgccaactagccgaccgcgttgcagccggcaaaaacatcggaaaagaacgcgaccccacaggactagaccccggcgaccacctaaaagagaaaagcatgctatcctacggaaacgtcatcgacctcaaccacctcgacatcgacgaaccgaccggccaaaccgcagactggctatccatagttgtatacctaacatccttcgtagtcccaatcttactcaaagccctgtacatgctcactaccagaggccgacaaacaaccaaagacaacaaaggcatgcgaatccgattcaaagacgactcctccttcgaagacgtcaacggcatccgcaaacccaagcacctcttcctatccatgcccaacgcgcaatcctccatgaaagccgacgaaatcaccccaggacgcttccgcaccgccatctgcggactatacccagcacaagtcaaagcacgcaacctaatctcccccgtcatgtccgttataggcttcctagccctagccaaaaactggacagaacgcgtcgaagaatggcttgacctgccatgcaaactactatccgaaccatcccccacctccctaaccaaaggcccctccaccaacagagactacctaaaccagcgccaaggagcactcgccaaaatggaaacaaaagaagcccaagcagtccgcaaacacgccaccgacgccggctgcaacctaatagaccacatcgacagccccagctcaatctgggtcttcgcgggagcacccgacagatgcccacccacatgcctcttcatcgccggaatggcagaactcggagccttcttcgcagtcctccaagacatgcgaaacaccatcatggccagcaaaaccatcggtacctccgaagaaaaactcaaaaagaaatcgtccttctaccaatcctacctccgccgcactcaaagcatgggcatacaactcgaccaacgcataatcgtactattcatggtggactggggcaaagaagctgtcgactcattccacctaggagacgacatggaccccgaactccgcggcctagcccaagccctaatcgaccaaaaagtcaaagaaatctccaaccaagaacccctaaaactataa

SEQ ID NO: 7708 - RNA, 1290 nt, synthetic construct
  misc_feature 1..1290: note = derived and/or modified CDS sequence (opt11) from DOBV(DOB/Pecs/27Aa/06)__KC848499.1__N
  source 1..1290: mol_type = other RNA
atggccacactagaagaactccaaaaagaaatcaacagccacgaaggtcaactcgtcatcgcccgacaaaaagtcaaagacgcagaaaaacaatacgaaaaagaccccgacgacctaaacaaaagagccctaagcgaccgcgaatccgtcgcccagtccatccaatccaaaatcgacgaactccgccgacaactcgccgaccgcgtcgcagccgggaaaaacatcggaaaagaacgagaccccaccggtctcgaccccggcgaccacctcaaagaaaaatccatgctaagctacggcaacgtaatcgacctcaaccacctagacatcgacgaaccaaccggccaaaccgcagactggctctcaatcgtcgtgtacctcacatccttcgtcgtacccatactcctcaaagcactatacatgctcaccacacgcggccgtcaaaccaccaaagacaacaaaggaatgcgcgtgcgattcaaagacgactcctcttttgaagacgtcaacggaatacgaaagcccaagcacctattcctatcaatgcccaacgcccaatcaagcatgaaagcggacgaaatcacacccggacgcttccgcacagcagtctgcggactctacccagcacaagtcaaagcccgaaacctcgtctcccccgtcatgtcagttataggatttcttgcccttgccaaaaactggaccgaacgtgtagaagaatggcttgacctcccatgcaaactcctctcagaaccctccccaacatccctcaccaaaggaccctccaccaaccgcgactacctaaaccagaggcaaggagccctcgcaaaaatggaaacaaaagaagcccaagccgtcagaaaacacgccatagatgcaggctgcaatatcatagatcacatcgactcccccagctcaatctgggtcttcgccggagcccccgaccgatgccctccaacctgcctattcatagccggcatggccgaactcggcgccttcttctccgtactacaagacatgcgcaacaccatcatggcaagcaaaaccatcggaacatccgaagaaaaactccgcaagaaaagctccttctaccaaagctacctacgacgcacccaaagcatgggcatccaactagaccagcgcatcatcgtactattcatggtggactggggcaaagaagccgtagattcattccacctcggcgacgacatggaccccgaactacgaggactagcacaagcactcatcgaccaaaaagtcaaagaaatctccaaccaagagcccctgaaactataa

SEQ ID NO: 7709 - RNA, 1290 nt, synthetic construct
  misc_feature 1..1290: note = derived and/or modified CDS sequence (opt11) from DOBV(DOB/Pecs/31Aa/06)__KC848500.1__N
  source 1..1290: mol_type = other RNA
atggccaccctcgaagaactacaaaaagaaatcaactcccacgaaggccagctagtcatcgcccgccaaaaagtcaaagacgccgaaaaacaatacgaaaaagaccccgacgacctaaacaaacgcgccctctcagaccgtgaaagcgtcgcccaatcaatacaatccaaaatagacgaactacgacgccaactcgccgacagagtcgccgccggcaagaacatcggcaaagaaagagacccaaccggcctcgaccccggcgaccacctcaaagagaagtcaatgctctcctacggcaacgtcatcgacctcaaccacctcgacattgacgaacccaccggccaaaccgccgactggctctccatagtcgtctacctaaccagcttcgtcgtcccaatcctcctcaaagccctctacatgctaaccacacgtggacgccaaaccaccaaagacaacaaaggcatgcgcatacgcttcaaagacgactcatcattcgaagacgtcaatggcataagaaaaccaaaacacctatttctatccatgcccaacgcccaatcaagcatgaaagccgacgaaataaccccaggacgcttccgcacagctgtctgcggcctctaccccgcccaggtcaaagccagaaacctcgtatcccccgtcatgagcgtaataggcttcctcgccctagcgaaaaactggaccgagcgcgtcgaagaatggctggacctcccctgcaaactcctatccgaaccaagcccaacctccctcaccaaaggcccctccaccaaccgagactacctcaaccaacgacaaggcgccctagccaaaatggaaacaaaagaagcacaagccgtcagaaaacacgccatcgacgccggctgcaatataatcgaccacatagactccccaagctcaatctgggttttcgcaggagcccccgaccgatgcccaccaacctgcctcttcatcgccggcatggcacaactaggcgccttcttcagcgtgctccaagacatgcggaacaccatcatggcctctaaaacaatcggaacctccgaagaaaagctacgcaagaaatccagcttctaccaatcctacctacgcagaacccaatccatgggcatacaactcgaccaacgcatcatagtcctctttatggtagactggggaaaagaagccgtcgactccttccacctcggcgacgacatggacccagaactccgcggcctcgcccaagctctcatcgaccagaaaatgaaagaaataagcaaccaagaacccctcaaactctaa

SEQ ID NO: 7710 - RNA, 1290 nt, synthetic construct
  misc_feature 1..1290: note = derived and/or modified CDS sequence (opt11) from DOBV(DOB/Sarmellek/77Aa/06)__KC848501.1__N
  source 1..1290: mol_type = other RNA
atggcaaccctagaagaactgcaaaaagaaatcaactcccacgaaggccagctagtaatagcccgacaaaaagtcaaagatgcagaaaaacaatacgaaaaagatccagacgacctcaacaaacgcgccctaagcgaccgcgaatccgtagcacaaagtatccaaagcaaaatcgacgaactccgccgccaactagcagaccgcgtcgcctctggcaaaaacatcggcaaagaacgcgacccgaccggcctcgacccgggtgaccacctaacagagaaaagcatgctctcctacggcaacgtgatcgacctcaaccacctagacatcgacgaacccaccggccaaaccgccgactggctatccatcgtagtctacctaacctccttcgtagtccctatcctcctcaaagccctctacatgctaaccacacgcggccgacaaaccacaaaagacaacaaaggcatgcgaatccgattcaaagacgactcctcattcgaagacgtaaacggcatcagaaaacccaaacacctcttcctctccatgcccaatgcacaatcctccatgaaagcagacgaaatcacccccggccgcttccgcaccgccatctgcggcctataccccgcacaagtcaaagcacgcaacctagtcagccccgtcatgtcagtcatcggattcctcgccctagccaaaaactggaccgaacgagtcgaagaatggctagacctaccctgcaaactactatccgaaccctccccaacctccctgacgaaaggcccctctaccaatagagactacctcaatcaacgccaaggcgccctcgccaaaatggaaaccaaagaagcccaagctgtacgaaaacacgccatagatgcaggctgcaacatcatcgatcacatcgactccccaagctccatctgggtattcgcaggcgcccccgacagatgccctccaacctgcctcttcatcgccggcatggccgaactcggcgcattcttctccgtcctacaagacatgcgcaacaccatcatggcctccaaaaccgtaggaacctcagaagaaaagctccgcaagaaatccagtttctaccaatcctacctacgacgcacccaatccatgggcatacaactcgaccaacgaatcatcgtcctgttcatggtagactggggcaaagaagccgtcgactccttccaccttggcgacgacatggaccccgaattacgcagcctcgcccaagcactaatcgaccaaaaagtaaaagaaatctccaatcaagaacccctcaaactatga

SEQ ID NO: 7711 - RNA, 1290 nt, synthetic construct
  misc_feature 1..1290: note = derived and/or modified CDS sequence (opt11) from DOBV(GER/05/239/Aa)__GQ205405.1__N
  source 1..1290: mol_type = other RNA
atggccaccctcgaggaactccaaaaagaaataaactcccacgaaggccagctcgtaatagcgcgccaaaaagtcaaagacgcagaaaagcaatacgaaaaagaccccgacgacctcaacaagcgcgccctctccgacagagaatccgtagcccaatccatccaaggcaaaatcgacgaactccgccgccaactagcagaccgcgtcgccgccggcaaaaacatcggaaaagaacgagaccccaccggcctcgacccaggcgaccacctcaaagaaaaatcaatgctatcctacggcaacgtcatcgacctcaaccacctagatattgacgaaccaaccggacaaaccgccgactggctctccatagtagtctacctcacgtccttcgtagtccccatcctcctcaaagccctctacatgctcacaactcgcggacgccaaaccaccaaagacaacaaaggcatgcgcatccgcttcaaagacgactccagcttcgaagacgtcaacggaatccgcaaaccaaaacacctcttcctctcaatgcccaacgcccaatcctcaatgaaagccgacgagatcaccccaggccgcttccgaaccgctatatgcggactctaccccgcccaagtcaaggctcgtaacctcgtttcccccgtcatgtccgtcatcggatttctcgccctcgctaaaaactggaccgaacgcgtcgaagaatggctcgacctcccctgcaaacttctctccgagccatctcccacctccctcacaaaaggcccctccacaaaccgcgactacctcagccaacgccaaggcgccctcgccaaaatggaaaccaaagaggcacaggccgtccgcaaacacgccatcgacgctggatgcaacatcatagaccacatagactcaccctcctcaatctgggtcttcgccggagcccccgacagatgccctccgacctgcctattcatagccggcatggccgaactcggcgcattctttgccgtactacaagacatgcgcaacaccatcatggcatccaaaaccatcggaacctcagaagaaaaactacggaagaaaagctcattctaccaatcctacctccgcagaacccaatcaatgggaatacaactcgaccaacgcatcatcgtgctattcatggtggactggggcaaagaagccgtcgactccttccacttaggcgacgacatggaccccgaactacgctcactagcccaagccctcatcgaccaaaaagtaaaagaaatctccaaccaagaacccctcaaactctag

SEQ ID NO: 7712 - RNA, 1290 nt, synthetic construct
  misc_feature 1..1290: note = derived and/or modified CDS sequence (opt11) from DOBV(GER/05/477/Af)__GQ205406.1__N
  source 1..1290: mol_type = other RNA
atggctaccctagaagaactccaaaaagaaatcaactcgcacgaaggccaactcgtcatcgcccgacaaaaagtcaaagacgcagaaaagcaatacgaaaaagacccagacgacctcaacaaacgagctctctcagaccgcgaatctgtagcccaatccatccaaggcaaaatcgacgaactccgacgccaactagccgaccgcgtcgctgccgggaaaaacataggaaaagaacgagaccccacagggctcgaccccggagaccacctcaaggagaaatccatgctatcctacggcaacgtcatagacctcaaccacctcgacatagacgaaccaacaggccaaacagcagactggctgtctatagtagtctacctaacctcattcgtcgtaccaattctcctcaaagcgctctacatgctaaccacccgaggacgccaaaccaccaaagataacaaaggcatgaggatacgcttcaaagacgactcctccttcgaagacgtaaacggcatccgaaaacccaaacacctattcctctcaatgcccaacgcacaaagctccatgaaagccgacgaaatcacccccggacgcttccgcacagcaatctgcggcctctaccccgcacaagtcaaagcacgcaacctcgtctccccagtcatgagcgtaatcggcttcctcgccctcgctaaaaactggacagaacgagttgaagaatggctcgacctcccgtgcaaactcatctccgaaccatcccccacttccctgaccaaaggccccagcacaaaccgcgactacctctcccaacgccaaggcgccctagcaaaaatggaaaccaaagaagcccaagcagtccgcaaacacgctatcgacgccggatgcaacataatcgaccacatcgactccccatcctccatatgggtcttcgcaggcgcccccgaccgctgtcccccaacctgcctattcatcgctggaatggctgagctaggcgccttctttgccgtactccaagacatgcgcaacaccatcatggcctcaaaaaccatcggcacaagcgaagaaaagctaagaaagaaatcctccttctaccaatcctacctacgcagaacccaaagcatgggcatacaactagaccaacgaatcatcgtcctcttcatggtcgactggggcaaagaagccgtcgactccttccacctcggcgacgacatggaccccgagctccgatcactcgcacaagccctgatcgaccaaaaagtcaaagaaataagcaaccaggaaccactcaaactttaa

SEQ ID NO: 7713 - RNA, 1290 nt, synthetic construct
  misc_feature 1..1290: note = derived and/or modified CDS sequence (opt11) from DOBV(GER/07/293/Aa)__GQ205401.1__N
  source 1..1290: mol_type = other RNA
atggccaccctagaagaactacaaaaagaaatcaactcccacgaaggccagctagtcatagcaagacaaaaagtcaaagacgccgaaaaacaatacgaaaaagacccagacgacctcaacaaaagagccctaagcgacagagaatccgtggcccaatccatacaaggcaagatagacgaactccggcgccaactagcggaccgcgtcgcagcaggcaaaaacatcggcaaagaacgcgaccccacaggactcgacccaggcgaccacctaaaagaaaaatcaatgctatcctacggaaacgtcatcgacctaaaccaccttgacatcgacgaacccacaggccaaaccgctgactggctcagcatcgtagtgtacctaacctcattcgtcgtccccatcctcctgaaagccctatacatgctcaccacccgcggccgacaaacgaccaaagacaacaaaggcatgagaatcagattcaaagacgacagctctttcgaagacgtcaacggcatccgaaaaccaaaacacctattcctatccatgccaaacgcccaatccagcatgaaagcagacgagataacccccggaagattccgcaccgccatatgcggcctgtacccagcccaagtaaaagcccgtaacctcgtaagcccagtcatgtccgtaatcgggttcctggccctagccaaaaactggacagaacgtgtcgaagactggctcgacctaccctgcaaactactatccgaaccctctccaacatccctcacgaaaggccccagtaccaaccgcgactacctaaaccaacgccaaggcgcactcgccaagatggaaacaaaagaagcccaggccgtccgaaaacacgcaatagacgccggctgcaacatcatcgaccacatcgactccccctccagcatatgggtcttcgccggagcccccgaccgatgcccacctacctgcctcttcatcgccggaatggcagaactaggagccttcttcgcagtgctacaagacatgcgaaacaccataatggccagcaaaaccatcggcacaagcgaagaaaaactacgcaagaaaagcagcttctaccaaagctacctccgccgaacccaaagcatgggcatccagcttgaccaacgcataatcgtcctcctaatggtagactggggaaaagaagcagtcgactccttccacctaggagacgacatggacccagaactacgaggcctcgcacaagcactaatagaccaaaaagtcaaagaaatctcaaaccaagaacctctcaaattatga

SEQ ID NO: 7714 - RNA, 1290 nt, synthetic construct
  misc_feature 1..1290: note = derived and/or modified CDS sequence (opt11) from DOBV(GER/07/424/Aa)__GQ205403.1__N
  source 1..1290: mol_type = other RNA
atggcaaccctggaagaactccagaaagaaataaactcacacgaaggacaattagtaatcgccagacaaaaagtaaaagacgcagaaaaacaatacgaaaaagacccagatgacctcaacaaaagagccctctccgaccgagaaagcgtagcccagagcatccaaggcaaaatcgacgaactccgacgccaactcgccgacagagtcgccgccgggaaaaatatagggaaagaacgcgaccccacaggcctcgaccccggcgaccatctaaaagagaaaagcatgctctcatacggaaacgtcatcgacctgaatcacctcgacatcgacgaacccaccggccaaacagcggactggctatccattgtcgtatacctcacctcattcgtcgtcccgatactactcaaagccctatacatgctcaccacccgcggccgccaaaccacaaaagacaacaagggcatgagaatccgcttcaaggacgactcctccttcgaagacgtcaacggcatcagaaaacccaaacacctcttcctatcaatgcccaacgcgcaatccagcatgaaagccgacgaaataacacccggtcgcttccgcaccgccatatgcggactatacccagcacaagtcaaagcacgcaacctcgtaagccccgtaatgtccgtcatcggcttcctcgccctcgccaaaaactggaccgaacgcgtcgaagactggctcgacctcccctgtaaactcctcagcgaaccaagcccaacaagcctaaccaagggccccagcaccaaccgcgactacttaaaccaacgccaaggagccctggcgaaaatggaaacaaaagaagcccaggcagtccgcaaacacgccatcgacgccggctgcaacataatagaccacatcgactcccccagcagcatctgggtcttcgcaggcgcccccgaccgctgcccaccaacctgcctcttcatcgccggcatggcagaactcggcgccttcttcgccgtactccaagacatgcgcaacaccatcatggcctccaaaaccatcggaacctcagaagaaaaacttcggaagaaatcctcattctaccaaagctacctacgacgaacccagagcatgggcatacaactagaccaacgaatcatcgtcctcttcatggtagactggggcaaagaagccgtcgactccttccacctaggcgacgacatggaccccgaactacgcggcctcgcccaagccctcatcgaccaaaaagtcaaagaaatttccaaccaagaaccactaaaactctaa

SEQ ID NO: 7715 - RNA, 1290 nt, synthetic construct
  misc_feature 1..1290: note = derived and/or modified CDS sequence (opt11) from DOBV(GER/08/118/Aa)__GQ205407.1__N
  source 1..1290: mol_type = other RNA
atggccacactcgaagaactgcaaaaggaaataaactcccacgaaggccaattagtcatcgcacgccaaaaagtcaaagacgccgagaaacaatacgaaaaagaccccgacgacctaaacaaacgagccctctccgaccgcgaaagcgtagcccaatccatccaaggaaaaatcgacgaactcagacgacaactggccgaccgcgtcgcagccggcaaaaacatcggcaaagagcgcgaccccacaggtctagaccccggcgaccacctcaaagagaaatccatgctctcctacggcaacgtcattgacctaaaccacctagacatcgacgaacccaccggccaaacagccgactggctatccatcgtcgtctacctaacctccttcgtcgtccccatcctcctaaaagccctatacatgcttaccaccagagggcgccaaaccaccaaagacaacaaaggcatgcgaatccgcttcaaggatgacagcagcttcgaagacgtcaacggcatccgaaaaccaaaacacctcttcctcagcatgccaaacgcacaaagctcaatgaaagctgacgaaatcacgcccggacggttccgcaccgccatctgcggactttaccccgcccaagtcaaagcacgcaacctcgtctccccagtcatgtcagttataggattcctcgccctcgccaaaaactggaccgaacgggtagaagactggctcgacctaccctgcaaactactcagcgaaccctcacccacctcactcaccaaaggaccctccaccaaccgagactacctaaaccaacgtcaaggcgcactcgccaaaatggaaaccaaagaagcccaagcagtacgcaaacacgcaattgacgcaggctgcaacatcatcgaccacatcgactcacccagctcaatttgggtattcgccggcgcccccgaccgctgccctcccacatgcctcttcatagccggcatggccgagctcggcgcattcttcgccgtactgcaagacatgagaaacacaatcatggcctccaagacagtaggcacatccgaagagaaaatgcgcaaaaagtcctccttctaccaaagctacctaagacgcactcaatccatgggcatccaactcgaccaacgaatcatcgtactattcatggtcgactggggaaaggaagccgtcgactccttccacctcggcgacgacatggacccagaacttcgcggactcgcccaagccctaatcgatcaaaaagtcaaagaaatctccaaccaagaacccctaaaactataa

SEQ ID NO: 7716 - RNA, 1290 nt, synthetic construct
  misc_feature 1..1290: note = derived and/or modified CDS sequence (opt11) from DOBV(GER/08/131/Af)__GQ205408.1__N
  source 1..1290: mol_type = other RNA
atggccacccttgaagaactccaaaaagaaatcaactcacacgaaggacagctagtaatagcccgccaaaaagtcaaagacgcagaaaaacaatacgaaaaagaccccgacgacctcaataaaagagccctcagcgaccgcgagtccgtcgcacaatccatccaaggcaaaatcgacgaactacgccgccaacttgccgaccgcgtcgcagccggaaagaacatcggaaaagaacgcgaccccactggcctcgacccaggcgatcacctcaaagaaaagtcaatgctgtcctacggcaacgtcatcgacctaaaccacctcgacatcgacgaacccaccggccaaaccgccgactggctctcaatcgtcgtctacctaacctccttcgtagtccccatcctcctaaaagcactatacatgctcaccaccagaggccgccaaaccacaaaagacaacaaaggcatgcgcatacgattcaaagacgactccagcttcgaagacgtcaacggcattcgcaaaccaaaacacctcttcctctccatgcccaacgcccaaagcagcatgaaagccgacgaaatcacgcccggccgcttcagaaccgccgtctgcggcctatacccagcccaagtaaaagcccgaaacctagtgtcccccgtaatgtcagtcatcggcttccttgccctagccaaaaactggacagaacgcgtcgaagactggctagacctaccctgcaaactcctatcagaacccagccccacctcactcaccaagggaccctccaccaaccgcgactacctcaaccaacgccaaggcgcactcgcaaaaatggaaacaaaagaagcccaggccgtacgcaaacacgctatcgacgccggctgcaacatcatcgatcacatcgactcaccatcaagcatctgggtattcgcaggcgcccccgacagatgcccaccaacctgcctcttcatagcaggaatggcagaactcggcgcctttttcgccgtcctacaagatatgcgcaacacaatcatggcatccaaaaccataggcacgtccgaagaaaaactccgcaagaaatcctccttctaccagtcctacctccgccgaacccaatcaatgggcatccaactagaccaacgcataatcgtactcttcatggtcgactggggcaaggaagccgtcgactcattccacctaggcgacgacatggaccccgaactccgaggcctcgcccaagccctcatcgaccaaaaagtcaaagaaatatccaaccaagaacccctaaaactctaa

SEQ ID NO: 7717 - RNA, 1290 nt, synthetic construct
  misc_feature 1..1290: note = derived and/or modified CDS sequence (opt11) from HTNV(76-118/POR)__KT885049.1__N
  source 1..1290: mol_type = other RNA
atggccaccatggaggaactccaacgagagataaacgcccacgaaggccagctagtcatcgccagacaaaaagtccgagacgccgaaaaacaatacgaaaaagaccccgacgaactcaacaagagagccctaaccaaccgagaaggcgtcgcagtctccatccaagcaaaaatcgacgaactcaaaatgcaactagcagacagaatagctaccggcaaaaacctcggaaaagagcaagaccccacaggcgtagaacccggcgaccacctcaaagaaagatccatgctctcatacggcaacgtactagacctcaaccacctcgacatagacgaacccaccgggcaaacagccgactggctctccataatcgtctacctcacctccttcgtcgtcccaatcctcctcaaagcactatacatgctaaccacccggggcagacaaactaccaaagacaacaaaggcacccggatcagattcaaggacgacagctcattcgaagacgtgaacggcatccgaaaacccaaacacctttacgtctccctccccaacgcacaatcaagcatgaaagccgaagaaatcacgcctggccgctaccgaaccgcagtatgcggcctctaccccgcacaaatcaaagccagacaaatgatctcccccgtcatgtcagtaataggtttcctcgccctcgccaaagactggagcgaccgcatcgaacaatggctgatcgaaccatgcaaactcctccccgacacagccgcggtcagcctcctaggcggaccagccacaaacagagactacctcagacaacgccaagtcgccctcggcaacatggaaaccaaagaaagcaaagcaatacgacagcacgccgaagcggccggatgctccatgatcgaagacatagaaagcccaagctcaatatgggtcttcgccggcgcccccgaccgctgcccaccaacctgcctcttcatcgccggaatcgcagaacttggcgccttcttctctatcctccaagacatgcgcaacaccatcatggcaagcaaaacagtcggcaccagcgaggagaaactaagaaagaaatcctccttctaccaatcatacctcagacgcacccagtccatgggcatacaactcgaccaacgaatcatagtcctcttcatggtagcatggggcaaagaagcagtcgacaacttccacctaggcgatgacatggaccccgaactccgcaccctcgcccaaagcctcatcgacgtaaaagtcaaagaaatctccaaccaagaacccctcaaactctaa

SEQ ID NO: 7718 - RNA, 1290 nt, synthetic construct
  misc_feature 1..1290: note = derived and/or modified CDS sequence (opt11) from HTNV(A16)__AF288646.1__N
  source 1..1290: mol_type = other RNA
atggccaccatggaagaactacaacgggaaatcaacgcccacgaaggccagctagtcatcgcacgccaaaaagtccgagacgcagaaaaacaatatgaaaaagacccagacgaactaaacaaacgcgcactgacagaccgcgaaggcctcgccgccagcatccaagccaaaatagacgaactaaaacgccaactagccgaccgcatagctaccggtaaaaacctaggcaaagaacaggacccaacaggcgtagaaccgggagaccacctaaaagaacgttccatgctctcctacggcaacgtcctcgaccttaaccacctagacatagacgaacccacaggacaaacagcagactggctatccatcgtaatctacctcaccagcttcgtagtccccatcctcctcaaagccctctacatgctcacaacccgcggccgccaaaccaccaaagacaacaaaggcacgcgaatacgcttcaaagacgactcctcattcgaagacgtaaacggcatccgaaaacccaaacacctatacgtctcactacccaatgcccaatcctcaatgaaagccgaagaaatcaccccaggccgataccgcaccgcgatctgcggcctataccctgcacaaatcaaggcccgccaaatgatcagcccggtaatgtcagtaatcggattcctcgcactcgccaaagactggtcagaccgcatcgaacaatggctctcagaaccctgcaaactactccccgacaccgccgccgtcagcctacacggcggccccgcaaccaaccgcgactacctccgccaacgccaagtcgccctcggcaacatggaaaccaaagagtctaaagcaatccgacaacacgccgaatccgcgggatgctcaatggtcgaagacatcgaatcacccagctcaatctgggtcttcgcaggagcaccaaaccgatgcccacccacatgcctcttcatagccggcatagccgaactcggcgcattcttctccatcctccaagacatgcgcaacacaataatggcctccaaaaccgtcggcacatcggaagaaaaactacgaaagaaatcatcgttctaccaatcttacctccgccgcacacaatccatgggaatccagctagaccaacggatcatagtcctcttcatggtagcctggggaaaagaagccgtagacaacttccacctcggcgacgacatggatcccgtcctacgcacactagcgcaaagcctcatcgacgtcaaagttaaagaaatttcaaaccaagaacccctcaaactctaa

SEQ ID NO: 7719 - RNA, 1290 nt, synthetic construct
  misc_feature 1..1290: note = derived and/or modified CDS sequence (opt11) from HTNV(CA09082007)__HQ834499.1__N
  source 1..1290: mol_type = other RNA
atggcaaccatggaggaacttcaacgggaaatcaacgcccacgagggccaactcgtcatcgcccgacaaaaagtccgcgacgccgaaaaacaatacgaaaaagacccagacgaactaaacaaacgcgccctaaccgaccgcgaaggcgtcgccgcgagcatacaagccaagatcgacgaactaaaacgccaactcgccgacagaatcgcaaccggcaaaaacctcggaaaagaacaagaccccaccggagtcgaacccggagaccacctcaaagaacgctccatgctaagctatggcaacgtcctagacctcaaccacctcgacatagacgaacccaccggacaaaccgccgactggctctcgatcgtaatatacctcacctccttcgtcgtccctatactcctaaaagccctctacatgctaacaacccgcggcagacaaacaaccaaagacaacaaaggaacaaggatccgattcaaagacgacagctcattcgaagacgtcaacggcatccgcaaacccaaacacctatacgtctcactccctaacgcacaatcgtccatgaaagccgaagagatcactccaggccgctaccgcaccgccatatgcggcctatatcccgcacaaatcaaagcccgccaaatgatatcccccgtcatgagcgtcataggcttcctcgctctcgcaaaggactggtccgaccgcatagaacaatggctctcagaaccctgcaaactactcccagacaccgcagcggtctccctgcacggcggacctgcaaccaacagagactacctccgccagcgccaagttgcactcggtaacatggaaacaaaggaatccaaagccatccgccaacacgctgaatccgcaggatgctcaatggtcgaagacatcgaaagccccagctcaatctgggtattcgccggcgcccccgaccgctgcccaccaacctgcctcttcatcgccggcatcgcagaactgggcgcattcttcagcatcctccaagacatgcgaaacaccatcatggcctcaaaaaccgtcggaacaagcgaagaaaaactccgcaagaaatcatcattctaccaatcctacatccggcgcacacaatcaatgggcatccaactagaccaacgcatcatagtactcttcatggtagcctggggcaaagaagctgtagacaacttccacctcggagacgacatggaccccgaactacgcacccttgcccaatccctaatcgatctcaaagtaaaagaaatatcaaaccaagaaccactcaaactctaa

SEQ ID NO: 7720 - RNA, 1290 nt, synthetic construct
  misc_feature 1..1290: note = derived and/or modified CDS sequence (opt11) from HTNV(CA10081109)__HQ834500.1__N
  source 1..1290: mol_type = other RNA
atgcccacctcaggagaactacaacgagaaatcaacgcacacgaaggccaacttgtcatcgcccgtcaaaaagtccgtgacgccgaaaaacaatacgaaaaagaccccgacgaactaaacaaacgagccctcacagaccgagaaggcgtagccgcatccatacaagccaaaatcgacgaactcaaacgccaactcgcagacagaatcgccaccggcaaaaacctcggcaaagaacaagaccccaccggcgtagaaccaggcgatcacctcaaagaacgctccatgctatcctacggcaacgtactggacctcaaccacctcgacatcgacgaaccaaccggccaaacagccgactggctctccatcgtaatctacctcacctccttcgtagtcccaatcctactcaaagccctctacatgctcacgacacgcggccgccaaaccaccaaagacaacaaaggcacccgtattcgcttcaaagacgactccagcttcgaagacgtgaacggcatcagaaaacccaaacacctctacgtctccctacccaacgcccaatcaagcatgaaagcagaagaaatcaccccaggacgataccgcacagccatctgcgaactctacccagcccaaataaaagccagcaaaatgatcagccccgtaatgtcagtaatcggcttcctggcactagccaaagactggagcgacagaatcgaacaatggctgtccgaaccatgcaaactcctacccgacaccgcagccgtatccctacacggcggccccgctacaaaccgcgactatctccgccaacgccaagtcgccctaggaaacatggaaacaaaagaatccaaggccatccgacaacacgccgagtccgccggctgctcaatggttgaagacatcgaaagcccatcctcaatctgggtcttcgccggagcccccgaccgctgcccgccaacctgcctgttcatagccggaatcgccgaactcggcgccttcttctccatcctccaagacatgcgcaacaccataatggcaagcaaaacagtcggcacctccgaggaaaaactccgaaagaaatcctccttctaccaatcatacctgcgaaggacccagagcatgggcatacaactagaccaacgcataatcgtcctcttcatggtcgcctggggaaaagaagccgtcgacaacccccacgccggcgacgatgtagatccctccctaggcatgctcgcacaatccctcatcgacgtgaaagtcaaagaaatctccaaccaagaacccctaaaactctga

SEQ ID NO: 7721 - RNA, 1290 nt, synthetic construct
  misc_feature 1..1290: note = derived and/or modified CDS sequence (opt11) from HTNV(CA10081113)__HQ834501.1__N
  source 1..1290: mol_type = other RNA
atggcaacctccggcgaactccaacgcgaaatcaacgcccacgaaggccaactcgttatcgcccgccaaaaagtccgcgacgccgaaaaacaatacgaaaaagaccccgacgaactaaacaaacgcgccctaaccgaccgcgaaggcgtcgccgcctccatccaagccaaaatcgacgaactaaagcgacaactcgccgaccgcatcgcaaccggcaaaaacctcggaaaagaacaagaccccaccggcgtggaaccaggagatcacctcaaagaacgctcgatgctaagctatggtaacgtactcgatctaaaccacctcgacatcgacgaaccaacaggccaaaccgcagactggctctcaatagtcatatacctcacctccttcgtcgtaccaatactcctcaaagcactatacatgctaaccacccgcggccggcaaaccacaaaagacaacaaaggcacccgcatacgattcaaagacgacagctccttcgaagacgtcaacggaatccgaaaaccaaaacacctctacgtctccctaccaaacgcccagagctccatgaaagcagaagaaatcacccccggccgatatcgcaccgcaatcttcgaactataccccgcccaaataaaagcccgacaaatgataagcccagtcatgagcgtcatcggcttcctagccctggccaaagactggagcgaccgaatagaacaatggctcagcgaaccttgcaaactactccccgacacagccgccgtctccctccacggcggccccgcaacaaaccgcgactacctccgccaaagacaagtcgccctcggaaacatggaaaccaaagaaagcaaagccatcagacaacacgccgaatcagccggctgctccatggtcgaagacatagaaagcccaagcagcatttgggtattcgccggcgcaccagaccgatgcccaccaacctgcctgttcatcgccggcatcgccgaactcggcgccttcttctccatcctacaagacatgcgcaacacgatcatggcaagcaaaacagtcggcacatccgaagaaaaacttagaaagaaatccagcttctaccaaagctacctccgcagaacacaatccatgggcatccaactcgaccaacgcataatagtactattcatggtagcatggggaaaagaagccgtagacaacagacacctaatgaacatcgtcgaccccgaaccccgcgccctagcacaatccctcatcgacgtaaaagtaaaagaaatcagcaaccaagaacccctcaaactctaa

SEQ ID NO: 7722 - RNA, 1290 nt, synthetic construct
  misc_feature 1..1290: note = derived and/or modified CDS sequence (opt11) from HTNV(CA10081203)__HQ834502.1__N
  source 1..1290: mol_type = other RNA
atggcaacaaacggcgaactccaacgcgaaataaacgcccacgaaggacaacttgtcatagccagacaaaaagtccgagacgcggaaaaacaatacgaaaaggaccccgatgaactaaacaaaagagcactgaccgaccgagagggcgtcgccgcatccatccaagccaaaatagacgaactaaaacgacaactcgcagaccgcatagcaacaggcaaaaacctcgggaaagaacaagaccccaccggagtcgaaccaggcgaccatctaaaagaacgctccatgctctcctacggcaacgttctcgacctcaaccacctcgacatcgacgaaccaacaggccaaaccgcagactggctcagcatcgtaatctacctcacctccttcgtagtccccatcctcctcaaagcactgtacatgctaaccacccgcggccgacaaaccacaaaagacaacaaaggcacccgaatccgattcaaagacgacagctcgttcgaagacgtaaacggtatccgcaaacccaagcacctatacgtatcactcccaaacgcacaatcctccatgaaagccgaagaaataacacccggcagataccgaaccgcaatcttcggactataccccgcccaaattaaagcccgacaaatgatcagcccggtcatgtccgtaataggattcctggccctagccaaagactggagcgaccgcatagaacaatggctaagcgaaccctgcaaactactgccagacacagcagccgtctcactccacggcgggcccgccaccaaccgcgactacctcagacagagacaagtcgccctcggcaacatggagaccaaagaatccaaagccatccgccaacacgcagaatccgccggctgctcaatggtagaagacatcgaatccccaagctccatctgggtcttcgccggcgccccagaccgctgcccaccaacctgcctattcatagccgggatcgccgagttaggagcattcttctccatactccaagacatgagaaacacaataatggcctcaaaaaccgtcggaaccagcgaagaaaaactccgtaagaaaagctccttctaccaaagctacctacgccgcacccaatccatgggcatacaactcgaccagcgcatcatcgtactattcatggtagcatggggcaaagaagccgtcgacgagctacacagtggcgacggcgaacaccacgcctcccgaaccctcgcccaatccctaatagacgttaaagtcaaagaaatcagcaaccaagaacccctcaaactctaa

SEQ ID NO: 7723 - RNA, 1290 nt, synthetic construct
  misc_feature 1..1290: note = derived and/or modified CDS sequence (opt11) from HTNV(CA10081206)__HQ834503.1__N
  source 1..1290: mol_type = other RNA
atggcaaccatcgaagaactccagcgcgagatcaacgcccacgaaggacaactcgtcatagcccgccaaaaggtacgcgacgccgaaaaacaatacgaaaaagaccccgacgagctaaacaaacgcgcactgaccgacagagaaggagtcgccgccagcatccaagccaaaatagacgaactaaaacgacaactcgccgaccgcatcgccacaggcaaaaacctaggaaaagaacaagatcccacaggcgtagaaccaggcgaccacctcaaagaacgcagcatgttaagctacggtaacgtcctcgacctcaaccacctagacattgacgaacccacaggacaaaccgccgactggctcagcatagtcatctacctgacctccttcgtggtacccatcctcctgaaagccctctacatgctaaccaccagaggacgacaaacaaccaaagacaacaaaggaacccgcatacgcttcaaagacgactccagcttcgaagacgtaaacggaatccgcaaacccaaacacctctacgtctccctccccaacgcccaatcatccatgaaagcggaagaaatcacgcccggacgctatcgcaccgcaatctgcggcctctacccagctcagataaaagcccgacaaatgatctcacccgtaatgtccgtaatcgggttcctcgcactagccaaggactggagcgatagaatagaacaatggctatccgaaccatgcaaactcctccccgacaccgcagccgtctcgctccacggcggcccagccaccaacagagactacctgcgacaacgccaagtcgccctaggaaacatggaaacaaaagaaagcaaagccatcagacaacacgccgaatcagccggatgttcgatggtcgaagacatcgaaagcccctcctcaatctgggtcttcgccggcgctcccgaccgatgtcccccaacctgcctcttcatagcaggcatagcggaactcggagcattctttagcatcctccaagacatgagaaacacaattatggcctcaaagaccgtcggcaccagcgaagagaaactacggaagaaaagctcattctaccaatcctacctccgccgcacccaatccatgggcatccaactcgaccaacgcatcatcgtattattcatggtcgcctggggaaaagaagcagtagacaacttccacgcatgggacggcatggaccccgaactaagaacactcgcccaatcactcatagacgtcaaagtcaaagaaatctcaaaccaggaaccgctcaaactctaa

SEQ ID NO: 7724 - RNA, 1290 nt, synthetic construct
  misc_feature 1..1290: note = derived and/or modified CDS sequence (opt11) from HTNV(CA10081708)__HQ834504.1__N
  source 1..1290: mol_type = other RNA
atgcccacatcaggagaactccaacgagaaattaatgcccacgaaggacaactggtcatcgcccgccagaaagtacgcgacgccgaaaaacagtacgaaaaagaccccgacgaactaaacaaaagggccctcaccgaccgcgaaggagtagccgccagcatacaagcaaaaatagacgaactaaaacgacagctcgcggaccgcatcgcaactggcaaaaacctcggaaaagagcaagaccccaccggcgtcgaacccggcgaccacctcaaagaacgctccatgctcagctatggtaacgtcctcgaccttaaccacctcgacatcgacgaaccaacaggccaaacggcagactggctatccatcgtcatctacctcacctccttcgtggtcccaatactactcaaagccctgtacatgctcacaacccgcggcagacaaacaaccaaagacaacaaagggacccgaatccgattcaaggacgactcctccttcgaggacgtaaacggcataagaaagccgaaacacctctacgtctcgctcccaaacgcacaatcctcaatgaaagccgaagaaatcaccccaggccgctaccgcacagccatcttcgaactctaccccgcacaaatcaaagcacgcaaaatgatcagccctgtaatgagcgtcataggattcctagccctcgccaaagactggagcgaccgcatcgaacaatggctcagcgaaccctgcaaattactccccgacactgccgccgtcagcctccacggcggccccgcgaccaaccgagactacctacgccaaagacaagtagccctcggcaacatggaaaccaaagaaagcaaagccatacgccagcacgcggaatctgccggctgctcaatggtcgaggacatcgaaagcccatcctcaatctgggtcttcgccggggccccagaccgatgcccacccacatgcctgttcatcgccggcatcgccgaactaggagccttcttcagcatactccaagacatgcgaaacaccataatggcgagcaaaaccgtcggcacgagcgaagaaaaactccgcaagaaaagctcattctaccaatcatacctccgccgaacacaatccatgggcatacaactagaccaacgaatcatcgtcctattcatggtggcctggggcaaagaagcagtcgacaacccccacacaggcgacgacgccgacccggaactccgcaccctcgcccaatcactaatcgacgtcaaagtaaaagaaatctccaaccaagaacccctaaaactctaa

SEQ ID NO: 7725 - RNA, 1290 nt, synthetic construct
  misc_feature 1..1290: note = derived and/or modified CDS sequence (opt11) from HTNV(CA10081905)__HQ834505.1__N
  source 1..1290: mol_type = other RNA
atggcgacatccggagaactccaacgagaaatcaacgcccacgaaggccagctagtcatagcacgccaaaaagtccgcgacgccgaaaaacaatacgaaaaagaccccgacgaactcaataaaagagcactcaccgaccgcgaaggagtcgccgcatcaatccaggccaaaatagatgaacttaaacggcaactcgccgaccgcatcgcaaccggcaaaaacctaggaaaagaacaagaccccaccggagtcgaaccgggcgaccacctaaaagaacgatccatgctctcctacggaaacgtcctcgacctcaaccacctagacatagacgaacccaccggtcaaacagcagactggctcagcatagtcatctatctcacatcattcgtagtgccaatcctcctcaaagccctatacatgcttacaacccgaggacgccaaacaaccaaagacaacaaaggcacacgcatccgattcaaagacgacagcagcttcgaagacgtcaacggaatacgaaaaccaaaacacctctatgtcagcctccccaacgcgcaatcgagtatgaaagccgaagaaatcacccccggacgataccgcaccgcaatcttcgagctataccccgcccaaatcaaagccagaaaaatgatctcccccgtcatgtccgtcatcggattcctagccctagcaaaagactggagcgaccgcatcgaacaatggctctccgaaccatgcaaacttctcccagacaccgcagccgtctcactccacggcggaccagccacaaatcgagactacctaagacaacgacaagtggccctcggaaacatggaaacaaaagaatccaaggccatccgccaacacgcagaaagtgccggatgcagcatggtcgaagacatcgaaagcccatcctcaatctgggtattcgccggggcacccgacagatgcccacccacgtgcctattcatcgccggcatcgccgaactgggcgccttcttctccatcctccaagacatgcgcaacaccatcatggcctccaaaaccgtaggaacctcagaagaaaaactccgaaagaaaagctccttctatcaaagctacctaagaagaacccaatccatgggcatacaactagaccaacgcatcatcgtactgttcatggtagcatggggcaaagaagccgtcgacaaccaccacctcatcaacgccggcgaccacgaactacgcaccctcgcccaaagcctcatcgacgtcaaagtaaaagaaatatccaaccaagaacccctaaaactttaa

SEQ ID NO: 7726 - RNA, 1290 nt, synthetic construct
  misc_feature 1..1290: note = derived and/or modified CDS sequence (opt11) from HTNV(E142)__AF288644.1__N
  source 1..1290: mol_type = other RNA
atggccaccatggaagaactccaacgcgaaatcaacgcacacgaaggccaactcgtcatcgcgcgacaaaaggtcagagacgccgagaaaagatacgaaaaggaccccgacgaactaaacaagcgcaccctcaccgaccgagaaggcgtagccgcctcaatccaagccaaaatcgacgaactaaaacgccagctagcagaccgcatagccaccggaaagaacctcggcaaggaacaagaccccaccggggtcgaacccggagaccacctaaaagaacgatccatgctcagctacggcaacgtcctggacctaaaccacctagacatcgacgaaccaaccggacaaaccgcagactggctcagcattgtcatatacctaacctccttcgtcgtcccaatactcctcaaagcactatacatgctcacaacccggggccgccaaacgacaaaagacaacaaaggaacccgcatccgattcaaagacgactcctcatcagaagacgtcaacggaatccgcaaacccaagcacctatacgtatccctccccaacgcccaaagtagcatgaaagccgaagaaataacccccggccgctacagaaccgccatctgcggcctctaccccgcgcaaataaaagcccgccaaatgatcagccccgtaatgtccgtcatcggtttcctcgccctagccaaagactggagcgaccgcatagaacaatggttatccgaaccctgtaaactactcccagacaccgcagcggtctccctacacggcggacccgctacaaacagagactacctccgacaacgccaagtcgcactcggcaacatggaaaccaaagaaagcaaggccatccgccaacacgcagaatcagcaggctgcagcatgatagaagacatcgaatcacccagctctatctgggtattcgcaggagcccctgaccgctgccctccaacctgcctcttcatcgccggcatcgccgaactcggcgccttcttctccatcctgcaagacatgcgcaacaccatcatggcctcaaaaaccgtcggcacctccgaagaaaaactacgcaagaaatcctccttctatcaatcctacctaagacgcacacaatcaatgggcatccaacttgaccaacgcatcatcgtcctattcatggtcgcatggggcaaagaagtcgtcgacaacttccacctcggagacgacatggaccccgaactacgtaccctagcccaatcactcatcgacgtcaaagtcaaagaaatatcaaaccaagagcccctaaaactctaa

SEQ ID NO: 7727 - RNA, 1290 nt, synthetic construct
  misc_feature 1..1290: note = derived and/or modified CDS sequence (opt11) from HTNV(H10150)__HQ834506.1__N
  source 1..1290: mol_type = other RNA
atggctaccatgggcgagctccagcgcgaaatcaacgcacacgaaggccaactcgtcatcgcacgccaaaaagtacgtgacgccgaaaaacaatacgaaaaagacccagacgagctcaacaaacgcgccctaaccgaccgagagggagtagccgcctcaatccaagccaaaatcgacgaactaaaacgacaactagcagaccgcatcgccaccggcaaaaatctaggaaaagaacaagaccccaccggcgtcgagcccggagaccacctcaaagaaagatcaatgctaagctacggcaacgtcctcgacctgaaccacctcgacatagacgaaccaaccggccaaaccgccgactggctctccatcgtcatctacctcaccagcttcgtagtcccaatcctcctcaaagccctatacatgctcaccacccgaggccgccaaacaaccaaagacaacaaaggaacccgaatccgcttcaaagacgactccagcttcgaagacgtcaacggcatacgcaagccaaaacacctctacgtcagcctcccaaacgcccaatcatccatgaaagcagaagaaataaccccaggccgctaccgaaccgccatcttcggactataccccgcccaaatcaaagcacgccaaatgatctcccccgtaatgagcgtaataggattcctagcactcgctaaggactggtccgatcggatcgaacaatggctcagcgaaccatgcaaactactccccgacaccgccgcggtatcgctccacggcgggcccgccaccaatcgcgactacttacgtcaacgacaagtcgccctcggcaacatggaaacgaaagaaagcaaagccatacgccaacacgccgaatccgccggctgctcaatggtcgaagacatcgagtcccccagctccatctgggtcttcgccggcgcccccgaccgctgcccaccaacctgcctattcatagcaggcatcgctgaactcggagccttcttctccatcctccaagacatgcgcaacaccatcatggcatcaaaaaccgttggcaccagcgaagaaaagctacgaaagaaaagctccttctaccaaagctacctacgcagaacacagtcaatgggcatccaactagaccaacgcatcatagtcctctttatggtcgcctggggcaaagaagcagtcgacaaccaccactgggcaaacgccatcggatccgaactccgcaccctcgctcaatcactcatagacgtaaaagtcaaagaaatatccaaccaagaaccactaaaactctaa

SEQ ID NO: 7728 - RNA, 1290 nt, synthetic construct
  misc_feature 1..1290: note = derived and/or modified CDS sequence (opt11) from HTNV(Aa03-161)__KT935024.1__N
  source 1..1290: mol_type = other RNA
atggcgacaatggaagaactacaacgcgaaatcaacgcccacgaaggacaactggtcatagccagacaaaaggtcagagacgccgaaaaacaatacgaaaaagacccagacgaactcaacaaaagggctctaaccgaccgcgaaggagtagcagtaagcatacaagccaaaatagacgaactcaaacgacaactagcagaccggatcgcaactgggaaaaacctcggaaaagagcaagaccccacgggcgtcgaaccaggagaccacctgaaagaacgatccatgctaagctacggaaacgtcctggacctcaaccacttagacatagacgaaccgaccggacaaacagccgactggctaagcatagtcgtatacttaacatcattcgtagtcccaatcctcctaaaagcactctacatgctaacaacccgcggcagacaaacaaccaaagacaacaaagggacaaggatcagattcaaagacgacagctcattcgaagacgtaaacgggatccgaaaacccaaacacctctacgtctcactcccgaacgcacaaagctcaatgaaagcagaagaaatcacacccggcagataccgcacagccgtatgcggcctatacccagcgcaaataaaagcacgccagatgatctcaccagtcatgagcgtgatcggattcctagcactagccaaagactggagcgacagaatagaacaatggctcagcgaaccctgcaaactcctaccagacgcggcggcagtcagcctcctcggcggccccgcaaccaacagagactacctacgccaaagacaggtcgcactaggaaacatggaaaccaaagaaagcaaggcaattcgacagcacgcggaagcagccgggtgctcaatgatagaagacatcgaaagcccgagctccatctgggtattcgccggcgccccggaccgctgcccacccacatgcctcttcatcgccggaatcgccgaactgggcgccttcttttccatactccaagacatgcgaaacaccataatggcgagcaaaaccgtaggaaccagcgaagaaaaactccggaagaaaagctcattctaccaatcatacctacgaagaacccaaagcatgggcatccaactagaccagcgaataatcgttctctttatggtggcctggggcaaggaagccgtcgacaacttccacctaggcgacgacatggaccccgaactacgaacactcgcacaatccctcatagacgtaaaagtaaaagaaatctcgaaccaagaaccgctcaaactatga

SEQ ID NO: 7729 - RNA, 1290 nt, synthetic construct
  misc_feature 1..1290: note = derived and/or modified CDS sequence (opt11) from HTNV(Aa04-722)__KU207190.1__N
  source 1..1290: mol_type = other RNA
atggcgaccatggaggaactccagcgcgagatcaacgcccacgaaggccaactggtgatagcccgacaaaaagtaagggacgcggaacgtcaatacgaaaaagacccagacgagcttaacaaacgagcactcaccgaccgagagggcgtagccgtatcaatccaagcaaaaatagacgaactcaaacgacaactcgcggaccgcatcgcgaccggcaaaaacctcggaaaagaacaggacccaactggcgtggaacccggcgaccacctcaaagaacgctcaatgctatcctacggcaacgtactagacctcaaccatctcgacatcgacgaacccacagggcaaacagccgattggctgagcatagtcgtgtacttgacatccttcgtggtaccaatcctactcaaagccctatacatgctcacaacccggggtagacaaaccaccaaagacaacaaaggaacaagaataagattcaaagacgacagcagcttcgaagacgtcaacggcataaggaaaccgaaacacctctacgtctcactcccaaacgcccaatcgagcatgaaagccgaggaaatcacgcccggccgctatcgcacagccgtatgcggactctacccagcacaaataaaagcacgacaaatgatcagcccagtaatgagcgtaatcggcttcctagcactggccaaagactggagcgaccgcattgaacaatggcttagcgaaccatgcaaactcctcccagacaccgccgcggtatcactcctaggcgggcccgcaaccaaccgcgactacctccgccaacgccaagtcgccctcggcaacatggaaaccaaagaaagcaaagccatccgacaacacgcagaagcagctggatgctcaatgatagaagacatcgaatccccaagctcgatctgggtctttgccggcgccccagacagatgcccacccacatgcctcttcatagccggaatcgccgaactcggcgcattcttcagtatactccaagacatgcgcaacaccataatggcaagcaaaaccgtcggaacaagcgaagaaaaactacgcaagaaaagcagcttctaccaatcgtacctacgaagaacccaaagcatgggcatacaactagaccaacgcataatagtcctcttcatggtcgcctggggcaaagaagccgtcgacaacttccacctgggcgacgacatggacccggaattacgaacactcgcgcaatcactaatagacgtaaaagtcaaagaaatctcgaatcaagaacccctcaaactctaa

SEQ ID NO: 7730 - RNA, 1290 nt, synthetic construct
  misc_feature 1..1290: note = derived and/or modified CDS sequence (opt11) from HTNV(Aa05-190)__KT935027.1__N
  source 1..1290: mol_type = other RNA
atggcaaccatggaagaactccaacgcgaaataaacgcccacgaaggacaactggtaattgccagacaaaaagtccgagacgcagaaaaacaatacgaaaaagacccagatgaactcaataaaagagccctcaccgaccgcgaaggcgtggcagtaagcatacaagcaaaaatagacgaactcaaacgacaactcgcggaccggatcgccaccggcaaaaacctcggaaaagaacaagaccccacaggtgtagagccaggagaccacctaaaagaacgctccatgctgagctacggcaacgtactcgacctcaaccacctcgacatcgacgaaccaaccggccaaaccgcagactggctaagcatcgtagtgtacctaacctcattcgtcgtccccatcctactcaaagccctctacatgctcacaacccgcggcaggcaaacaaccaaagacaataaaggcacccgtatcagattcaaagacgacagttctttcgaagatgtaaacgggatacggaaacccaaacacctctacgtctcactcccaaacgcacaatccagcatgaaagccgaagaaattacccccggacgataccgtacagcagtatgcggactctaccccgcacaaataaaagcacgccaaatgataagcccggtcatgagcgtgatcggattcctggccctcgccaaagattggagcgaccgcatcgaacaatggctatccgaaccctgcaaactactccccgacacagccgccgtctccctactaggcgggccagcaaccaaccgcgactacctacgacaacgacaagtcgcgctcggaaacatggaaacaaaagaaagcaaagccatcagacaacacgcggaagccgccggctgctcaatgatcgaagacattgagagcccaagctcaatctgggtcttcgccggagccccggacagatgcccgccgacatgcctattcatcgccggcatagcagaactcggagcgttcttcagcatactacaagacatgcgcaacaccatcatggcaagcaaaaccgtaggcacatccgaggaaaagctacgaaagaaatcctcgttctaccaatcctacctacgccgcacacaatcaatgggcatacaactagaccaacgaatcattgtgctattcatggtagcctggggaaaagaagcggtcgacaacttccaccttggcgacgacatggacccagaactacgcacactcgcccaatcgttgatagacgtaaaagtaaaagagatctcgaaccaagaacccctcaaactctag

SEQ ID NO: 7731 - RNA, 1290 nt, synthetic construct
  misc_feature 1..1290: note = derived and/or modified CDS sequence (opt11) from HTNV(Aa10-123)__KT935036.1__N
  source 1..1290: mol_type = other RNA
atggcaaccatggaagaactccagcgcgaaatcaacgcccacgaaggacaactcgtcatagcccgacaaaaagtcagagacgcagaaaaacaatacgaaaaggaccccgacgaactcaacaaaagagccctcactgaccgcgaaggcgtcgccgtaagcatccaagcaaaaatcgacgaactcaaacgccaactcgcagacagaatagccaccggcaaaaacctcggaaaagaacaagaccccaccggagtcgaaccgggcgaccacttaaaagaacgctccatgctctcctacggcaacgtcctcgacctcaaccacctagacatcgacgaacccaccggccaaaccgccgactggctaagcatagtagtatacctgacctccttcgtagtcccaatcctactcaaagcactgtacatgctcaccacccgaggaagacaaacaaccaaggacaacaaaggaacaagaatcagattcaaggacgactcctccttcgaagacgtcaacggcatcagaaaaccaaaacacctctacgtctcactaccgaacgcacaatcctccatgaaagcagaagaaataacaccagggcgctaccgcacagcagtatgcggcctataccccgcacaaataaaagcccgccaaatgatcagcccagtcatgagcgtgatcgggttcctagcactagccaaagactggtcagatcgaatagaacaatggctaagcgaaccatgcaaactgctcccagacaccaccgcagtatccctcctaggcgggcccgcgaccaaccgcgactacctaagacagcgccaagtcgccctcggaaacatggaaacgaaagaaagcaaggccatccgacaacacgcagaagcggccggatgctcgatgatcgaagacatcgagagcccctccagcatatgggtcttcgccggggccccagaccgctgcccacccacatgcctgttcgtggccggaatcgcagaattaggagcattcttcagcatactacaagacatgcgaaacaccataatggcaagcaagaccgtaggcacgagcgaagaaaaactcagaaagaaaagctcattctaccaaagctacctccgcagaacccagtccatgggaatacaactagatcaacgcatcatcgtactcttcatggtcgcctggggcaaagaagcggtcgataacttccacctcggtgacgacatggacccagaactccgcaccctagcgcaatccctcatagacgtcaaagtgaaagaaatctccaaccaagagccccttaaactctaa

SEQ ID NO: 7732 - RNA, 1290 nt, synthetic construct
  misc_feature 1..1290: note = derived and/or modified CDS sequence (opt11) from HTNV(Aa10-265)__KU207194.1__N
  source 1..1290: mol_type = other RNA
atggccaccatggaagaactccaacgagaaataaacgcccacgaaggacaactcgtcatagcccgacaaaaagtccgcgacgccgaaaaacagtacgagaaagaccccgacgaactcaacaaacgcgccctcaccgaccgcgaaggcgtcgccgtatccatccaagcaaaaatcgacgaactcaaacgacaactagccgaccgaatcgccaccggcaaaaacctcggcaaagaacaagaccccaccggagtcgaacccggagaccacctcaaagaacgctctatgctctcctacggcaacgttctcgaccttaaccacctcgacatcgacgaaccaaccggacagacggcggactggctctccatcgtcgtctacctaacctcattcgtcgtcccaatcctactaaaagcactatacatgctcaccacccgcggccggcagaccacaaaagacaacaaagggacccgcatccgattcaaagacgacagctcattcgaggacgtcaacggcatacgcaaaccaaaacacctatacgtctccctacccaacgctcagtcctcaatgaaagcagaagaaatcacacccggccgctacagaaccgccgtctgcggcctttaccccgcacaaataaaagcccgccagatgatatcacccgttatgagcgtaatcggatttctagccctcgccaaagactggagcgaccgaatcgaacaatggctctccgaaccctgcaaactcctcccagacacagcagcagtatccctactcggaggacccgcaaccaaccgagactacctccgccagcgccaagtcgccctcggcaacatggaaaccaaagaaagcaaagccatcaggcagcacgccgaagccgcaggctgctccatgatagaagacatcgagagcccctccagcatatgggtattcgccggcgcccccgaccgatgccccccaacatgcctgttcgtagcaggaatcgccgaactcggcgccttcttctcaatcctccaagacatgagaaacaccatcatggccagcaaaaccgtcggcacctccgaagaaaaactccgtaaaaaaagctccttctaccaatcttacctccgtcgaacccaatccatgggcatacaactagaccaacgcataatcgtcctcttcatggtcgcctggggcaaagaagccgtcgacaacttccacctcggcgacgacatggacccagaactccgcacactcgcccaatccctaatcgacgtaaaagtcaaagaaatctcaaaccaagaacccctaaaactatag

SEQ ID NO: 7733 - RNA, 1290 nt, synthetic construct
  misc_feature 1..1290: note = derived and/or modified CDS sequence (opt11) from HTNV(AA1028)__AF427318.1__N
  source 1..1290: mol_type = other RNA
atggccacaatggaggaactacagcgagaaatcaacgcacacgaagggcagctagtcatagcacgccaaaaagtacgcgacgccgaaaaacaatacgaaaaagaccccgacgaactcaacaaaagagccctcacagatagagaaggcgtggcagtgtccatacaggcaaaaatagacgagctcaaacgccagctcgccgacaggatcgccaccggcaaaaacctaggcaaagaacaagaccccacaggcgtcgagcccggagaccacctaaaagaacgaagcatgctatcctacggcaacgtcctcgacctaaaccacctcgacatcgacgaacccaccggccaaaccgcagactggctaagcatcgtcgtatatctaaccagcttcgtagtcccaatcctactaaaagcactatacatgctaaccacaaggggcagacaaacaacaaaagacaacaaaggaacacgcatcagattcaaagacgacagctcattcgaagacgtcaacggaatacgaaaacccaaacacttatacgtctcactccccaacgcccagtcaagcatgaaagccgaagaaatcacgcccggccgctaccgaacagccatatgcggactgtacccagcacaaataaaagcccgccaaatgatcagccccgtaatgagcgtaatcgggttcctagccctagccaaagactggagcgaccgcatagaacaatggctcagcgaaccatgcaaactactacccgacacggccgccgtaagcctactcggaggccccgccaccaacagagactacctacgccaacgacaggtcgccctcggaaacatggaaaccaaagaaagcaaagcaatccgacagcacgcagaagccgctggatgctcaatgatcgaagacatcgaatcaccctcctccatctgggtcttcgccggcgcaccagaccggtgcccgcccacatgcctattcatcgccggaatcgccgaactaggcgccttctttagcatcctccaagacatgcgaaacaccatcatggcgtcaaaaacagtaggcaccagcgaggaaaaactacgcaagaaaagctcattctaccaatcatacctccgccgaacacaaagcatgggcatccaactggaccaacgaataatcgtactatttatggtagcctggggcaaagaagccgtcgacaacttccacctcggcgacgacatggaccccgaactccgaaccctcgcacaatcactcatcgacgtcaaagtcaaagaaatctccaaccaagaacccctgaaactataa

SEQ ID NO: 7734 - RNA, 1290 nt, synthetic construct
  misc_feature 1..1290: note = derived and/or modified CDS sequence (opt11) from HTNV(Aa10-434)__KT935038.1__N
  source 1..1290: mol_type = other RNA
atggccaccatggaagaactccaacgcgaaataaacgcccacgaaggacagctagtcatcgcacgccaaaaagtcagagacgcggaaaagcaatatggcaaagatcccgacgaactcaacaaacgagcccttacagaccgcgaaggtgtcgcagtaagcatacaagccaaaatagacgaactcaaaagacaactcgcagaccgaatcgccaccggcaaaaacctagggaaagaacaagacccaacaggcgtcgaacccggcgaccacctcaaagaacgctcaatgctcagctacggcaacgtcctagacctgaaccacctagatatcgacgaaccaaccggccaaacagctgactggctcagcatcgtcgtatacctaacctcattcgtcgtacccatcctcctcaaggccctctacatgctaaccacccgcggccgacaaaccaccaaagacaacaaaggaacccgaatccgcttcaaggacgacagctccttcgaagacgtcaacggaatcagaaaaccaaaacacctctacgtatccctaccaaacgcccaatcatccatgaaagccgaagagatcacccccggccgctaccgaaccgccgtctgcggcctctaccccgcacaaataaaagcccgacaaatgatatccccagtcatgagcgtcatcggattcctagcactagccaaagactggagcgaccgaatcgaacaatggctctccgagccatgcaaactcctcccggacaccgccgccgtatcactcctaggaggccccgcaacaaaccgcgactacctacgccaaagacaagtagccctaggcaacatggaaacaaaagaaagcaaggccatacgccaacacgccgaagcggcaggatgctcaatgatcgaagacatcgaaagcccgagctcaatttgggtcttcgccggtgcccccgaccgatgcccaccaacctgcctattcattgcgggcatcgcagaacttggcgcattcttcagcatcctccaagacatgcgcaacaccatcatggcaagcaagacagtcggaacgtcagaagaaaaactacgcaagaaaagctcattctaccaaagctacctccgacgcacccaaagcatgggcatacaactcgaccaacgaatcatcgtcctcttcatggtcgcatggggaaaagaagcggtcgacaacttccacctcggggacgacatggaccccgaactcagaaccctagcccaatcccttatcgacgtcaaagtcaaagaaatctccaaccaagaacccctcaaactataa

SEQ ID NO: 7735 - RNA, 1290 nt, synthetic construct
  misc_feature 1..1290: note = derived and/or modified CDS sequence (opt11) from HTNV(Aa14-362)__KT935049.1__N
  source 1..1290: mol_type = other RNA
atggcaaccatggaggaactccaaagagagatcaacgcccacgaaggacagctagtcatagcgcgccaaaaagtacgagacgcagaaaaacaatacgaaaaagacccagacgaactgaataaacgagctttaaccgaccgcgaaggcgtagccgtaagcatacaagccaagatcgacgaactcaaacgccaactagccgaccgaatcgcaaccggcaaaaacctaggaaaagaacaagatcccacaggcgtggaaccaggcgaccacctaaaagaacgctcaatgctcagctacggcaacgtcctcgaccttaaccacctcgacatagacgaacccaccggacaaactgccgactggctcagcatagtcgtatacctgacctcgttcgtcgtaccgatcctactcaaagccctatacatgctcacaacccgaggacggcaaacaacaaaagacaacaaaggcaccagaatcagattcaaggacgacagctccttcgaagacgtaaacgggatccgaaaaccgaaacatctctatgtcagcctccccaacgcccaatccagcatgaaggcagaagaaatcacaccaggacgctaccgcacagcagtctgcggactctaccccgcacaaataaaagcacgacaaatgatatccccggtcatgagcgtgatcggatttctcgcactcgccaaagactggagcgaccgagtcgaacaatggctaagtgaaccctgtaaactattaccagacacggccgcggtctccctcctgggcggacccgcgacaaaccgcgactacctgcgacaacgccaagtagccctcggcaacatggaaaccaaagaaagcaaagcaatccgccaacacgctgaagcagccggctgctcaatgatcgaagatatagagagcccgagcagcatctgggtcttcgccggggcaccagaccgctgcccacccacatgcctcttcatcgcaggaatcgcagaactcggcgcattcttcagtatcctccaagacatgcgaaacacaattatggcgagcaaaaccgtaggcacaagcgaagaaaaactccgcaagaaaagctcattctaccaatcatacctacgcagaacccagagcatgggaatccaactcgaccagcgcataatagtcctcttcatggtcgcctggggcaaagaagccgtcgacaacttccacctgggcgacgacatggacccagaactaagaaccctcgcacaatcactaatagacgtgaaagtaaaagaaatctcaaaccaagaaccgctcaaactctag

SEQ ID NO: 7736 - RNA, 1290 nt, synthetic construct
  misc_feature 1..1290: note = derived and/or modified CDS sequence (opt11) from HTNV(Aa14-404)__KT935052.1__N
  source 1..1290: mol_type = other RNA
atggccaccatggaagaactacaacgcgagataaacgcacacgaagggcaactcgtcatcgcccgccaaaaagtgagagacgcagaaaaacaatacgaaaaggaccccgacgaactcaacaaacgcgccctcacagaccgggaaggcgtagcagtctcaatccaagccaaaatagacgagctaaaaagacaactagccgaccgcatagccaccggcaaaaacctaggaaaagaacaggatcccacaggagtcgaacccggcgaccacctaaaagaacgatccatgctctcctacggaaacgttctcgacctaaaccacctagacatcgacgagccaaccggccaaaccgccgactggctaagcattgtcgtatacctcacatccttcgtcgtacccatcctactcaaagccctatacatgctgaccacccgcggccgccaaaccaccaaagacaacaaaggcacacgaatccgattcaaagacgactcctcgttcgaagacgtcaacggcatccgcaaacccaaacacctatacgtctccctaccaaacgcccaatccagcatgaaagccgaagagatcacacccggaagataccgcactgccgtatgcggcctctatcccgcccaaataaaagcaagacaaatgatatcccccgtaatgagcgtaatcggcttcctcgccctcgcaaaagactggtctgaccgaatagaacagtggctaagcgaaccctgcaaactcctccccgacaccgccgcagtaagcctactcggcggaccagccacaaaccgagactacctgcgccaacgacaagtagccctcggcaacatggaaaccaaggaatccaaagcaatccgccaacacgccgaagccgccggctgcagcatgatcgaagacatcgagagtccatcatccatctgggtattcgcaggcgcccccgaccgctgcccacccacctgtctcttcatcgccggaatcgccgaactaggcgccttcttcagcatactgcaagacatgcgaaacaccatcatggcgtccaaaaccgtcggcacctcagaagaaaaactcagaaagaaatcatctttctaccaatcatacctacgccgcacccaatccatgggaatacaactcgaccaacgcatcatcgtgctattcatggtcgcatggggcaaagaagccgtagacaacttccacctgggagacgacatggaccccgagctccgcacactcgcccaatcactgatcgacgtcaaagtgaaagaaatatccagccaagaaccactaaaactctaa

SEQ ID NO: 7737 - RNA, 1290 nt, synthetic construct
  misc_feature 1..1290: note = derived and/or modified CDS sequence (opt11) from HTNV(Aa15-56)__KU207195.1__N
  source 1..1290: mol_type = other RNA
atggcaaccatggaagaactccaaagagaaatcaacgcccacgaaggccagctagtcatcgcccgccaaaaagtccgcgacgccgaaaaacaatacgaaaaagaccccgacgaactaaacaaacgagccctcaccgaccgagaaggcgtagccgtcagtatccaagcaaaaatcgacgaactcaaacgccaactagcagaccgaatcgccaccggcaaaaacctcgggaaagaacaagaccccaccggagtcgaacccggagaccacctcaaagaaagaagcatgctctcctacggcaacgtcctcgacctcaaccacctcgacatagacgaacccaccggccaaaccgccgactggctcagcatcgtagtatacctaacatcattcgtcgtcccaatcctacttaaagccctctacatgctaaccacccgaggcagacaaacaaccaaagacaacaaaggcacacgcataagattcaaagacgacagctccttcgaagacgtaaacggcatacgcaaacccaaacacctctacgtaagcctaccaaacgcgcaatcctccatgaaagccgaagaaatcaccccaggccgctaccgcacagcagtatgcggactctacccagcgcaaatcaaagcacgccaaatgatctcacccgtaatgtccgtcatcggcttcctagccctagcaaaagactggagcgaccgcatcgaacaatggctcaacgaaccatgcaaactcctacccgacacagctgcggtctccctcctaggaggacccgccacaaaccgcgattacctacgccaacgccaagtagccctgggcaacatggaaaccaaagaatccaaggccatccgacaacacgcggaagccgccggatgctcaatgatcgaagacatagaaagcccctcatccatctgggtcttcgcaggcgcccccgaccgctgcccgcccacatgcctgttcatcgccgggatcgccgaactgggcgcgttcttcagcatactacaagacatgcgcaacaccataatggcctccaaaacagtaggaaccagcgaagaaaaactacgcaagaaatcatccttctaccaatcctacttacgcagaacacaatcaatgggcatccaactcgaccaacgaatcatcgtactattcatggtggcctggggaaaagaagccgtggacaatttccacctcggagacgacatggaccccgaactccgcacactcgcacaatccctcatcgacgtaaaagtcaaagaaatatcaaaccaagaacccctaaaactctaa

SEQ ID NO: 7738 - RNA, 1290 nt, synthetic construct
  misc_feature 1..1290: note = derived and/or modified CDS sequence (opt11) from HTNV(AA1719)__AF427319.1__N
  source 1..1290: mol_type = other RNA
atggccaccatggaagaactccaacgtgaaatcaacgcccatgaaggacaactcgtcatagcacgccaaaaagtccgggacgccgaaaaacaatacgaaaaggaccccgacgaactcaacaaacgagccctaaccgaccgcgaaggcgtcgcggtatccatccaagctaaaatagacgaactcaaaagacaactagccgaccgcatcgctacaggcaaaaacctcggaaaagaacaagacccaaccggcgtcgaaccgggagaccacctcaaagaaagatccatgctcagctacggcaacgtcctagatctaaaccacctagacatcgacgagcccacaggccaaacagccgactggttatccatcgtcgtatacctcacctcattcgtagtcccaatcctacttaaggccctctacatgctcacaacacgcggccgccaaacaacaaaggacaacaaaggaacaagaatacgctttaaagacgactcctcattcgaagacgtgaacggcatacgcaaacctaaacacctatacgtctccctacccaacgctcaatcaagcatgaaagcagaagagataacaccaggacgctaccgcacagctatctgcggactctaccccgcccaaatcaaagcccgacaaatgatcagcccagtcatgtcagtcatcggcttcctcgccctagcaaaagactggtccgaccgcatcgaacagtggctgagcgaaccctgtaaactactcccagacaccgccgccgtctccctcctcggcggcccagccactaatcgagactacctccgccaacgccaagtcgcactcggcaacatggaaaccaaagaatcaaaagccatacgccaacacgccgaagccgccggatgctcaatcatcgaagacatcgaaagcccgtcatccatctgggtcttcgcaggagcccccgaccgctgcccacccacatgcctattcatcgccggaatagcggaactaggagcattcttcagcatactacaagacatgcgcaacaccataatggcatccaaaaccgtcggcaccagcgaagaaaaacttcgcaagaaatcgtcattctaccaatcctacctacgccgcacccaaagcatgggcatccaactggaccaacgcataatcgtcctcttcatggtggcctggggcaaagaggccgtcgacaacttccacctaggagacgacatggacccggaactacgcaccctcgcccaaagcctcatagacgtcaaagtcaaggaaatctctaaccaggaacccctaaagctataa

SEQ ID NO: 7739 - RNA, 1290 nt, synthetic construct
  misc_feature 1..1290: note = derived and/or modified CDS sequence (opt11) from HTNV(AP1168)__AF427323.1__N
  source 1..1290: mol_type = other RNA
atggccacaatggaagaactccaaaaagaaatcaacgcccacgaggggcaactcgtaatcgcacgccaaaaagtccgcgacgccgaacgacaatacgaaaaagaccccgacgagctcaacaagcgcgctctaacagaccgcgaaggcgtcgccgcctccattcaagcaaagatagacgagctgaaacgacaactagccgaccgaatcgcaaccggaaagaacctcggaaaagaacaagatcccacaggagtcgaaccaggcgaccacctcaaagaacgatcaatgctctcctacggcaacgttctagacctcaaccacctagacatagacgaacccacaggacaaaccgccgactggctatccatcgtagtctacctcacctccttcgtcgtaccaatactcctcaaagcactctacatgctcaccacccgcggccgccagaccaccaaagacaacaaaggaacccgcatacgatttaaagacgactcttcattcgaggacgtaaacggcatcagaaaacccaaacacctctacgtctcactccccaacgcccagagctccatgaaagccgaagaaataacccccggccgctaccgcaccgccatctgcggcctttacccagcacaaatcaaagcccgccaaatggtatcccccgtcatgtcagtcatcggcttcctcgccctcgccaaagactggggagaccgcatagaacaatggctttcagaaccctgcaagctcctccccgacaccgcagctgtcagcctccacggaggcccagctacaaaccgagactacctcagacaacgacaagccgccctcggcaacatggaaacaaaagaatccaaagcaatacgccaacacgccgaaacagccggctgctcaatgatcgaagacatcgaaagcccctccagcatatgggtcttcgccggcgcacccgaccgatgcccgcccacatgcctattcatagccggcatcgccgaactcggcgcattcttctcaatactccaagacatgcgcaacaccatcatggcatccaaaaccgtaggcaccagtgaagaaaaactaagaaagaaatcctccttctaccaatcatacctccgacgcacacaatctatgggaatccaactagaccaacgcatcatcgtcctattcatggtcgcctggggcaaagaagcagtagacaacttccacctaggcgacgacatggaccccgagctcagaacactagcccaatccctcatcgacttaaaagtcaaagaaatatcgaaccaagaacccctaaaactgtaa

SEQ ID NO: 7740 - RNA, 1290 nt, synthetic construct
  misc_feature 1..1290: note = derived and/or modified CDS sequence (opt11) from HTNV(AP708)__AF427322.1__N
  source 1..1290: mol_type = other RNA
atggcaaccatggaagaactccaaaaagaaattaacgcccacgaaggacaactcgtcatagcccgccaaaaagtccgggacgccgaacgccaatacgaaaaagaccccgatgaactaaacaagcgagccctcaccgaccgcgaaggcgtcgccgccagcatccaggccaaaatagacgaactcaaacgtcaactcgccgaccgcatagcaaccggcaaaaaccttggtaaagaacaagatcccacaggcgtcgaacccggagaccatctaaaagaacgctcaatgctatcatacggcaacgtccttgacctcaaccacctcgacatagacgaaccaacaggccaaaccgcagattggctctccatcgtcgtatacctaacatctttcgtcgtacccatcctattaaaagcactctacatgctcacaacacgcggccgtcaaaccacgaaggacaacaaaggcacacgaatacgcttcaaagacgactcctctttcgaagacgtcaacggcatccgcaaacccaaacatctatacgtctccctcccgaacgcacaatcatccatgaaagccgaagaaataacacccgggcgctacagaaccgccatctgcggcctctacccggcccaaatcaaagcccggcaaatggtgagccccgtcatgtccgtaattgggttcctggccctagcaaaagactggggcgatcgcatagaacaatggctcagcgaaccctgcaaactcctacccgacacagccgccgtctcgctccacggcggccccgccaccaaccgcgactacctccgccaacgacaagccgcactaggcaacatggaaaccaaagaatcaaaagccatacgacagcacgccgaaaccgccggatgcagcatgatcgaagacatagaatccccgtcctccgtctgggtattcgccggcgcccccgaccgatgcccgccaacctgcctcttcatagccggaatcgccgaactaggcgcattcttctccatcctccaagacatgcgcaacaccatcatggcctccaaaaccgtcggcacatcagaagaaaaactccgcaagaagtcatccttctaccaatcctacctccgacgcacacaaagcatgggtatccagctcgaccaacgcatcatcgtactctttatggtcgcctggggaaaagaagccgtcgacaacttccacctcggcgacgacatggaccccgaactgcgcaccctagcacaatccctaatagacctcaaagtaaaagaaatctccaaccaagaacccctcaagctctaa

SEQ ID NO: 7741 - RNA, 1290 nt, synthetic construct
  misc_feature 1..1290: note = derived and/or modified CDS sequence (opt11) from HTNV(DandongHu-32)__KC570386.1__N
  source 1..1290: mol_type = other RNA
atggccaccatggaagaactacaacgcgaaatcaacgcccacgaaggccagctagtaatcgcccgccaaaaagtccgcgacgcagaaaaacaatacgaaaaagacccagacgaactaaacaaacgagccctaaccgaccgagaaggagtcgccgtctccatccaagcaaaaatcgacgaactaaaacgccaactcgccgaccgcatcgccacagggaaaaacctaggaaaagaacaagaccccaccggagtagaaccgggcgaccacctgaaagaacgctcaatgctaagctacggcaacgtcctcgacctcaatcacctagacatcgacgaacccaccggacaaaccgcagactggctcagcatcgtcgtctacctcacatccttcgtcgtacccatcctactcaaagccctctacatgctcactacccgaggccgccaaacgaccaaggacaacaaaggaacccgaatcagattcaaagacgacagctccttcgaggacgtcaacggaatccgcaaacccaaacacctctacgtcagcctacccaacgcccaatcctccatgaaagcggaagaaataacgcccggccgctaccgcaccgcaatctgcggactataccccgcgcaaatcaaagcacgacaaatgatctcccccgtaatgtccgttatcggcttcctcgccctcgccaaagactggagcgaccgcatcgaacaatggctctccgaaccatgcaaactcctccccgacacagcagccgtctccctcctaggcggaccagccaccaaccgagactacctacgacaacgccaagtcgcgctcggtaacatggaaacaaaggaaagcaaagccatacgccagcacgccgaagcagccggctgctccatgatcgaagatatagaatcaccctcatccatatgggtcttcgccggcgcaccggaccggtgcccgcccacatgcctattcatcgccggcatcgccgaactcggcgcgttcttctccatcctccaagatatgcgcaacaccataatggcgagcaaaacagtcggcacctcagaggaaaaactaagaaagaaaagctcattctaccaatcataccttcgccgcacccaatccatgggaatacaactagaccaacgaatcatcgtactattcatggtggcgtggggcaaagaagccgtcgacaacttccacctaggcgacgacatggacccagaactacgcatactagcccaatccctcatcgacgtaaaagtaaaagagatatccaaccaagaacccctgaaactctaa

SEQ ID NO: 7742 - RNA, 1290 nt, synthetic construct
  misc_feature 1..1290: note = derived and/or modified CDS sequence (opt11) from HTNV(DandongHu-34)__KC570387.1__N
  source 1..1290: mol_type = other RNA
atggccaccatggaagaactccaacgagagataaacgcccacgaaggccaactcgtcatcgcacgccaaaaagtaagagacgcggaaaaacaatacgaaaaagaccccgacgaactaaacaaacgagcactcacagaccgagaaggcgtcgccgtctcaatacaagccaaaatagacgaactcaaacgccaactcgccgaccgcatcgccaccgggaagaacctcggaaaagagcaagaccccacaggagtcgaaccaggtgaccacctgaaagaacgcagcatgctcagctacggcaacgtactagacctaaaccaccttgacatcgacgaaccaaccggacaaaccgcagactggctctcaatagtcgtctacctcacctccttcgtagtgcccatcctactcaaggccctatacatgctcacaacccgcggcagacaaaccacaaaggacaacaagggcacccgaataagattcaaagatgacagctccttcgaagacgtaaacggcatccgaaaacccaaacacctatacgtaagcctccccaacgcgcagtcctcaatgaaagccgaagaaatcacccccggacgataccgcaccgccatatgcggcctataccccgcccaaataaaagcacgccaaatgatctccccagtcatgtccgtcataggattcctagcactagcaaaagactggagcgaccgaatcgagcaatggctctcagaaccctgcaaactcctcccagacactgccgcagtaagcctcctaggaggccccgccacaaaccgcgactacctgcgtcaacgccaagtcgccctaggcaacatggaaaccaaagaatccaaagccatacgccaacacgcagaagcagctggatgcagtatgatcgaagacatagaaagcccatcctccatctgggtattcgccggcgcccccgaccgctgcccacccacatgcctcttcatagcagggatggccgaactcggcgcattcttcagcatccttcaagacatgcgaaacaccatcatggcatcaaaaaccgtcggcacatccgaagaaaaactacggaagaaaagctcattctaccaatcctacctccgccgcacacaaagcatgggcatacaactcgaccagcgaataatcgtactcttcatggtggcctggggcaaagaagcagtagacaacttccacctcggagacgacatggaccccgaactacgcaccctcgcacaatcactcatagacgtcaaagtgaaagaaatctcaaaccaggaaccactcaaactctag

SEQ ID NO: 7743 - RNA, 1290 nt, synthetic construct
  misc_feature 1..1290: note = derived and/or modified CDS sequence (opt11) from HTNV(DandongHu-89)__KC570389.1__N
  source 1..1290: mol_type = other RNA
atggccaccatggaagaactccaacgcgaaatcaacgcccacgaaggccaactcgtcatcgcccgacaaaaagtcagagacgccgaaaaacaatacgaaaaagatcccgacgaactcaacaagcgtgcactcaccgaccgcgaaggcgtcgccgtctccatccaagcaaaaatcgacgaactcaaacgccaactggcagaccgaatcgccacaggcaaaaacctaggcaaggaacaagaccccaccggcgtcgaaccaggcgaccacctcaaagaacgttcaatgctcagctacggcaacgtcctagacctaaaccacctcgatatcgacgaacccacaggccaaaccgccgactggctctccatagtagtctacctgacctccttcgtcgtaccaatactactaaaagcactctacatgctaaccacccgcggcagacaaacaaccaaagacaacaaagggacccgcatacgcttcaaggacgacagtagcttcgaggacgtaaacggaatccgtaaacccaaacacctctgcgtcagcctcccaaacgcacaatcatcaatgaaggcagaagaaataaccccaggccgctatcgcaccgccatctgcggcctctacccagcccaaatcaaagccagacaaatgatctccccggtcatgtccgtaatcggcttcctcgccctcgccaaagactggagcgacagaatagaacaatggctctccgaaccctgcaaactcctaccagacacagccgccgtctcactcctcggcgggcccgccaccaaccgcgactacctacgacaacgccaagtcgccctcgggaacatggagacaaaagaaagcaaagccatccgccaacacgccgaggcagccgggtgcagcatgatcgaagacatagaaagcccatcctccatctgggtcttcgccggcgcccccgaccgatgcccgcccacatgcctattcatagcaggaatcgcggaactcggcgccttcttctcaatactccaagacatgcgcaacaccataatggcctccaaaaccgtcggaacatccgaagaaaaactacgaaagaaatcctcattctaccaaagctacctacgacggacccagagcatgggcatccaactcgaccaacgaatcatagtactattcatggtagcatggggcaaggaagccgtagacaacttccacctaggcgacgacatggatcccgaactacgcaccctagcccaatcactaatcgacgtaaaagtaaaagaaatcagcaaccaggaacccctaaaactttaa

SEQ ID NO: 7744 - RNA, 1290 nt, synthetic construct
  misc_feature 1..1290: note = derived and/or modified CDS sequence (opt11) from HTNV(DandongHu-91)__KC570390.1__N
  source 1..1290: mol_type = other RNA
atggccaccatggaggaactacaacgagaaatcaacgcacacgaaggtcagctagtcatcgcccgccaaaaagtccgcgacgcagaaaaacaatacgaaaaagaccccgacgaactaaacaaacgcgccctcacagaccgcgaaggcgtcgcagtatccatacaagcaaaaatcgacgaactaaaaaggcaactcgccgaccggatcgccaccggcaaaaacctcggaaaagaacaagaccccaccggcgtcgaacccggcgaccacctcaaagaacgctcaatgctctcatacggaaacgtcctcgaccttaaccacctcgacatagacgaaccaaccggccaaacagcagactggctcggcatcgtcatctacctcacctccttcgtcgtcccaatactcctcaaagccctatacatgctcaccacccgcggccgacaaaccaccaaagacaacaaaggcacccgcattcgattcaaagacgactcctccttcgaagacgtcaacggcatccgaaaaccaaaacacctctacgtcagcctccccaacgcacaatccagcatgaaagccgaagaaatcaccccaggacgctaccgaaccgccatctgcggactctacccagcccaaatcaaagcccgccaaatgatctcccctgtaatgtcagtcatcggcttcctagccctcgcaaaagactggtcagatcgcatcgaacaatggctatccgaaccttgcaaactcctcccagacacagccgccgtatccctactcggaggccccgccactaaccgcgactacctaagacaacgccaagtcgccctcggcaacatggaaaccaaagaatccaaagccatacgacaacacgcagaagcagcaggatgctccatgatcgaagacatcgaatcaccgagcagcatatgggtcttcgccggcgcccccgaccgctgccctccaacctgcctctttatcgccggcatggccgaactaggagccttcttcagcatcctccaagacatgcgcaacacaatcatggcctccaaaaccgtaggcacctccgaggaaaaactccgaaagaaatcctccttctaccaaagctacctccgacgcactcaaagcatgggcatacaattagaccaacgaataatcgtactattcatggtcgcctggggcaaagaagcagtggacaacttccacctaggagacgacatggacccagaactcagaaccctagcacaaagcctcatcgacgtaaaagtaaaagaaatcagcaaccaagagcccctcaaactctaa

SEQ ID NO: 7745 - RNA, 1290 nt, synthetic construct
  misc_feature 1..1290: note = derived and/or modified CDS sequence (opt11) from HTNV(Fuyuan-Aa-145)__KJ857349.1__N
  source 1..1290: mol_type = other RNA
atggccaccatggaagaacttcaacgcgagatcaacgcccacgaaggacaactcgtcatagctcgccaaaaagtcagagacgccgaaaaacaatacgaaaaggacccagacgaactcaacaaaagggccctaacagaccgcgaaggcgtagcagtaagcatacaagcgaaaatcgacgaactcaaacgacagctcgcagacagaatcgctaccgggaaaaacctcggaaaagaacaagacccaacaggcgtagaaccaggagaccatctcaaagaacgatccatgctatcctacggaaacgtactggacctcaaccacctagacatagacgaaccaacaggacaaacagcagactggctaagcatagtcgtatacctcacctccttcgtagtaccaatcctactcaaagctctgtacatgctcaccaccagaggccgacaaaccaccaaagacaacaaaggcacccgcatcagattcaaggacgatagctcgttcgaagacgtcaatggaattagaaaaccaaaacacctctatgtcagcctcccaaacgcccaatccagcatgaaagcagaagaaatcacacccggacgctaccgaacagccatatgcggcctccacccagcacagataaaagcacgccaaatgatctctcccgtcatgagcgtaatcggattcctggccctagccaaagactggtccgaccgcatagaacaatggctcagcgaaccctgcaaactgctcccagacaccgccgccgtctccctcctcggcggccccgccacaaacagagactacctcagacaacgccaggtagcactcgggaacatggaaaccaaagaaagcaaggccatacgccaacacgccgaagccgccggatgctcgatgatcgaagacatagaaagcccaagctccatctgggtattcgccggcgccccagaccgatgcccgcccacatgtctgttcatcgccggaatcgccgaactcggcgcattcttcagcatactccaagacatgagaaacaccataatggccagcaaaaccgtgggcaccagcgaggaaaaactccgaaagaaatccagcttctaccaatcctacctgcgccgcacccagagcatgggcatacaacttgaccaacgcataatcgtgcttttcatggtcgcctggggcaaagaagcagtcgacaacttccacctgggcgacgacatggaccccgaactacgcacgctagcgcaatcactcatagacgtaaaagtaaaagaaatctccaaccaagaaccactcaaactctaa

SEQ ID NO: 7746 - RNA, 1290 nt, synthetic construct
  misc_feature 1..1290: note = derived and/or modified CDS sequence (opt11) from HTNV(Fuyuan-Aa-26)__KJ857347.1__N
  source 1..1290: mol_type = other RNA
atggcaacaatggaggaactccaacgcgagatcaacgcacacgaaggccaactggtaatcgccagacaaaaagtccgcgacgcagaaaaacaatacgaaaaagacccagacgagctcaacaaaagagcactcaccgaccgcgaaggagtagcagtgtccatccaagcaaaaatagacgagctcaaacgacaacttgccgacaggatcgccaccgggaaaaacctcggaaaagaacaagaccccaccggcgtggaaccaggcgaccacctaaaagaacgatcaatgctaagctacggaaacgtcctcgacctaaaccatctcgacatcgacgaacccaccggacaaacagccgactggctcagcatagtcgtctatctaacctccttcgcggttcccatcctactcaaagccctgtacatgctcacgacccgaggccggcaaacgaccaaagacaacaaagggacccgaatcagattcaaagacgactcctcactcgaagacgtaaacggaatccgaaaaccaaaacacctctacgtctccctcccaaacgcacaaagcagcatgaaagccgaagagatcacacccggccgctaccgcacagccatatgcggactctaccctgcccaaatcaaagcgcgacaaatgatcagcccggtcatgagcgtaataggcttcctcgccctagccaaggactggagtgaccgcatagaacaatggctaagcgagccatgcaaactactcccagacacagctgcagtctccctcctaggcggccccgccacaaaccgcgactacctgcgccaacgtcaagtcgccctcggaaacatggaaacaaaagaaagcaaggcaatacgccaacacgcagaagccgctggttgctcaatgatagaagacatcgaaagtcccagctcaatatgggtcttcgccggagcaccagacaggtgcccaccgacctgccccttcatcgccggtatcgccgaactgggcgcattcttcagcatactccaggacatgcgaaacaccataatggccagcaaaaccgtcggcacaagcgaagaaaaacttagaaagaaaagctccttctatcaatcatacctccgccgcacccaatccatgggcatccaactagaccagcgcataatcgtactcttcatggtagcctggggaaaagaagccgtcgataacttccacttaggagacgacatggaccccgaactccgcacactcgcccaatccctaatagacgtgaaagtcaaagaaatctccaaccaagaaccgctcaaactctag

SEQ ID NO: 7747 - RNA, 1290 nt, synthetic construct
  misc_feature 1..1290: note = derived and/or modified CDS sequence (opt11) from HTNV(JS1)__KP970572.1__N
  source 1..1290: mol_type = other RNA
atggccaccatggaagaactacaacgcgaaataaacgcccacgaaggccagctagtcatcgcccgacaaaaagtccgcgatgccgaaaaacaatacgaaaacgacccggatgaactcaacaaaagagccttaaccaaccgcgagggcgtcgcagtatccatccaagcaaaaatcgacgaactcaaacgccaattagcagaccgcatcgcaaccggcaaaaaccttggcaaagaacaagaccccaccggtgtcgaacccggagaccacctaaaggagcgatcgatgctatcatacggcaacgtcctcgacctaaaccacctcgacatcgacgaaccaaccggacaaaccgccgactggctcagcataatcgtatacctcacctcattcgtagtcccaatactcctcaaagccctctacatgctaaccacacgcggcagacaaaccaccaaagataacaaaggcacccgcatacgattcaaagacgactcatccttcgaagacgtcaacggcatcagaaagcccaaacacctctacgtctccctccccaacgcccaatcctcaatgaaagccgaagaaatcacccccggccgctaccgcacagccgtctgcggcctctatcccgcccaaattaaagcacgtcaaatgatatcccccgtcatgagcgtaataggattcctcgccctcgccaaagactggtccgaccgaatcgaacaatggctcatcgaaccatgcaaactcctaccagacacagccgccgtctccctcctcggcggtcccgccaccaaccgggactacctccgccaacgccaagtcgccctcggaaacatggaaaccaaggaatccaaagccatacgccaacacgccgaagccgcaggctgcagcatgatcgaggacatcgaatcaccatcatctatatgggtcttcgccggagccccagaccgctgcccacccacatgcctcttcatagccggcatcgccgaactaggcgccttcttctccatcctccaagacatgcgcaacaccataatggcctccaaaaccgtcggcaccagcgaagaaaaactccgaaagaaaagctcattctaccaatcatacctccgacgcacccagtccatgggcatccaactagaccaacgcatcatcgtcctcttcatggtagcctggggcaaagaagccgtcgacaacttccacctcggcgacgacatggaccctgaactccgcaccctagcccaaagcctaatcgacgttaaagtaaaggaaataagcaatcaagagcccctcaaactatag

SEQ ID NO: 7748 - RNA, 1290 nt, synthetic construct
  misc_feature 1..1290: note = derived and/or modified CDS sequence (opt11) from HTNV(LongquanAa-08-150)__JQ912697.1__N
  source 1..1290: mol_type = other RNA
atggcaaccatggaagaactacaacgcgaaatcgatgcccacgaaggccagctcgtcatagcccgccaaaaagtccgtgatgcagaaaaacaatacgaaaaagaccccgacgaactcaacaaacgcgccctaaccgacagagaaggcgtcgccgccagcattcaagcaaaaatcgacgaacttaaacgccagctcgcagacaggatcgccaccggcaaaaacttaggcaaagagcaagacccaaccggagtcgaacccggcgaccacctcaaagaacgctcaatgctctcctacggaaacgtcctagacctcaaccacctcgacatcgacgaacccaccggccaaaccgccgattggctctccatcgtcgtctacctcacctcattcgtcgtacccatcctactcaaagccctctacatgctcaccacccgcggccgtcaaacaacgaaagacaacaaaggcacccgcatcagattcaaggacgacagctcattcgaagacgtcaacggcatccgcaaacccaaacacctctacgtcagcctcccaaacgcccaaagcagcatgaaggcagaagaaatcacccccggacgctatcgcaccgcaatatgcggcctctaccccgcccaaatcaaagcccgacaaatgattagccccgtcatgtccgtcatcggattcctcgccctagccaaagactgggcagaccgcatagaacaatggctctccgagccctgcaagctactacccgacacagccgccgtctccctccacggcggaccagccaccaaccgcgactacttacgacaacgccaagtagccctaggcaacatggaaaccaaagaatcaaaagccatccgccaacacgcagaaaccgccggatgctcaatgatcgaagacatcgaaagtccctcctccatctgggtcttcgccggcgcccccgaccgatgcccacccacttgcctattcatcgccggcatagcagagctaggcgcattcttctcaatcctacaagacatgcgaaacaccataatggcctcaaagacggtcggcaccagcgaagaaaaactacgaaagaaatcctccttctaccagtcctaccttcgacgcacccaatcgatgggcatccaactagaccagcgcatcatcgtcctcttcatggtcgcatggggcaaagaagcagtcgacaacttccacctcggagacgacatggacccagaactacgcacactcgcccaaagcctcatagacgttaaagtcaaagaaatctccaaccaggagcccttaaaactataa

SEQ ID NO: 7749 - RNA, 1290 nt, synthetic construct
  misc_feature 1..1290: note = derived and/or modified CDS sequence (opt11) from HTNV(LongquanAa-08-157)__JQ912698.1__N
  source 1..1290: mol_type = other RNA
atggcaacaatggaagaactccaacgcgaaatcaacgcccacgaaggacagctagtaatagcacgccaaaaagtccgagacgccgaaaaacaatacgaaaaagaccccgacgaactcaacaaacgcgccctcaccgacagagaaggcgtcgccgccagcatccaagccaaaatcgacgaactcaaaagacaactcgcagaccgcatcgcaaccggcaaaaacctaggcaaagaacaagaccccaccggcgtcgaacccggcgaccacctaaaggaaagaagcatgctatcctacggcaacgtcctcgacttaaaccacctcgacatcgacgagcccacaggccaaaccgccgactggctcagcatagtcgtctacctcacatccttcgtcgtaccaatactactcaaagccctctacatgctaaccactcgaggcagacaaaccactaaagacaacaaaggcacccgcatccgcttcaaagacgactcatccttcgaagacgtcaacggaatccgcaaacccaaacacctatacgtcagccttcctaacgcacaaagcagcatgaaagccgaagaaatcaccccaggccgttaccgaacagctatctgcggcctctacccagcacaaatcaaagcccgccaaatgatatcaccagtcatgtcagtcatcggattcctcgcactagcaaaggactgggcagaccgcatcgaacaatggctcagcgaaccctgcaaactcctccccgacaccgccgccgtctcactccacggcggccccgccaccaaccgcgactacctacgacaacgccaagtcgccctcggcaacatggaaaccaaagaatcgaaagccatccgacaacacgccgaaaccgctggctgcagcatgatcgaagacatcgaatcaccatcaagcatctgggtattcgcaggcgccccagaccgatgccctccaacctgcctattcatcgccggcatcgcagaactcggcgccttcttctcaatcctacaagacatgcgcaacactataatggcctccaaaacggtaggaacctcagaagagaaactccgcaagaaatcctcattctatcaaagctacctcagaagaacacaatccatgggcatccaactcgaccaacgaatcattgtactcttcatggtagcctggggcaaagaagctgtcgacaacttccacctcggagacgacatggaccccgaactccgtaccctcgcacaaagcctaatcgacgtcaaagtcaaagaaatcagcaaccaagagcccctaaaactataa

SEQ ID NO: 7750 - RNA, 1290 nt, synthetic construct
  misc_feature 1..1290: note = derived and/or modified CDS sequence (opt11) from HTNV(LongquanAa-08-314)__JQ912709.1__N
  source 1..1290: mol_type = other RNA
atggccaccatggaagaactccaacgagaaatcaacgcccacgaaggccaactggtcatcgcccgacaaaaagtccgagacgccgaaaaacaatacgaaaaagaccccgacgaactcaacaaacgtgccctcaccgaccgcgaaggcgtagccgcctccatgcaagccaaaatcgacgaactgaaacggcagctagccgaccgcatcgccaccggcaaaaacctcggaaaagaacaagaccctaccggcgtcgaaccaggagaccacctgaaagaacgcagcatgctgtcatacggaaacgtcctcgatctaaaccacctcgacatagacgaaccaacaggccagacagccgactggctcagcatagttgtctacctaaccagcttcgtcgtaccaatcctcctcaaagcactatacatgctaacaaccagaggccggcaaaccacaaaagacaacaaaggcacccgaatccgcttcaaagacgacagctcattcgaagacgtaaacggcatccgcaaacccaaacacctctacgtcagcctacccaacgcccaatcctcaatgaaagccgaagaaatcacaccaggccgataccgaaccgccatctgcggactataccccgcccagatcaaagcacgacaaatgatctcccccgtcatgtccgtgatcggcttcctcgccctagcaaaagactgggccgacagaatcgaacaatggctctccgaaccctgcaaactactccccgacacagccgccgtctccctccatggcggacccgcgaccaaccgcgactatctccgccaacgccaagtcgccctcggcaacatggaaacgaaagaaagcaaggccatccggcagcacgctgaaaccgccggctgctccatgatagaagacatcgaatcaccctcctcaatctgggtattcgccggcgccccagaccgctgcccaccgacctgcctgttcatcgcagggatcgcagaactaggagccttcttctcaatcctacaagacatgcgcaacaccataatggccagcaaaacggtcggaacctccgaagaaaaactccgaaagaaaagctccttctaccaaagctacctacgcagaacccaatcaatgggcatccaactcgaccaacgcattatagtcctcttcatggtagcatggggcaaagaagccgtcgacaacttccacctcggcgacgacatggaccccgaactccgcaccctcgcccaatcactcatcgacgtcaaagtaaaagagatctccaaccaggaacccctcaaactctaa

SEQ ID NO: 7751 - RNA, 1290 nt, synthetic construct
  misc_feature 1..1290: note = derived and/or modified CDS sequence (opt11) from HTNV(LongquanAa-08-573)__JQ912714.1__N
  source 1..1290: mol_type = other RNA
atggccaccatggaagaactacaacgggaaataaacgcccacgagggacaactcgtaatagcacgacaaaaagtccgcgacgccgaaaaacaatacgaaaaagaccccgacgaactaaacaaaagagccctaaccgacagagaaggcgtagccgccagcatacaagcaaaaatcgacgaactcaaacgccaactggcagatcgaatcgccaccggcaaaaacctcggcaaagaacaggaccccaccggtgtcgaacccggagatcacctcaaagaacgttccatgctatcctacggtaacgttctcgacctaaaccacctcgacatagacgaacccacaggccaaaccgcagactggctcagtatcgtcgtctacctgaccagcttcgtagtccccatcctcctcaaagccctctacatgctcacaacacgcggccgccaaacgaccaaagacaacaaaggaacccggatacgattcaaagacgactccagcttcgaagacgtcaacggcatcagaaaacccaaacacctctacgtttccctaccaaacgcccaaagctccatgaaagccgaagaaatcacccccggacgctaccgcaccgcaatatgcggcctctacccagcccaaataaaagcacgccaaatgatctcaccagtaatgtcagtcataggattcctcgccctagccaaagactgggccgaccgaatcgaacaatggctctccgaaccctgtaaactcctaccagacaccgccgcagtcagcctacacggcggacctgccaccaaccgcgactacctacgccaacgccaagtcgccctaggaaacatggaaaccaaagaaagcaaagccatccgccaacacgccgcaacagcaggatgctccatgatcgaggacatcgaatccccctcatccatctgggtcttcgccggcgcacccgaccgttgcccaccaacctgcctcttcatagcaggcatcgccgagctcggcgccttcttcagcatcctacaagacatgcgcaacacaatcatggcaagcaaaacagtaggaacatccgaagaaaaactccgcaagaaaagctcattctaccaaagctacctacgccgcacccaatccatgggaatccaactcgaccagcgaatcatcgtactcttcatggtggcatggggcaaagaagcagtcgacaacttccacctcggagacgacatggacccagaactgagaacactagcccaatcactcatagacgtcaaagtcaaagaaatctccaaccaggagcccctaaaactctaa

SEQ ID NO: 7752 - RNA, 1290 nt, synthetic construct
  misc_feature 1..1290: note = derived and/or modified CDS sequence (opt11) from HTNV(LongquanAa-09-113)__JQ912716.1__N
  source 1..1290: mol_type = other RNA
atggcaacaatggaagaactccaacgagaaataaacgcccacgaaggacagctagtcatcgcccgtcaaaaagtccgcgacgcagaaaaacaatacgaaaaagaccccgacgaactcaacaaacgcgcactcaccgaccgcgaaggagtagccgcctcaatacaggctaaaatcgacgagctcaaaagacaactcgcagacagaatcgcaacgggtaaaaacctcggaaaagaacaagaccccacaggcgtagaacccggcgaccacttaaaagaaagatcaatgctatcctacggaaacgtactagaccttaaccacctcgatatcgacgaacccaccggccaaaccgccgactggctcagcatagtcgtatacctcacctccttcgtcgtcccaatactactcaaagccctctacatgctcaccacacgaggcagacaaaccacaaaagacaataaagggacccggatacgcttcaaagacgactccagcttcgaagacgtcaacggcacccgtaaaccaaaacacctatacgtatccctcccaaacgcccaatccagcatgaaagccgaagaaatcacgcccgggcgctaccgcaccgcaatctgcggactgtaccccgcccaaatcaaagcccgacaaatgatctcccccgtcatgagcgtcatcggattcctcgccctagccaaagactgggcagaccgaatagaacaatggctatccgaaccatgcaaactcctaccagacacagccgcagtctccctacacggcggccccgcaaccaacagagactacctacgccaacgacaggtcgcactcggaaacatggaaacaaaagagagcaaagccatacgacaacacgccgaaacagccggctgctcaatgattgaagacatcgagtcaccctcatcaatatgggtcttcgccggcgccccagaccgctgcccaccaacatgcctattcatagccggaatcgcagaactaggagcattcttctcaatcctacaagacatgcgaaacaccatcatggcctcaaaaaccgtaggcacatccgaagaaaaacttcgcaagaaaagctcgttctaccaatcttacctgcgccgcacccagagcatgggcatccaactcgaccaacgaatcatcgtcctattcatggtagcctggggaaaagaagccgtcgacaacttccacctgggagacgacatggaccccgagctccgcaccctagcccaaagcctaatagacgtcaaagtaaaagaaatcagcaaccaagaacccctcaaactatag

SEQ ID NO: 7753 - RNA, 1290 nt, synthetic construct
  misc_feature 1..1290: note = derived and/or modified CDS sequence (opt11) from HTNV(LongquanAa-09-191)__JQ912719.1__N
  source 1..1290: mol_type = other RNA
atggcaaccatggaggaactccaacgcgaaatcaacgcccacgaaggccaactcgtcatcgccagacaaaaagtccgcgacgccgagaaacaatacgaaaaagacccggacgaactcaacaaacgcgccctcaccgaccgcgaaggcgtcgcagcctcaatccaggcaaaaatcgacgaactgaaacgccaactagccgaccgaatcgccaccggcaaaaacctcggaaaagaacaagaccccaccggcgtcgaacccggcgaccacctaaaagaacgctcaatgctaagctacggaaacgtactcgacctcaaccacctcgacatcgacgaaccaaccggccaaaccgcggactggctctcaatcgtcgtatacctcacgagcttcgtcgtccccatcctactcaaagccctttacatgctcacaacccgaggccgacaaacaatcaaagacaacaaaggaacccgtatacgattcaaagacgactcctcattcgaagacgtcaacggtatacgcaaaccaaaacacctctacgtaagcctacccaacgcccaatcctcaatgaaagccgaagaaatcacccccggccgctaccgaacagccatatgcggcttataccccgcccaaatcaaagcccgccagatgatatcccccgtaatgtccgtaatcggattcctagccctcgcaaaagactgggccgaccgcatcgaacaatggctatcggaaccatgcaaactcctcccagacaccgccgccgtatcactccacggcggtcccgcaaccaaccgcgactacctcagacaaagacaagtcgccctcggaaacatggaaaccaaagaatccaaagccatccgccaacacgcagaaaccgccggctgctcgatgatcgaggacatagaatccccctcatcaatatgggtcttcgccggcgcccccgaccgctgtcccccaacatgcctcttcatcgccggaatagccgaactcggcgcatttttctcaatcctacaagacatgcgaaacacaatcatggcatcgaaaaccgtcggcacctccgaagaaaaactacgcaagaaatcatccttctaccaatcctatcttcgccgaacccaaagcatgggcatacaactcgaccaacgcatcattgtcctcttcatggtcgcctggggaaaagaagccgtcgacaactttcacttaggcgacgacatggaccccgaactccgaaccctagcacaatctctcatcgacgtaaaagtaaaagaaatctcaaaccaggagcccctcaaactataa

SEQ ID NO: 7754 - RNA, 1290 nt, synthetic construct
  misc_feature 1..1290: note = derived and/or modified CDS sequence (opt11) from HTNV(LongquanAa-09-192)__JQ912720.1__N
  source 1..1290: mol_type = other RNA
atggccaccatggaagaactccaacgcgaaatcaacgcacacgaaggccaactcgtcatcgcccgccaaaaagtccgggacgccgaaaaacagtatgaaaaagacccagacgaactcaacaaacgcgccctaaccgacagagagggcgtagccgcaagcatgcaaggcaaaatagacgagctcaaacgccagcttgcagaccgaatagccacaggcaaaaacctcggaaaagagcaagaccccacaggcgtagaaccaggtgaccacctcaaagagcgtagcatgctatcatacggcaacgtcctcgacctcaaccacctcgacatcgacgaacccaccggacaaacagcagactggctaagcatagtcgtctacctgacctcattcgtcgtccccatactcctcaaagcactctacatgctcacgacccgaggaagacaaaccaccaaagacaacaaaggaacccgcatccgcttcaaagacgacagctccttcgaagacgtaaacggaatccgaaaaccaaaacacctatacgtatcactcccgaacgcgcaatcaagcatgaaagccgaagaaatcacacccggacgctaccgcacagcaatatgcggactctaccccgcccaaataaaagcacgacagatgataagcccagtcatgagcgtaatcggattcctagccctagcaaaagactgggccgacagaatcgaacagtggctctccgagccctgcaaactcctaccagacaccgcagcagtatccctacacggcggaccagccacaaaccgcgactaccttcgccaacgccaagtcgcgctcggcaacatggaaaccaaagaaagcaaagcaatccgccaacacgcagaaacagcagggtgctccatgatagaagacatcgaatccccctcaagcatctgggtattcgccggagcaccagaccgctgcccaccaacatgcctgtttatcgccggcatcgcagaactaggagcgttctttagtatcctacaggatatgcgcaacaccatcatggcaagcaaaacggtcggcaccagtgaggaaaaactcaggaaaaaatcatcattctaccaaagctacctccgaagaacccaaagcatgggcatccaactagaccagcgcataatagtactcttcatggtagcctggggaaaagaagcagtcgacaacttccacctaggcgacgacatggacccggaactccgaacgctagcacaatcactcatagacgtaaaagtaaaagagatctcaaaccaggaacccctcaaactctag

SEQ ID NO: 7755 - RNA, 1290 nt, synthetic construct
  misc_feature 1..1290: note = derived and/or modified CDS sequence (opt11) from HTNV(LongquanAa-10-46)__JQ912754.1__N
  source 1..1290: mol_type = other RNA
atggcgaccatggaagaactacaacgagaaatcaacgcccacgaaggccagctcgtaatagcaagacaaaaagtccgcgacgcagaaaaacaatatgaaaaagaccccgacgaactaaacaaacgggccctcaccgaccgcgaaggcgtcgccgcatcaatacaagccaaaatagacgagctcaaacgacaactcgccgaccgcattgccaccggcaaaaacctcggcaaagaacaagaccccaccggcgtcgaaccaggcgaccacctcaaagaacgaagcatgctaagctacggcaacgtcctagacctcaaccacctagacatagacgaacccacaggacaaacggccgactggctcagcatagtcgtatacctcacctccttcgtcgtcccaatactcctcaaagccctgtacatgctcaccacgagaggccgccaaaccacaaaagacaacaaaggaacaagaatccgctttaaagacgacagctccttcgaagacgtaaacggcatccgcaaaccagaacacctctacgtctcgctcccaaacgcccaatcctctatgaaggccgaagaaataaccccaggccgataccgcaccgccatctgcggcctataccccgcccaaataaaagcacgccaaatgatcagcccagtaatgagcgtcatcggattcttagccctcgcaaaagactgggccgaccgcatcgaacaatggctgtccgaaccctgcaaactactccccgacaccgcggccgtatcactccacggtggcccagccaccaatcgcgactacctccgccaacgccaagtcgccctcggcaacatggaaaccaaagaaagcaaagcaatccgccaacacgccgagacagcaggctgctcaatgatcgaagacatcgaaagccccagcagcatctgggtcttcgcaggcgcccccgaccgctgcccaccaacctgcctattcatcgcaggcatcgccgaactcggcgcattcttctcaatccttcaagacatgcgcaacacaatcatggcctccaaaacagtaggaacaagcgaagaaaaactccgcaagaaatccagcttctaccaaagctacctacgccgtacgcaatcaatgggaatccaacttgaccaacgcataatcgtcctattcatggtcgcatggggcaaagaagccgtcgacaacttccacctcggcgacgacatggaccccgaactgcgcacactcgcccaatccctcatcgacgtcaaagtcaaagaaatctcgaaccaagaacccctaaaactctaa

SEQ ID NO: 7756 - RNA, 1290 nt, synthetic construct
  misc_feature 1..1290: note = derived and/or modified CDS sequence (opt11) from HTNV(LongquanAa-11-745)__KC344237.1__N
  source 1..1290: mol_type = other RNA
atggccaccatggaagaactacaaaaagagatcaacgcccacgaaggccaactcgtcatagcccgacaaaaagtacgagatgccgaaaaacaatacgaaaaagaccccgacgaactcaacaaacgcgccctcacagaccgagaaggcgtcgccgccagcatccaggccaaaatcgacgaactaaaacgccaactcgccgaccgcatcgccaccggcaaaaacctcggcaaagaacaagaccccaccggcgtcgaacccggcgaccacttaaaagaacgctccatgctctcctacggcaacgtattagatctcaaccacctcgacatcgacgaaccaacaggacaaaccgcagactggttatcaatcgtagtatacctcacctcattcgtagtcccgatactactgaaagccctatacatgctaaccaccaggggacgacaaacaaccaaagacaacaaaggcacacgcatccgcttcaaagacgactcctccttcgaagacgtcaacggcatccgaaagccaaaacacctatacgtatccttaccaaacgcacaatcctccatgaaagccgaagaaatcacccccggccgctaccgaaccgccatctgcggcctctacccagcccagatcaaagcccgccaaatgatctcaccggtcatgtccgtcataggctttctcgccctagcaaaagactgggccgaccgcatcgaacaatggttgtccgaaccctgcaaactacttcccgataccgctgctgtctcactccacggaggcccagccaccaaccgcgactacctccgacaacgacaagtcgccctaggaaacatggaaaccaaagaatccaaagcaatacgccaacacgcagaaaccgctggatgctcaatgatcgaagacatcgagagcccctcctcaatctgggtcttcgccggtgcaccagaccgatgcccacccacctgtctcttcatagctggcatcgccgaactaggggccttcttctccatcctccaggacatgcgcaacaccataatggcgagcaaaaccgtcggcaccagcgaagaaaaactaagaaagaaaagctccttctaccaatcatacctccgacgaacccaatcaatgggaatccaactagaccaacgcatcatcgtcctcttcatggtagcatggggaaaagaagccgtcgacaacttccacctcggcgacgacatggaccccgaactccgcacactagcccaatcactcatcgacgtaaaagtaaaagaaatctcaaaccaagaacccctcaaactctaa

SEQ ID NO: 7757 - RNA, 1290 nt, synthetic construct
  misc_feature 1..1290: note = derived and/or modified CDS sequence (opt11) from HTNV(ROKA14-11)__KU207207.1__N
  source 1..1290: mol_type = other RNA
atggccaccatggaagaactacaacgagaaataaacgcccacgaaggacaactggtcatcgcccgacaaaaagtcagagacgccgaaaaacaatacgaaaaggaccccgacgaactcaacaaacgcgcactaacagaccgagaaggcgtagccgtctccatccaagccaagatagacgaactaaaacgccaactcgccgaccgcatcgcgaccggcaaaaacctcggcaaagaacaagacccaacaggcgtggaaccaggcgaccacctaaaagagcggtcgatgctctcatacggaaacgtccttgacctcaaccacctcgacatcgacgaaccgaccggacaaacagcagactggctgagcatcgtagtatacctaacctccttcgtcgtcccaatactcctcaaagccctatacatgctcaccaccaggggccgccaaacaaccaaagacaataaaggcaccagaatacgattcaaagacgacagcagcttcgaagacgtcaacggcatacgaaaaccaaaacacctatacgtctccctaccgaacgcgcaatcaagcatgaaagccgaagaaataacaccaggcagataccgaacagccgtctgcggactataccccgcccaaataaaagcacgccaaatgatatccccagtaatgtccgtaatcgggttcctagccctcgccaaagattggtcagaccgcatagaacaatggctatccgaaccctgcaaactactacccgacaccgcagccgtctcactcttaggcggccccgcgaccaaccgcgactacctacgccaacgccaagtcgccctagggaacatggaaaccaaagaatccaaggcaatccgccaacacgccgaagccgccggctgctctatgatcgaagatatagaaagcccctcatcaatctgggtcttcgccggcgcacccgaccgatgcccacccacatgcctattcgtagccggcatcgcagaactcggagccttcttcagcatcctacaggacatgcgaaatacaatcatggcatccaaaaccgtaggcacaagcgaagagaaaatgcgcaagaaaagctcattctaccaatcgtacctccgtcgcacccaaagcatgggtatacaactggaccaacgcatcatagtcctcttcatggtagcctggggcaaagaagccgtggacaacttccaccttggcgacgacatggaccccgaactccgcaccctagcacaatcgctaatcgacgtaaaagtcaaagaaatcagcaaccaagaaccactcaaactctaa

SEQ ID NO: 7758 - RNA, 1290 nt, synthetic construct
  misc_feature 1..1290: note = derived and/or modified CDS sequence (opt11) from HTNV(US8A14-2)__KU207208.1__N
  source 1..1290: mol_type = other RNA
atggcgaccatggaagaactacaaagagagatcaacgcccacgaaggacagctagtcatagccagacaaaaggtaagagacgcagaaaaacaagatggcaaagacccggacgaactcaacaaacgcgcactaaccgaccgcgaaggcgtcgccgtaagcatacaagcgaaaattgacgaactcaagcgtcagctcgccgacagaatcgccaccggcaaaaacctcggaaaagaacaagaccccacaggagtagaaccgggagaccacctaaaagagagatcaatgctcagctacggcaacgtcctggacctaaaccacctcgatatagacgagcctacaggacaaaccgccgactggctcagcatagtcgtatacctcacgtcattcgtagtcccaatcctactcaaggccctatacatgctaaccacccgaggccgacaaacaaccaaagacaacaaaggaacccggatcagattcaaagacgacagctcattcgaagacgtgaacgggatcagaaaacccaaacacctctacgtctcactacccaacgcccaatcgagcatgaaagccgaagaaattacacccggacgataccgcacagccgtatgcggactctaccccgcccaaataaaagcacgacaaatgataagccccgtaatgagcgtaatcggattcctagcgctagccaaagactggagcgaccgcatcgaacaatggctcagcgagccctgcaaactcctcccagacacagccgccgtctcactcctcggcggacccgcaaccaaccgagactacctacgacagcgacaagtcgcactcggaaatatggaaaccaaagaaagcaaagccatacgccagcacgcagaggccgccggatgctcaatgatagaagacatagagagcccgagctccatctgggtcttcgccggagccccagaccgatgcccacccacatgcctcttcatagccgggatcgcagaattaggagcattcttcagcatactccaggacatgagaaacaccataatggcgagcaagaccgtcggcaccagcgaagaaaaactcagaaagaaaagctcattctaccaatcgtacctacgccgcacacagagcatgggcatacaactggaccaaagaataatcgtgctattcatggtagcctggggcaaagaagctgtagacaacttccacctgggcgacgacatggaccccgaactacgcacactcgcacaatccctcatagacgtaaaagtcaaagaaatctcaaaccaagaacccctaaaactctag

SEQ ID NO: 7759 - RNA, 1290 nt, synthetic construct
  misc_feature 1..1290: note = derived and/or modified CDS sequence (opt11) from HTNV(US8A15-1)__KU207209.1__N
  source 1..1290: mol_type = other RNA
atggcaaccatggaagaactacaacgcgagatcaatgcccacgaaggacagctagtaatcgctcgccaaaaagtcagagacgccgaaaaacaatacgaaaaagaccccgacgaactcaacaaacgcgccctgaccgaccgagaaggagtcgccgtctccatacaagccaaaatcgacgaactaaaacgacaactcgccgacagaatcgcgacaggcaaaaacctaggaaaagaacaagacccaaccggagtcgagccaggagaccacctaaaagagcgctcaatgctctcctatggcaacgtactcgacctaaaccacctcgacatcgacgaacccacaggccaaacggcagactggctttccatcgtcgtatacctcaccagcttcgtagtacccatcctcctaaaagcactctacatgctcacaaccagaggcagacaaaccaccaaagacaacaaaggaacacgcatacgattcaaagacgactcatcattcgaagacgtcaacggaatccgaaaaccaaaacacctctacgtctcactcccaaacgcccaatcctccatgaaagccgaagaaatcacccccggccgataccgaaccgccgtctgcggcctctaccccgcacaaataaaagcgagacaaatgatcagccccgtcatgagcgtgataggcttcctcgccctcgcaaaggactggtccgaccgcattgaacaatggctctcagaaccctgcaagctcctccccgacaccgcagccgtatcactactcggaggccctgccacgaacagagactacctacgacagcgccaagtcgcgctaggcaacatggaaaccaaagaatccaaagcaatccgccaacacgccgaagccgccggatgcagcatgatagaggacatagaatccccaagcagcatctgggtcttcgccggagcaccagaccgatgcccacccacatgcctattcatagccggcatcgccgaactcggcgccttcttcagcatactccaagacatgcgcaacaccataatggcatccaaaatcgtaggcaccagcgaagaaaaactccgaaagaaaagctccttctaccaatcctacctccgccgaactcaaagcatgggcattcaactcgaccaacgaatcatcgtactcttcatggtagcttggggaaaagaagcagtcgacaacttccacctcggcgacgacatggaccccgaactacgcaccctcgcacaatcactcatagacgtaaaagtcaaagaaatctccaaccaagaaccactcaaactctaa

SEQ ID NO: 7760 - RNA, 1290 nt, synthetic construct
  misc_feature 1..1290: note = derived and/or modified CDS sequence (opt11) from HTNV(YaluRiver13)__HQ611981.1__N
  source 1..1290: mol_type = other RNA
atggccaccatggaagaactccaacgcgagatcaacgcccatgaaggacaactcgtaatcgccagacaaaaagtacgcgacgccgaaaaacaatacgaaaaagaccccgacgaactcaacaaaagagccctaacagatcgtgaaggcgtagccgtaagcatccaagccaaaatagacgaactcaaacgccaactagcggaccgcatagcaaccgggaaaaacctcggcaaagaacaagacccaaccggagtcgaacccggcgaccacctcaaagaacgctccatgctcagctacggcaatgtcttagacctaaaccacctcgacatagacgaacccaccggccaaaccgcagactggctcagcatcgtcgtctatctcacatccttcgtcgtccccatcctactcaaagccctatacatgctcacaacccgcggcggacaaacaaccaaggacaacaaaggcacccggatccggttcaaagacgacagctcattcgaagacgtaaacggcatccgaaaaccaaaacacctctacgtctccctcccaaacgcccagtcaagcatgaaagcagaagaaatcactcccggccgctaccgtacagccatatgcggtctataccccgcacaaataaaagcccgccaaatgatctccccagtcatgagcgtcatcggattcctcgccctcgcaaaagactggagcgaccgcatagaacaatggctcagcgagccctgcaaactcctccccgacaccgcagccgtatcactcctgggaggcccagcgacaaaccgcgactacctacgtcagcgccaggtcgcactcggaaacatggaaaccaaagaatcaaaagccatccgacaacacgccgaagccgccggctgctccatgatagaagacatcgaatccccatcctccatctgggtcttcgccggtgccccagacaggtgcccacccacatgcctcttcatagcctccatcggagagctcggcgcgttcttctccatccttcaagacatgagaaacaccattatggcaagcaaaaccgtgggcacctcagaagaaaaacttcgaaagaaaagctcattctaccaatcttacctgcgtcgcacacaaagcatgggcatacaactagaccagcgaatcatcgtcctcttcatggtctcctggggcaaagaagcagtcgacaatttccacctaggcgacgacatggacccggaactccgcactctcgcccagtcactaatcgacgtcaaagtaaaagaaatccccaaccaagaaccgctcaaactataa

SEQ ID NO: 7761 - RNA, 1290 nt, synthetic construct
  misc_feature 1..1290: note = derived and/or modified CDS sequence (opt11) from HTNV(84FLi)__AY017064.1__N
  source 1..1290: mol_type = other RNA
atggccacaatggaagaactccaacgagaaatcaacgcacacgaaggccagctagttatcgcccgccaaaaagtcagagacgctgaaaaacaatatgaaaaagaccccgacgaactcaacaaacgcaccctcaccgaccgcgaaggcgtcgcagcctccatacaagccaaaatagacgaactcaaacgccaactagcagaccgcatcgcaacaggcaaaaacctcggaaaagagcaagaccccaccggcgtcgaaccaggcgaccacctaaaagaacgatccatgctcagctatggaaacgtcctcgacctcaactacctcgacatcgacgaacccaccggacaaaccgcagactggctctccatcgtcatatacctcacctcattcgtcgtccccatcctcctaaaagccctgtacatgctcaccaccagaggccgccaaaccacaaaagacaacaaaggtacccgcatccgcttcaaagacgactcctccttcgaagacgtcaacgggatccgaaaacccaaacacctctacgtctccctacccaacgcccaatcaagcatgaaagccgaagaaattacaccaggccgataccgcactgccatctgcggactctaccccgcacaaataaaagcgagacaaatgatctccccagtaatgagcgtaatcggcttcctcgccctggccaaagactggtccgatcgaatcgaacaatggctctccgaaccctgcaaactcctccccgacaccgccgccgtctccctccacggcggccccgcaaccaaccgagattacctacgccaacgacaagtcgcactcggaaacatggaaacgaaagaaagcaaagccatccgacaacatgccgaatcagccggatgctccatgatagaagacatagaatcacccagcagcatctgggtcttcgccggcgccccagaccgctgcccaccaacatgcctattcatcgccggcatagccgaactgggagccttcttctccatcctccaggacatgcgaaacaccataatggccagcaaaaccgtcggaaccagcgaagaaaaactcagaaagaaatcctcgttctaccaatcgtacctacgccgcacccagagcatgggcatccaactagaccaacgcatcatcgtgctattcatggtcgcctggggcaaagaagcggtcgacaacttccacctaggagacgacatggacccagaactccgcacgctcgcccaatcactcatcgacgtcaaagtaaaagaaatctcaaaccaagaaccactcaaactttag

SEQ ID NO: 7762 - RNA, 1290 nt, synthetic construct
  misc_feature 1..1290: note = derived and/or modified CDS sequence (opt11) from HTNV(Bao14)__AB127998.1__N
  source 1..1290: mol_type = other RNA
atggccacaatggaagaactccaacgcgaaatcaacgcccacgaaggccaactcgtcatcgcacgccaaaaagtccgtgacgcggaaaaacaatacgaaaaggaccccgacgaactcaacaaacgaaccctgaccgatcgagaaggagtcgcagtaagcatacaagcaaaaatagacgaactcaagcgccaactagccgaccgcatagcaaccggtaaaaatctcggaaaagagcaagaccccaccggtgtcgaacccggcgaccacctcaaagaaagatccatgctctcatatggcaacgtcctcgacctaaaccacctcgacatcgacgaaccaacaggccaaaccgccgactggctcagcatcgtagtatacctcacctccttcgtcgtccccatcctcctaaaagccctttacatgctaaccacacgcggccgacaaacaaccaaagacaacaaaggcacacgcatacgcttcaaagacgactcatccttcgaagacgtaaacggcataagaaaaccaaaacacctctacgtctcccttccaaacgcccaatcaagcatgaaggcagaagagatcacgcccggacgctaccggaccgccatatgcggactataccccgcccagataaaagcccgacaaatgatcagcccagtcatgagcgtaatcgggttcctagccctcgccaaagactggtcagaccgcatagagcaatggctcagcgagccctgcaaactcctcccagacacagccgccgtctcactactaggcggcccagccacaaaccgcgactacctccgccaacgccaggtcgcactcggcaacatggaaaccaaagaaagcaaagccatacgccaacacgcagaagcagccggatgctccatgatcgaagacatcgaatccccctcctcaatatgggtattcgccggggcccccgacagatgcccgccaacctgcctattcatcgccggcatcgctgaactcggcgccttcttctcaattctccaagacatgagaaacaccatcatggcctcgaaaaccgtcggcacctccgaagaaaaactacgaaagaaaagctccttctaccaatcgtacctgcgacgcacccaatcaatgggcatccaactcgaccaacgcatcatcgttctcttcatggtcgcctggggaaaagaagccgtagacaacttccacctcggcgacgacatggaccccgaactccgcaccctagcacaatccctcatcgacgtaaaagtaaaagagatatcaaaccaagaacccttaaaactctaa

SEQ ID NO: 7763 - RNA, 1290 nt, synthetic construct
  misc_feature 1..1290: note = derived and/or modified CDS sequence (opt11) from HTNV(Chen4)__AB027101.1__N
  source 1..1290: mol_type = other RNA
atggccaccatggaagaactccaaagagagataaacgcacatgaaggccaactcgtcatagcacgacaaaaagtacgcgacgcagaaaaacaatacgaaaaagaccccgacgaactcaacaaacgaacactgaccgacagagaaggcgtcgccgcctccatccaagccaaaatagacgaactaaaacgccagctcgccgaccgaatcgcaaccggcaaaaacctaggaaaagaacaagaccccacgggcgtagaacccggcgaccacctaaaagaacgatcaatgctctcctacggaaacgtcctagacctcaaccacctcgacatcgacgaaccaaccggccaaacagcagactggctctcaatcgtcatttacctaacctcattcgtcgtccccatactcctcaaagccctatacatgctcaccacccgaggcagacaaaccaccaaagacaacaaaggcacccgcatccgcttcaaagacgactcctccttcgaagacgtaaacggcatccgcaaacccaaacacctctacgtctccctccccaacgcacaaagctccatgaaagccgaagaaataacccccggccgctaccgcaccgccatctgcggcctctaccccgcgcaaatcaaagcacgccaaatgatcagccccgtcatgagcgtaatcggcttcctagccctcgcaaaagattggagcgaccgtatagaacaatggctcagcgcaccctgcaaactgctcccagacacagcagcagtatcactccacggaggacccgccaccaaccgcgacaacctacgccaacgccaagtcgcactcggcaacatggaaaccaaagaaagcaaagcaatccgccaacatgccgaaagcgccgggtgctccatgatcgaagacatagagtcaccatcctcaatctgggtcttcgccggcgcacccgaccggtgcccacccacgtgcctcttcatcgctggaatcgccgagctgggcgcattcttctccatacttcaagacatgcgaaataccataatggccagcaaaacagtaggcacatccgaagaaaagctccgcaagaaatcctcattctaccaatcatacctacgccgcacccaatccatgggaatacaactcgaccaacgaatcatcgtactcttcatggtcgcctggggcaaagaagccgtcgacaacttccgcctaggcgatgacatggacccagaactccgcacactcgcacaatcactcatcgacgtaaaagtcaaagagatcagcaaccaagaacccctaaaactatga

SEQ ID NO: 7764 - RNA, 1290 nt, synthetic construct
  misc_feature 1..1290: note = derived and/or modified CDS sequence (opt11) from HTNV(Hu)__AB027111.1__N
  source 1..1290: mol_type = other RNA
atggcaacaatggaagaactacagcgcgaaataaacgctcacgaaggacaactcgtcatcgcacgccaaaaagtccgagacgccgaaaagcaatacgaaaaagaccccgacgaactcaacaaaagagccctcaccgaccgcgaaggcgtcgccgcaagcatacaggcaaaaatcgatgaactcaaacgacaactggccgaccgaatcgcaaccgggaaaaacctaggaaaggaacaagaccccaccggcgtcgaacccggcgaccacctaaaagaacgatccatgctttcctacggcaacgtcctcgacctaaaccacctcgacatagacgaaccgaccggccagacagccgactggctaagcatagtaatctacctcacatccttcgtggtacccatcctcctcaaagccctctacatgctaaccaccaggggcagacaaaccaccaaagacaacaaaggcacccggatccgcttcaaagacgactcctcattcgaagacgtaaacggaatccgcaaaccaaaacacctctacgtctccctccccaacgctcaatccagcatgaaagcagaagaaatcacccccggcagataccgtaccgccatctgcggactctaccccgcccaaatcaaagcacgacaaatgatctcccccgtcatgagcgtcataggcttcctcgccctcgccaaagactggtccgacagaatcgaacaatggctaagcgaaccctgcaaactactcccagacacggccgcagtcagcctacacggaggccccgcaacaaaccgagactacctccgccaacgccaggtagcactaggcaacatggaaacaaaagaaagcaaagcaatcagacaacacgcagaagccgccggctgctcaatgatcgaagacatagaatccccaagctcaatatgggtattcgccggcgcacccgaccgcagcccacccacatgcatgttcatcgccggcatagacgaactcggcgcattcttcagcatcctccaagacatgcgcaacacaatcatggcctccaaaacagtaggcacatccgaagaaaaactccggaagaaatcctccttctaccaaagctacctacgaagaacacaaagcatgggcatccaactcgaccaaagaatcatagtactgttcatggtcgcctggggaaaagaagcagtcgacaacttccacctgggcgacgacatggacccggaactgcgaacactcgcacaatccctaatagacatcaaagtaaaagagatatcaaaccaggaacccctcaaactctga

SEQ ID NO: 7765 - RNA, 1290 nt, synthetic construct
  misc_feature 1..1290: note = derived and/or modified CDS sequence (opt11) from HTNV(HubeiHu02)__JQ665905.1__N
  source 1..1290: mol_type = other RNA
atggcgacaatggaagaacttcaaaaagaaattaacgcccacgaaggacaactcgtaatcgcccgccaaaaagtccgcgacgccgaaaaacaatacgaaaaagaccccgacgaactcaacaaaagaacacttacagacagagaaggagtcgcagcaagcatccaagcaaaaatagacgaactcaaacgccaactagcggatcgcatcgcaacaggcaaaaacctcggcaaagaacaagaccccacaggagtcgaacccggagaccacctcaaagaacgctcaatgctcagctacggcaacgtactcgacctaaaccacctagacatcgacgaaccaaccggccaaacagccgactggcttagcatagtcatctacctcacatccttcgtcgtacccatactactaaaagccctatatatgctcaccacccgcggccgtcagacaaccaaagacaacaaaggcacccgaatacgcttcaaagacgactccagcttcgaagacgtgaacggcatccgaaaacccaagcacctctacgtctcactccccaacgcccaatccagcatgaaagccgaagacataacgcccggacgctacagaaccgcaatctgcggactgtaccccgcccaaatcaaagcacgccaaatgatctcccccgtcatgtcagtcatcggattcctagccctagccaaagactggagcgaccgcatcgaacaatggctatccgaaccctgtaaactcctccccgacacagcagccgtaagcctacacggcggccccgcaaccaaccgcgactacctacgccagagacaagtcgccctaggaaacatggaaacaaaagaatccaaagcaatacgacaacacgcggaatccgccggatgtagcatgatcgaagacatagagtccccctcctccatctgggtcttcgccggagccccagaccgctgccctccaacctgcctcttcatagccggaatcgccgaactaggcgctttcttcagcattctccaagacatgagaaacaccataatggcgtcaaaaaccgtaggaaccagcgaagagaaactccgcaagaaatcttccttctaccaaagctacctaagaagaacccaatccatgggcatccaactagaccagcgcataatcgtactcttcatggtcgcctggggcaaagaagccgtcgacaacttccacctaggcgacgatatggaccccgagctacgtaccctagcccaatcactaatagacgtcaaagtcaaagaaatcagcaaccaagaacccctcaaactctaa

SEQ ID NO: 7766 - RNA, 1290 nt, synthetic construct
  misc_feature 1..1290: note = derived and/or modified CDS sequence (opt11) from HTNV(HV004)__JQ083395.1__N
  source 1..1290: mol_type = other RNA
atggccaccatggaagaactacaaaaagaaatcaacgcgcatgaaggccaactcgtcatagcacgccaaaaagtccgcgacgccgaaaaacaatacgaaaaagacccagacgaactcaacaaacgagccctaacagaccgcgaaggagtagccgcatctatccaagccaaaatcgacgaactcaaacgccaactagccgacagaatcgccaccggcaaaaacctaggaaaagaacaagaccccacaggcgtcgagcccggcgaccacctcaaagaacgctccatgctatcatacggaaacgtactcgacctaaaccacctcgacatagacgaaccaacaggccaaacagccgactggctatccatcgtcatctacctaacctccttcgtagtcccaatcctactaaaagcgctatacatgctcacaacccgaggacgccaaaccacaaaagacaacaaaggtacccgcatacgcttcaaagacgactcctcattcgaagacgtaaacggtatccgcaaacccaaacacctctacgtctccctaccaaacgcacaatctagcatgaaagccgaagaaatcaccccaggacgctaccgcaccgctatctgcggcctctaccccgcacaaataaaagcccgacaaatgatctcaccagtcatgtccgtaataggctttctagcactcgccaaggactggtccgaccgcatcgaacaatggctcagcgaaccctgcaaactactcccagacactgccgcagtctctctccacggaggccccgccaccaaccgcgactacctacgacaacgccaagtcgccctcggaaacatggaaaccaaagaatcaaaagcaatccgacaacacgccgaatccgcaggctgctcgatgatcgaagacatcgaatccccctcctcaatctgggtctttgccggcgccccagacagatgcccgccaacctgcctcttcatagccggcatcgccgaactcggcgccttcttctccatcctacaagacatgcgaaacaccatcatggccagcaaaacagtcggaacctcagaagaaaaactgcgcaagaaatcatccttctaccaatcctacctacgccgcacacagtccatgggcatacaactagaccaacgcataattgtactattcatggtagcctggggcaaagaagcagtcgacaacttccacctcggcgacgacatggaccccgaacttcgcaccctagcccaaagcctcatcgacgtgaaagtcaaagaaatcagcaaccaagaacccctcaaactataa

SEQ ID NO: 7767 - RNA, 1290 nt, synthetic construct
  misc_feature 1..1290: note = derived and/or modified CDS sequence (opt11) from HTNV(Maaji-1)__AF321094.1__N
  source 1..1290: mol_type = other RNA
atggcaacaatggaagaactccaaaaagaaattaacgcacacgaaggccaactcgtaatcgcccgacaaaaggtcagagacgcagaacgccaatacgaaaaagatccggacgaactcaacaaacgaaccctaacagaccgagagggcgtagccgcatccatccaagcaaaaatcgacgaactcaaacgacaactagcagaccgcatcgccacaggcaaaaacctcggaaaagaacaagaccccacaggcgtcgaaccgggcgatcacctgaaagaacgctcaatgctaagctacggaaacgtcctcgacctcaaccacctcgacatcgacgaacccaccggccaaaccgcagactggctaagcatagtcatctacctaacctcgttcgtcgtccccatcctcctcaaagccctatacatgctaaccactagaggccgacaaaccaccaaagacaacaaaggaacccgtatacgattcaaagacgacagcagcttcgaagacgtcaacggcatacgaaaacccaaacacctctacgtctcactacccaacgcccaatcgtcaatgaaagcagaagaaatcacccccggcagataccgaacagccgtctgcggactctatcccgcacaaatcaaagcacgccaaatgataagccccgtaatgtccgtaataggattcatggccctcgccaaagactggagcgaacgcatcgaacaatggctaagcgaaccctgcaaactcctcccggacacctccgcagtctccctcctgggaggccccgcaacaaacaaagactacctgcgccaacgccaggtcgccctcggcaacatggaaaccaaagaatccaaagccatcagacaacaagccgaagcatccggctgctctatgatcgaagacatcgaaagccccagctcaatctgggtattcgcaggcgcccccgaccgatgcccacccacatgcctcttcatagcaggcatggccgaactcggagcattcttctcgatcctacaagacatgcgcaacaccatcatggccagcaaaaccgtcggcacctccgaagagaaactccgcaagaaatcatcattctaccaatcctacctccgccgcacccaaagcatgggaatacaactcgaccaacgcatcatcgtactatttatggttgcctggggaaaagaagccgtcgacaacttccacctaggcgacgacatggaccccgaactccgcaccctagcccaatccctcatcgacgtcaaagtaaaagaaatatccaaccaagaaccactcaagctataa

SEQ ID NO: 7768 - RNA, 1290 nt, synthetic construct
  misc_feature 1..1290: note = derived and/or modified CDS sequence (opt11) from HTNV(Maaji-2)__AF321095.1__N
  source 1..1290: mol_type = other RNA
atggccaccatggaagaactccaacgcgaaatcaacgcacacgagggacaactcgtcatagcacgccaaaaagtacgggacgccgaaaaacaatacgaaaaagaccccgacgaactaaacaaacgcacactcaccgaccgcgaaggcgttgccgtatccatccaagcaaaaatcgacgaactcaaacgacaactcgcagaccgcatagcaaccggcaaaaacttcggaaaagaacaagaccccaccggcgtcgagcccggcgaccacctcaaagaacgctccatgctaagctacggcaacgtcctagacctcaaccacctagacatcgacgaacccaccggacaaaccgccgattggctctccatagtcgtatacctcacatccttcgtagtccccatccttctcaaggccctctacatgctcaccacccgcggtagacaaaccaccaaagacaacaaaggcacccggataaggttcaaagacgactcatctttcgaagacgtcaacggaatccgcaaacccaagcacctatacgtctccctccccaatgcccaatcatccatgaaagcagaagaaatcacccccggacgctaccgcacagccgtatgcggcctttacccagcccaaatcaaagcccgccaaatgatctcccccgtcatgtccgtcataggattcctcgccctcgcaaaagactggagcgaccgcatcgaacaatggctcagcgaaccctgcaaattactacccgacacagccgccgtcagcctcctaggaggccccgccaccaaccgcgactacctacgccaacgccaagtcgccctcggaaacatggaaacaaaagaatccaaagcaatacgacaacacgcggaagcagcaggctgctctatgatcgaagacatcgagtccccatcctccatctgggtcttcgccggcgcccccgaccgctgcccaccaacctgcctattcatcgccggcatcgccgaactaggcgcattcttcagcatcctccaagacatgcgaaacaccatcatggcctccaaaaccgtaggcacctccgaagaaaaactaagaaagaaaagcagcttctatcaatcctacctacgacgcacccaactaatgggcatccaactggaccaacgaatcatagtcctcttcatggtggcatggggcaaagaagccgtggacaacttccacctaggagacgacatggaccccgaactgcgaaccctcgcccaatcgctcatcgacgtcaaagtaaaagaaatcagcaaccaagaaccccttaaactctag

SEQ ID NO: 7769 - RNA, 1290 nt, synthetic construct
  misc_feature 1..1290: note = derived and/or modified CDS sequence (opt11) from HTNV(N8)__DQ658415.1__N
  source 1..1290: mol_type = other RNA
atggcgaccatggaagaactacaaagagaaataaacgcccacgaaggacaactcgtaatcgcccggcaaaaagtccgcgacgctgaaaaacaatacgaaaaagacccagacgaactcaacaaacgcaccctaacagaccgcgaaggcgtcgccgccagcatacaagcgaaaatcgacgaactcaaacgccagcttgccgaccgcatagcgacaggcaaaaacctcgggaaagaacaagacccaaccggcgtggaacccggagaccacctaaaagaacgaagcatgctaagctacggcaacgtcctagacctcaaccacctcgacatcgacgaacccaccggccaaaccgccgactggcttagcatcgtcatctacctaacctccttcgtagtccccatcctcctcaaagcactctacatgcttaccaccaggggccgccaaacaaccaaagacaacaaaggcaccagaatccgattcaaagacgacagctcattcgaagacgtcaacggaatccgcaaacccaaacacctatacctctcgctccccaacgcgcaatcaagcatgaaagccgaagaaataacccccggccgctaccgaacagccatctgcggcctctatcccgcccaaataaaagccagacaaatgatatccccagtaatgagcgtcatcggctttctcgccctcgccaaagactggagcgaccgcatcgaacaatggctcagcgaaccatgcaaactcctcccggacgccgccgcggtatcgctgcacggcggcccagccaccaacagagactacctccgccaacgccaggtagcactcggcaacatggaaacaaaggaaagcaaagccatccgccaacacgccgaaaccgcaggctgctccatgatcgacgatatcgagagcccctcctcgatatgggtcttcgccggcgccccagaccgatgcccacccacatgcctcttcatagcagggatcgccgaactaggcgccttcttcagcatccttcaagacatgcgaaacaccatcatggcatccaaaaccgtaggaacaagcgaagaaaaactccgcaaaaagtcctcattctaccaaagctacctaagaagaacccaatccatgggcatccaactcgaccaacgaatcatcgtcctcttcatggtggcatggggcaaagaagccgtcgacaacttccacctaggcgacgacatggaccccgaactcagaacactcgcccaaagcctaattgacgtcaaagtaaaagaaatctcaaaccaagaacccctcaaactctag

SEQ ID NO: 7770 - RNA, 1290 nt, synthetic construct
  misc_feature 1..1290: note = derived and/or modified CDS sequence (opt11) from HTNV(Q32)__AB027097.1__N
  source 1..1290: mol_type = other RNA
atggcaaccatggaagaactgcaacgagaaatcaacgcccacgagggacaactcgtcatcgcccgactcaaagtacgcgacgcagaaaaaccctacgaaaaagacccagacgaactcaatatgcgaaccctcacagaccgagaaggcgtcgccgcaagcatccaggccaaaatcgacgaactaaaacgccaactcgcagaccgcatcgccaccggcaaaaacctcggtaaagaacaagacccaaccggcgtagagcccggcgaccacctcaaagaacgctcaatgctatcatacggcaacgtactcgacctaaaccatttagacatcgacgaacccaccggccaaaccgcagactggctatccatagtaatatacctcacatcattcgtcgtaccaatcctcctgaaagcactctacatgctaaccacccgaggccgccaaaccaccaaagacaacaaaggaaccagaatacgcttcaaagacgactcatccttcgaagacgtcaacggcatacgaaaacccaaacacctctacgtatcgctaccaaacgcccaatcctcaatgaaagccgaagaaatcacccctggccgataccgaaccgcaatatgcggcctctaccccgcccaaataaaagccagacaaatgataagcccagtcatgtccgtcataggcttcctagcactcgccaaagactggagcgaccgcatagaacagtggctaagcgaaccatgcaaactcctccccgacaccgccgccgtctcccttcacggcggcccagccaccaaccgtgactacctccgccaacgccaagtcgccctaggaaacatggaaaccaaagaatccaaagccatccgacaacacgctgaatccgcaggctgcagcatggtcgaggacatcgaatcaccatcaagcatctgggtgttcgccggcgcccccgaccgatgccccccaacatgcctgttcatcgcaggcatagccgaactcggcgctttcttctcaatcctccaagacatgcgaaacacaataatggcctcaaaaacagtcggcacaagcgaagaaaaactacgcaaaaaatcatccttctaccaatcctacctacgacgcacccaatccatgggcatacaactcgaccaacgtataatcgttctctttatggtggcatggggaaaagaagccgtcgacaacttccaacccggcgacgacatggatcccgaactccgcaccctagcccaaagcctgatcgacgtcaaagtaaaagaaatctcaaaccaagaacccctaaaactgtga

SEQ ID NO: 7771 - RNA, 1290 nt, synthetic construct
  misc_feature 1..1290: note = derived and/or modified CDS sequence (opt11) from HTNV(SXHu2012B1)__KC844226.1__N
  source 1..1290: mol_type = other RNA
atggccaccatggaagaactccaacgcgaaataaacgcccacgaaggacaactcgtcatagcacgccaaaaggtccgagacgcggaaaaacaatacgaaaaggacccagacgaactcaacaaaagggcactcaccgaccgcgaaggcgtcgcagcctcaatccaagccaaaatcgacgaactcaaacgacagctcgcagaccgcatcgccaccggcaaaaacctcggcaaagaacaagacccaaccggcgtagaacccggcgaccacctaaaagaacgatcaatgctatcctacggaaacgtcctagacctcaaccacctagacatcgacgaaccgaccggacaaacagcagactggctctccatagtcatatatctaacatccttcgtagtcccaatcctcctcaaagccctatacatgctcacaacccgcggccgacaaaccaccaaagacaataaaggtacccggatccgcttcaaagacgactcctcattcgaagacgtaaacgggatccgaaaaccgaagcacctctacgtctccctcccaaacgcgcaatcctccatgaaagccgaagagatcacgcccggccgataccgcacggcaatatgcggactttaccccgcccaaatcaaagcgcgccaaatgataagccccgttatgagcgtcataggcttcctcgccctcgccaaagactggagcgaccgcatagagcaatggttaagcgaaccctgtaaattactcccagacaccgcagcggtatccctccatggcggccccgccaccaaccgagactacctgcgccaacgacaagtcgccctcggaaacatggaaaccaaagagagcaaagccatcagacaacacgcggaatcagccggatgctcaatggtcgaagacatcgaaagcccgtcaagcatctgggtattcgcaggcgcccccgaccggtgcccgcccacatgcctattcatcgccggaatcgcagaactaggcgccttcttttccatcctccaggacatgcgcaacaccataatggcatcaaaaaccgtaggcaccagcgaagaaaaactaagaaagaaatcctccttctaccagtcatacctaagaaggacccaaagcatgggaatacaactcgaccaacgcataatcgtactcttcatggtagcctggggcaaagaagcagtagacaacttccacctcggcgacgacatggaccccgaactgcgcacgctcgcacaatcccttatcgacgtcaaagtcaaagaaatctccaaccaagaacccctcaaactctga

SEQ ID NO: 7772 - RNA, 1290 nt, synthetic construct
  misc_feature 1..1290: note = derived and/or modified CDS sequence (opt11) from HTNV(TJJ16)__AY839871.1__N
  source 1..1290: mol_type = other RNA
atggccacgatggaggaactccagagagaaatcaatgcgcacgaaggacaactggtaatcgccagacaaaaagtccgcgacgcggaaaaacaatacgaaaaggaccccgacgaactaaacaaacgcgccctcaccgaccgcgagggcctcgccgccagcatacaagcaaaaatagacgagctcaaacgtcaactagcagaccggatcgcaaccggcaaaaacctcggcaaagaacgcgaccccaccggcgtagaacccggagaccacttaaaagaacgctcaatgctatcctacggcaacgtcctagacctaaaccacctagacatcgacgaacccaccggacaaaccgccgattggctatcaatcgtaatatacctaacctcattcgtcgtccctatactcctcaaagccctatacatgctcacaacacgcgggaggcaaacaaccaaagacaacaaaggcacccgaatccgcttcaaagacgacagcagcttcgaagacgtcaacggcatacgcaaacccaaacacctctacgtcagcctccccaacgcgcaatcatccatgaaagccgaagagataactcccggaagataccgcacggccatatgcggcctctacccagcccaaataaaagcccgacaaatgataagccccgtcatgagcgtcatagggttcctcgcactagccaaagactggtccgaccgcatagaacaatggctttcagaaccctgcaaactactcccagacacagccgccgtctccctacacggcggcccagccaccaaccgagactacctacgccagcgccaagtcgcactcggcaacatggaaacaaaagaaagcaaagccatacgccaacacgccgaatccgccggctgctcaatggtagaagacatcgaaagccccagctccatatgggtcttcgccggggcccccgaccgctgtcccccaacctgcctctacatagccgggatcgcagaactcggcgcattcttcagcatcctccaagacatgcgcaacaccataatggcaagcaagacggtaggaacaagcgaagaaaaactccgaaagaaaagctccttctaccaatcctacctaagaagaacacaatcaatgggcatccaactagaccagcgcatcatcgtcctgttcatggtagcctggggaaaagaagcagtagacaacttccacctaggcgacgacatggaccccgaactacgcaccctagcccaatccctaatcgacgtcaaagtaaaagaaatctcaaaccaagaaccgctaaaactttaa

SEQ ID NO: 7773 - RNA, 1290 nt, synthetic construct
  misc_feature 1..1290: note = derived and/or modified CDS sequence (opt11) from HTNV(WCL)__KM355414.1__N
  source 1..1290: mol_type = other RNA
atggcaaccatggaagaactccaacgcgaaatcaacgcccacgaaggacaactcgtcatagcccgccaaaaagtccgcgacgccgaaaaacaatacgaaaaagacccagacgaactgaacaaacgcgccctgacagacagggaaggcgtagcagtcagcatccaagcaaaaatagacgaactcgaacgccaactcgccgacagaatcgcaaccgggaaaaacctcggcaaagagcaagaccccaccggagtagaaccgggcgaccacctaaaagaacgctccatgctttcctacggcaacgtcctagacctcaaccacctcgacattgacgaacccaccggccaaaccgccgactggctatcaatcgtcgtctacctaaccagctttgtagtcccaatcctactaaaagcactatacatgcttacaacacgtggccggcaaacaacaaaagacaacaaaggaacccgaatccgattcaaagacgactcctcattcgaagacgtcaacggcataagaaaacccaaacacctctacgtatccctccccaacgcccagtcctccatgaaagccgaagaaatcacaccaggccgctaccgcacagcaatctgcggcctctaccccgcacaaataaaagcccgccaaatgatctccccagtaatgtcagtcatcggattcctagccctagccaaagactggagcgaccgcatcgaacaatggttaagcgaaccctgcaaactactcccagacacagccgcagtcagcctcctcggcggccccgcaacaaaccgagactaccttcgccaacgacaagtcgccctaggaaacatggaaaccaaagagtccaaagccatccgacaacacgctgaggcagccggctgctccatgatagaagacatcgaaagccccagctcaatctgggtcttcgccggagcccccgaccgatgcccaccgacctgcctattcatcgcaggaatcgccgaactcggcgccttcttctcaatcctccaagacatgcgcaacaccataatggcctccaaaaccgtcggcacaagtgaggaaaaactccgcaagaaatcctcattctaccaatcttacctccgccgcactcaatcaatgggaatacaactagaccagcgcatcatagtcctcttcatggtagcctggggcaaagaagccgttgacaacttccacctcggcgacgacatggaccccgaactccgaaccctagcccaatcactcatcgacgtcaaagtaaaagaaatctcaaaccaagaacccctcaaactctaa

SEQ ID NO: 7774 - RNA, 1290 nt, synthetic construct
  misc_feature 1..1290: note = derived and/or modified CDS sequence (opt11) from HTNV(YN509)__GU329991.1__N
  source 1..1290: mol_type = other RNA
atggccacaatggaggaactccagaaagaaatcaacgcgcacgaaggacaactcattatagccaaacaaaaagtaaaagacgcagaaaaacaatacgaaaaagacccagacgaactaaacaaacgagccctaaccgaccgagaaggcgtagccgcctccatccaagccaaaatagacgaactaaaacgccaactcgccgaccgcatcgcaaccggcaaaaacctcggacaagaccgcgacccaaccggcgtagaacccggcgaccacctaaaagaacgctccatgctcagctacggcaacatactagacctaaatcacctcgacatcgacgaacccaccgggcaaacagccgactggctcagcataatagtctacctcacctccttcgtcgtacccatcctcctaaaagccctctacatgctgaccacacgcggacggcaaaccgcaaaagacaacaaaggcacaagaataagattcaaagacgacagcagcttcgaggacgtcaacggaatccgaaaacccaaacacctctacgtcagcatgcccaacgcccagtcaagcatgaaagcagaagaaataacaccaggccgctaccgcaccgccgtctgcggcctctatcccgcacaaatcaaagcgcgccaaatggtctccccagtcatgtccgttatcggcttcatggccctggccaaagactggaccgacagaattgaaaactggctaggcgaaccctgcaaactgcttcccgacacctcctcagtaatactcctcggcggccccgccacaaacagagactacatccgccaacgacaagtagcactcggaaacatggaaaccaaagaagccaaagccgtccgacaacacgccgaatcagccggctgctccatgatcgacaacatcgacagccccagctccatctgggtcttcgccggcgcacccgaccgatgcccaccaacgtgcctattcgtcgccggcctcgcagaacttggagcattcttctccatactccaagatatgcgaaacacaatcatggccagcaaaaccgtaggcacaagcgaagaaaaaatgcgcaaaaaatcctcattctaccaatcctacctccgccgcacccaatccatgggaatacaactcgaccaacgcatcatcgtcctcttcatggttgcatggggaaaagaagcagtcgacaacttccacctaggcgacgacatggatcccgagctccgcaatctagcccaatccctaatagaccaaaaagtcaaagaaatctccaaccaagaacccctcaaactctaa

SEQ ID NO: 7775 - RNA, 1290 nt, synthetic construct
  misc_feature 1..1290: note = derived and/or modified CDS sequence (opt11) from HTNV(YU62)__AY748309.1__N
  source 1..1290: mol_type = other RNA
atggccaccatggaagaactccaacgcgaaatcaacgcccacgaaggacaactcgtcatcgcccgccaaaaagtccgcgacgcagaaaaacaatatgaaaaagatcccgacgaactcaacaaacgcgccctcaccgaccgcgaaggactcgcggccagcatccaagccaaaatcgacgagctaaaacgccaactcgccgaccgcatagccaccggaaagaacctcggcaaagaacaagaccccacaggcgttgaaccaggcgaccacctcaaagaacgctcaatgctatcatatggcaacgtactcgacctcaaccacctcgacatcgacgaaccaaccggacaaaccgccgactggctctccatcgtcatctacctcaccagcttcgtggtccccatcttgctaaaagcactttacatgctcaccaccagaggtcgccagacaaccaaagacaacaaaggcacccgcatacgattcaaagacgactcatcattcgaagacgtaaacggcatccgaaaaccaaaacacctctacgtctccctccccaacgcccaatccagcatgaaagcagaagaaatcacgccaggccgataccgcacagccatttgcggcctctaccccgctcaaataaaagcacgacagatgatcagccccgttatgagcgtaatcggattcctcgccctagccaaagactggtccgaccgcatcgaacaatggctgtccgaaccctgcaaactcctcccagacaccgccgccgtctcgctccacggcggccccgcaacaaaccgcgactacctacgccaacgacaagtcgccctcggcaacatggagaccaaagagtcaaaagccatccgccagcacgcagagagcgccggctgcagcatggtcgaagacatcgaaagcccctcatctatctgggtcttcgcgggagcccccgaccgctgccctcccacatgcctcttcatcgccggaatcgccgaactaggagccttcttctccatactacaagacatgcgcaacaccatcatggcctccaaaaccgtcggcacatcagaagaaaaactccgcaagaaatctagcttctaccaatcatacctaagaagaacacaatcaatgggaatccaactagaccaacgcatcatcgtcctattcatggtagcctggggcaaagaagccgtcgacaacttccacctcggcgacgacatggaccccgaactccgcaccctcgcacaatccctcatcgacgtcaaagtcaaagaaatatcaaatcaggaacccctcaaactctaa

SEQ ID NO: 7776 - RNA, 1290 nt, synthetic construct
  misc_feature 1..1290: note = derived and/or modified CDS sequence (opt11) from HTNV(ZLS6-11)__FJ753396.1__N
  source 1..1290: mol_type = other RNA
atggcgaccatggaagaactccaacgcgaaatcaacgcccacgaaggccaactcgtcatagcaaggcaaaaagtacgcgacgccgaaaaacaatacgaaaaagatcccgacgaactcaacaaacgagcactcaccgaccgcgaaggcgtagcagcaagcatacaagccaaaatcgacgagctcaaacgccaactcgccgatagaatcgcaaccggcaaaaacctcgggaaagaacaagaccccacaggcgtagaaccgggcgaccacctaaaagaacgctccatgctatcatacggaaacgtcctagaccttaaccacctcgacatagacgaaccgaccggacaaacagccgactggctctccatcgtcatctacctcacctcattcgtcgtcccaatcctcctcaaagccctctacatgcttaccacccgcggccgacaaacaaccaaagacaacaaaggaacccgaatccgcttcaaagacgactcctcattcgaagacatcaacggcatacgaaaacccaaacacctctacgtctccctgcccaacgcccaatcctcaatgaaagccgaagaaatcacacccggcagataccgcacagctatatgcggcctctacccagcacaaatcaaagcacgacaaatgatatcccccgtaatgagcgtcataggcttcctcgcactcgccaaagactggtccgacagaatcgaacaatggctatccgaaccctgcaaactcctacccgacacggccgccgtctcgctacatggtggaccagccacaaaccgcgactacctccgtcaacgccaagtagcactcggcaacatggaaaccaaagaatccaaggccatacgacagcacgcagaaaccgcaggctgctcaatgatcgaagacatcgaaagccccagctcaatctgggtatttgccggagcccccgaccgttgccctccaacctgcctattcatagccggaatcgcagaactcggcgccttcttcagcatcctccaagacatgagaaacaccatcatggcgagcaaaaccgtcggcacaagcgaagaaaaactaagaaagaaaagctccttctatcaaagctacctacgacgaacacaaagcatgggcatccaactggaccagagaataatcgtactattcatggtcgcctggggcaaagaagccgtcgacaacttccacctaggagacgacatggaccccgaactgcgcaccctcgcacaatccctaatcgacgtcaaagtcaaagaaatatccaaccaagagcccctcaaactctaa

SEQ ID NO: 7777 - RNA, 1290 nt, synthetic construct
  misc_feature 1..1290: note = derived and/or modified CDS sequence (opt11) from HTNV__AB027523.1__N
  source 1..1290: mol_type = other RNA
atggcaacaatggaagaactccaaaaagaaatcaacgcccacgaaggacaactaataatagcaaaacaaaaagtcaaagacgccgaaaaacaatacgaaaaagaccccgacgaactaaacaaacgggccctgacagaccgagaaggcgtaagcgcatcaatccaagcaaaaatcgacgaacttaaacgccaactcgccgacagaatcgccaccgggaaaaacctaggccaagaccgagaccccaccggagtagaacccggcgaccacctcaaggagcgctcaatgctatcctacggaaacatcctggacctaaaccacctcgacatcgacgaacccaccggacaaaccgccgactggctgagcataatcgtatacctcacatccttcgtcgtccccatactcctcaaagccctatacatgctcacaacacgcggccgccaaacagcaaaagacaacaaaggaaccagaatccgattcaaggacgacagcagcttcgaagacgtaaacgggataagaaaacccaaacacctatacgtttcaatgcccaacgcccaatcaagcatgaaagccgaagaaatcacccccggcggctaccgaaccgcagtatgcgggctattccccgcgcaaatcaaagcccgacaaatggtctcccccgtcatgagcgtgatcggcttcatggcactcgccaaagactggaccgacagaatcgaatcatggctgggcgagccctgcaaactcctacccgacacaagcgccgtctccctcctcggcggccccgccacaaaccgagactacatccgccaacgccaggtcgccctaggaaacatggaaacaaaagaagccaaagcagtccgacaacacgccgaatcagccggatgctcaatgatcgacaacatagacagcccaagctcaatctgggtcttcgcgggagccccagaccgctgcccacccacatgcctcttcatcgcaggaatcgcagaactgggcgccttcttcagcatactccaagacatgcgcaacaccataatggcctccaaaaccgtaggcactagcgaggagaaaatgagaaagaaatcctcattctaccaatcatacctccgcagaacccaaagcatgggaatacagctagaccagcgaataatagtactattcatggtcgcatggggcaaagaagcagcagacaacttccaacacggcgacgacatggaccccgaactccgaaccctcgcccaatcgctcatcgaccaaaaagtaaaagaaatatcaaaccaagaacccctcaaactctag

SEQ ID NO: 7778 - RNA, 1293 nt, synthetic construct
  misc_feature 1..1293: note = derived and/or modified CDS sequence (opt11) from HTNV__D25530.1__N
  source 1..1293: mol_type = other RNA
atgatggctaccatggaagaactccagcgagagatcaacgcccacgaaggccagctagtcatcgcccgacaaaaagtacgcgatgccgaaaagcaatacgaaaaagaccccgacgaactaaacaaaagagcactcaccaaccgcgaaggcgtagccgtctccatccaagcaaaaatcgacgaactcaaaatgcaactcgcagacaggattgcaacaggcaaaaacctcggaaaagaacaagacccaacaggagtcgaacccggagaccacctcaaagaacgaagcatgctgtcctacggaaacgtactcgacctaaaccacctcgacatcgatgaaccaaccggacaaacggccgactggctctccatcatagtctacctcaccagcttcgtagtccccatactcctcaaagccctatacatgctaacaaccagaggacgacaaaccacaaaagacaacaaaggcaccagaatccgcttcaaagacgacagctccttcgaagacgtcaacggaatccggaaacctaaacacctctacgtatccctccccaacgcacaatccagcatgaaagccgaagaaatcacccccggacgataccgaaccgccgtctgcggactctatccagcccaaatcaaagcacgccaaatgatctcccccgtcatgtcagtcatcggcttcctagccttagccaaggactggagcgaccgcatcgaacaatggctcatagaaccatgcaaattgctgccggacaccgccgccgtctcactcctaggcggacccgcaacgaacagagactacctacgacaacgacaagtcgcactcggcaacatggaaaccaaagaatccaaagccataagacaacacgcagaggccgccggatgctccatgatcgaagacatcgaatcccccagctccatctgggtcttcgcaggagccccagacaggtgcccacccacatgcctcttcatcgccggaatcgccgaactaggcgccttcttttccatcctacaggacatgcgcaacacaatcatggcaagcaaaaccgtcggcacaagcgaagaaaaactccgcaagaaatcctccttctaccaatcgtaccttcgcagaacccagtccatgggcatccaactagaccaaagaataatcgtactcttcatggtagcatggggcaaagaggccgtcgacaacttccacctaggcgacgacatggaccccgaactccgaacactagcgcaatccctcatcgacgtcaaagtaaaagaaatctccaaccaagaaccactcaaactctaa

SEQ ID NO: 7779 - RNA, 1290 nt, synthetic construct
  misc_feature 1..1290: note = derived and/or modified CDS sequence (opt11) from HTNV__M14626.1__N
  source 1..1290: mol_type = other RNA
atggccaccatggaagaactccaaagagaaatcaacgcccacgaaggccaactcgtcatcgcccgccaaaaagtcagagacgccgaaaaacaatacgaaaaggaccccgacgaactcaacaaacgtaccctcaccgaccgcgaaggcgtagccgtcagcatccaagcaaaaatcgacgaactcaaaagacaactagccgacagaatcgccaccggcaaaaacctcgggaaagaacaagaccccaccggcgtcgaaccgggcgaccacctcaaagaacgatcaatgctgagctacgggaacgtcctagacctcaaccacctcgacatagacgaaccaaccggccaaacagcagactggctgagcataatagtctacctaacctccttcgtcgtcccaatcctactcaaagccctttacatgctcaccacccgaggccgccaaacaaccaaagacaacaaaggcacccgaatcaggttcaaagatgacagctccttcgaagacgtcaacgggatccgcaaaccaaaacatctctacgtctcactacccaacgcccagtcaagcatgaaagccgaagaaatcacgcccggacgctaccgcacagccgtctgcggactctaccccgcccaaataaaagcacgccaaatgatatctcccgtcatgtcagtcatcgggttcctagccctggcaaaagactggagcgaccgcatagaacaatggctcatagagccatgcaaactgctccccgacaccgcagcagtctccctcctaggcggccccgcaaccaaccgcgactacctacgccaacgacaggtcgcactcggcaacatggaaacaaaagaaagcaaagccatacgccaacacgcagaagccgccggctgctcaatgatagaagacatcgagtcccccagctccatatgggtcttcgccggcgccccggaccgctgcccaccaacctgcctgttcatagccggaatagccgaattaggcgcattcttcagtatactccaagacatgcgcaacaccatcatggccagcaaaacagtcggcacaagcgaagaaaaactacgcaaaaagagctccttctatcaaagctacctccgccggacccaaagcatgggcatacaactaggacaacgaataattgtactcttcatggtggcctggggcaaagaagccgtcgacaacttccacctaggcgacgacatggaccccgaactgcgaaccctagcgcaatccctcatagacgtaaaagtaaaagaaatctcaaaccaagaacccctcaagctctag

SEQ ID NO: 7780 - RNA, 1290 nt, synthetic construct
  misc_feature 1..1290: note = derived and/or modified CDS sequence (opt11) from HTNV__X95077.1__N
  source 1..1290: mol_type = other RNA
atggccaccatggaggagctccaacgcgaaatcaacgcccatgaaggacaactcgtcatagcaagacaaaaagtccgagacgcagaaaaacaatacgaaaaagaccccgacgaactcaacaaaagaacccttacagatcgcgagggcgtcgccgtctccatacaagccaaaatagacgaactcaaacgccaacttgccgacaggatcgccaccggcaaaaacctcggaaaagagcaagacccaacaggcgtagaaccaggagaccacctgaaagaacgttcgatgctgagctacggcaacgtcctcgacctaaaccacctcgacatcgacgaacccacaggacaaacagccgactggctaagcatagtcgtatacctaacatccttcgtcgtcccgaccctgcttaaagccctctacatgctcacgacccgggggagacaaacaaccaaagacaacaaaggaaccagaatacgattcaaagacgacagctctttcgaagacgtaaacgggatcagaaaaccaaaacacctctacgtctccctccccaacgcacaatcaagcatgaaagctgaagagatcacgcccggacgctaccgaaccgcagtctgcggcctctaccccgcccaaatcaaggccagacaaatgatcagcccagtcatgagcgtaatcggattcctagcactagccaaagactggagcgaccgaatcgaacaatggctaagcgaaccctgcaaactactcccagacacaacagccgtctccctcctgggaggacccgcaaccaaccgcgactacctacgccaacgacaggtcgcactaggcaacatggaaacaaaagaatcaaaagccatcagacaacacgccgaagccgcaggttgctcaatgatagaagacatcgaatcccccagctccatctgggtattcgccggggcccctgaccgatgcccgccaacctgcctattcatagccggcatcgccgaactaggagccttctttagcatactccaagacatgcgcaacacaataatggcaagcaaaacagtcggcacaagcgaagaaaaacttcgaaagaaaagcagcttctaccaatcctacctacgccgaacacagagcatgggcatacagctagaccagcgaataatcgtactcttcatggtggcatggggcaaagaagctgtagacaacttccacctcggcgacgacatggaccccgaactccgcacgctagcacaatccctcatagacgtaaaagtcaaagaaatctcaaaccaagaacccctcaagctctaa

SEQ ID NO: 7781 - RNA, 1290 nt, synthetic construct
  misc_feature 1..1290: note = derived and/or modified CDS sequence (opt11) from HTNV(CGAa1011)__EF990913.1__N
  source 1..1290: mol_type = other RNA
atggccaccatggaagaactccaacgtgaaatcaacgcacacgaaggacaactcgtcatcgcccgacaaaaagtcagagacgccgaaaaacagtacgaaaaagaccccgacgaactcaataaacgcaccctcacagaccgagagggcgtagccgccagcatacaagccaaaatagacgaactcaaacgacaactcgcagaccgaatcgccacaggtaaaaacctcggaaaagaacaagacccaaccggcgtggaacccggcgaccacctcaaagaacgctccatgctctcctacggaaacgtactagacttgaaccacctcgacatagacgaacccaccggacaaaccgccgactggctctccatagtcatatacctcacctccttcgtagtacccatcctactcaaagccctctacatgctcaccacccgcggccgccaaaccaccaaagacaacaaaggaacaagaatccgattcaaagacgactcgtccttcgaagacgtcaacggcataagaaaacccaaacacctcgatgtatccctcccaaacgcccaatcatccatgaaagcagaagaaatcacaccaggccgatacagaaccgccatctgcggcctctacccagcacaaataaaagcacgacagatgatatctccagtcatgtccgtcatcggcttcctcgcactcgctaaagactggtcagaccgcatcgaacagtggctcggcgaaccatgcaaactcctccctgacaccgccgccgtctcactcctcggcggccccgcaaccaaccgcgactacctccgacaacgacaggtagccctcggcaacatggaaacaaaggaatcaaaagccatccgccaacacgccgaaaccgcaggctgcagtatgatcgaagacatagaaagcccctcctccatatgggtcttcgccggggccccagaccgatgcccacccacatgcctcttcatcgccggcatcgccgaactaggcgccttcttctccgtactacaggacatgcgaaacaccatcatggcatcaaaaacagtaggcacctccgaagaaaaactacgaaagaaatccagcttctaccaatcctacctcggccgaacccagtccatgggaatacaactggaccaacgcatcatcgtcctcttcatggtggcctggggcaaagaagcagtcgacaacttccacctgggagacgacgtcgaccccgaactgagaaccctcgcacaatcactcatagacgtcaaagtaaaagaaatatccgaccaagaacccctaaaactgtaa

SEQ ID NO: 7782 - RNA, 1290 nt, synthetic construct
  misc_feature 1..1290: note = derived and/or modified CDS sequence (opt11) from HTNV(CGAa1015)__EF990912.1__N
  source 1..1290: mol_type = other RNA
atggccaccatggaagaactccaacgcgaaataaacgcacacgaaggacaactggtcatcgcgcgccaaaaagttcgagacgcagaaaaacaatacgaaaaggaccccgacgaactcaacaaaagaaccctaacagacagagaaggagtagcagcaagcatccaagccaaaatcgacgaactcaaaagacaactcgccgaccgcatcgccaccggcaaaaacctcggcaaagaacaagaccccacaggagtagaacccggcgaccacctgaaagaacgcagcatgctcagctacggcaacgttctcgacctgaaccacctcgacatagacgaacccaccggacaaaccgcagactggctttcaatcgtcatctacctgaccagcttcgtagtccccatcctcctaaaggccctctacatgctcacaacaagaggccgccaaaccaccaaagacaacaaaggtacacgaatccgcttcaaagacgactccagcttcgaagacgtaaacggcattcgaaaacccaaacacctcgacgtatccctacccaacgcacaaagctccatgaaggccgaagaaatcacccccggccgctaccggactgcaatctgcggcctctaccccgcccaaatcaaagcccgccaaatgatctcccccgtcatgtcagtcatcggctacctagccctcgccaaagactggtccgaccgcatcgagcaatggctaggcgaaccctgcaaactcctaccagatacagccgcagtcagcctcctcggtggaccagccacaaacagagactacctacgccaacgacaagtcgccctgggcaacatggaaaccaaagaaagcaaagccataagacaacacgccgaaacagctggatgctcaatgatcgaggacatcgaatccccctcctccatctgggtcttcgccggcgcccccgaccgatgcccaccaacctgcctcttcatcgccggcatcgccgaactcggcgccttcatctcagtactacaagacatgcgcaacaccataatggcctcaaaaacagtaggcaccagcgaagaaaaactccgcaagaaaagcagcttctaccaatcctacctaggacgaacccaatccatgggcatacaactagaccaaagaatcatcgtcctcttcatggtagcctggggcaaagaagccgtcgacaacttccacctaggcgacgacgtagaccccgaactccgcaccctcgcacagagcctcatcgacgtcaaagtcaaagaaatatcagaccaagaacccctaaaactctaa

SEQ ID NO: 7783 - RNA, 1290 nt, synthetic construct
  misc_feature 1..1290: note = derived and/or modified CDS sequence (opt11) from HTNV(CGAa2)__EU092219.1__N
  source 1..1290: mol_type = other RNA
atggcaaccatggaagaacttcaaagagaaatcaacgcgcacgaaggacaactggtcatcgcaaggcaaaaagtcagagacgccgaaaaacaatacgaaaaagaccccgacgaactaaacaaacgaacactcaccgaccgcgaaggcgtcgccgcaagcatccaagccaaaatcgacgaactcaaacgccaactagccgaccgcatagcaactggcaaaaacctaggcaaagaacaagatcccaccggcgtagaacccggcgaccacctcaaagaacgctccatgctcagctacggaaacgtactagacctaaaccacctcgacatcgacgaaccaaccggccaaaccgcagactggctctccatagtcatctacctaacctccttcgtggtacccatcctcctcaaggccctctacatgctcacaacacgaggacgccaaacaaccaaagacaacaaagggacccgcatccgattcaaagatgactcctccttcgaagacgtcaacggcatccggaaacccaaacacctctacgtatccctacctaacgcccaatcaagcatgaaagcaaaagaaatcaccccagggcgctaccgcacagcaatctgcggcctataccccgcccaaatcaaagcccgccaaatgatcagcccagtcatgagcgtaatcggtttcctagcccttgccaaagactggagcgaccgcattgaacaatggctcagcgaaccctgcaaactactaccagacaccgccgcagtatcactccacggcggccccgcaaccaaccgggactacctcagacaacgccaagtcgcactcggaaacatggaaccgaaagaatccaaagccatccgccagcacgcagaatcagccggatgctccatggtcgaagacatcgaaagcccctccagcatatgggtcttcgccggcgccccagacagatgcccaccaacctgcctattcatagccgggatagcagaactcggagcgttcttcagcatactccaagacatgagaaacaccatcatggcctccaaaacagtaggcaccagcgaagaaaaactcagaaagaaaagctcattctaccaatcctacctacgccggacccagagcatgggcatccaactagaccaaagaataatcgtccttttcatggtcgcctggggaaaagaagccgtcgacaacttccacctgggcgacgacatggaccccgaactccgcaccctcgcccaaagcctcatagacgtcaaggtcaaagaaatctccaaccaagaacccctcaaactctga

SEQ ID NO: 7784 - RNA, 1290 nt, synthetic construct
  misc_feature 1..1290: note = derived and/or modified CDS sequence (opt11) from HTNV(CGAa31MP7)__EF990911.1__N
  source 1..1290: mol_type = other RNA
atggcaaccatggaggaactacaacgcgaaataaacgcccacgaagggcaactcgtcatagcccgccaaaaagtcagagacgccgaaaaacaatacgaaaaagacccagacgaactaaacaaacgaacattaaccgacagagaaggcgtcgccgccagcatacaagccaaaatcgacgagctcaaacgccagctcgcagacagaatcgccaccggcaaaaaccttggaaaagaacaagaccccacgggagtggaaccgggagaccacctaaaagagcgttcgatgctctcatacggaaacgtactcgacctaaaccacctcgacatagacgaacccacaggacaaaccgcagactggttaagcatagtcatatacctaacatccttcgtagtcccaatcctgctaaaagccctttacatgctcacgacacgcggcagacaaacgaccaaagacaacaaaggcaccagaataagattcaaagacgacagcagcttcgaagacgtaaacggaatccgaaaaccgaaacacctctacgtaagcctccccaatgcccaatcctccatgaaagcggaagaaatcacacccggacgataccgaacggccatatgcggactataccccgcacaaataaaagcccgtcagatgataagcccagtcatgtccgtcatcggattcctagcactggctaaagactggagcgaccgcatagaacaatggctcagcgagccctgcaaactactccccgacaccgcagcagtcagcctccacggcggaccagcaaccaaccgcgactacctacgccaacgccaagtagcgctcggaaacatggaaaccaaggaaagcaaagccatccgccaacacgcagaatccgcaggctgctcgatggtggaagacatcgaaagcccaagctcaatctgggtcttcgccggagcccccgaccgatgcccacccacatgcctcttcatcgccggaatagcggaactcggcgcattcttcagcatactacaagacatgcgcaacacaataatggcaagcaaaaccgtcggcaccagcgaagaaaaactacgaaagaaatcctccttttaccaatcctacctacgcaggacccaaagcatgggcatacaactggaccagcgcatcatcgtgctattcatggtagcctggggaaaagaagccgtcgacaacttccacctcggcgatgacatggaccccgaactacgaacactcgcacaatcgctcatcgacgtcaaagtaaaagaaatatcaaaccaggaaccactaaaactctaa

SEQ ID NO: 7785 - RNA, 1290 nt, synthetic construct
  misc_feature 1..1290: note = derived and/or modified CDS sequence (opt11) from HTNV(CGAa31P9)__EF990910.1__N
  source 1..1290: mol_type = other RNA
atggcgaccatggaagaactacaaagagaaataaacgcccacgaaggccagctagtaatagcccggcaaaaagtacgcgacgcagaaaaacaatacgaaaaagacccggacgaactcaacaaaaggaccctaaccgaccgagagggcgtagccgcaagcatacaagctaaaatagacgagctcaaacgccaactcgccgacagaatcgcaacagggaaaaacctaggaaaagaacaagatcccaccggagtagaaccaggcgaccatctcaaggagcgatccatgctgagctacggcaacgtcctagacctaaaccatctagacatcgacgaaccgacaggacaaacagccgactggctcagcatagtcatatacctcacatcgttcgtagtcccgatcctactgaaagccctatacatgctcacaaccagaggcaggcaaacgaccaaagacaacaaagggacaaggataagattcaaggacgacagctcattcgaagacgtgaacggaataaggaaaccgaaacatctctacgtttctctgccgaacgcacaatcgagcatgaaagcagaagagatcacacccggacgctaccgcacggcaatatgcggactataccccgcccaaatcaaagcacgccaaatgatcagcccagtcatgagcgtaataggattcctagcactagccaaagactggagcgaccgcatcgaacaatggttgagcgaaccctgcaaactactccccgacacagccgcagtttcgctacacggcgggcccgcaaccaaccgcgactacctacgccaacgccaagtcgcactcggaaacatggaaaccaaggagagcaaagccatccgacagcacgccgagtcggccgggtgctccatggtggaagacatcgaaagtccatcctcaatctgggtattcgccggcgccccagacaggtgcccgccaacctgcctattcatagccgaaatcgcagaactaggcgcattcttcagcatactacaagacatgcgaaacacaataatggcaagcaaaaccgtcggcacaagcgaagaaaaactccgcaaaaagagctcgttctaccaatcgtacctccgaaggacccaaagcatgggcatccaactagaccaacgaataatcgtgctattcatggtcgcctggggaaaagaagcggtagacaacttccacctgggcgatgacatggaccccgaactacgcacgctagcccaatcactcatagacgtaaaagtgaaagaaatatcaaaccaagaaccactcaaactctaa

SEQ ID NO: 7786 - RNA, 1290 nt, synthetic construct
  misc_feature 1..1290: note = derived and/or modified CDS sequence (opt11) from HTNV(CGAa4MP9)__EF990915.1__N
  source 1..1290: mol_type = other RNA
atggccaccatggaggaactccaacgagaaataaacgcccacgaaggacagctagtcatcgcacgccaaaaagtcagagacgcggaaaaacaatacgaaaaagacccagacgaacttaacaaacgaacactcacagaccgcgaaggcgtcgccgcctccatacaagccaaaatcgacgaactcaagcgccaactagcagaccgcatcgccaccggcaaaaacctaggcaaagaacaagacccaacgggagtcgaacccggcgaccacctcaaagaacgaagcatgctctcctacggcaacgtcctcgatctcaaccacctcgacatcgacgaaccaaccggccaaaccgccgactggttaagcattgtcatctacctaaccagcttcgtcgtacccatactcctaaaagccctatacatgctcacaacaaggggacgacaaaccacaaaagacaacaaaggaacacgaatccgcttcaaagacgactcatcattcgaagacgtaaacggaatcagaaaaccaaagcacctatacgtctcactacccaacgcccaatcaagcatgaaagccgaagaaataacacccggccgatatcgcaccgccatctgcgggctctacccagcccaaataaaagcccgccaaatgatctcccccgtaatgagcgtaataggcttcctggccctcgcaaaggactggagcgaccgcatcgaacaatggctcggcgaaccatgcaaactactcccagacacagcagcagtatccctcctaggcggccccgcaaccaaccgcgactacctccgccaacgccaagtagccctcggcaacatggaaaccaaagaatccaaagccatacgccaacatgccgaaacggccggatgctccatgatcgaagacatagagagcccctccagcatctgggtcttcgccggtgcccccgaccgctgcccacccacatgccttttcatagcaggcatcgcagaactcggagccttcttcagcgttctccaagacatgcgcaacaccatcatggcaagcaaaaccgtcggcacaagcgaagaaaaacttcgcaagaaatcctcattctaccaaagctacctccgccggacccaatcaatgggcatccaactagaccaacgcatcatcgtcctattcatggtcgcatggggcaaggaagccgtcgacaacttccacctgggcgacgacatggaccccgaactgcgcacactcgcacaatcactcatcgacgtcaaagtaaaagagatctcaaaccaagaaccactcaaactttaa

SEQ ID NO: 7787 - RNA, 1290 nt, synthetic construct
  misc_feature 1..1290: note = derived and/or modified CDS sequence (opt11) from HTNV(CGAa75)__EU092220.1__N
  source 1..1290: mol_type = other RNA
atggccacaatggaagaactccaacgtgaaatcaacgcacacgaaggacaactcgtcatagcccgccaaaaagtacgcgacgcagaaaaacaatacgaaaaagaccccgacgagctcaataaacggaccctcacagaccgcgagggagtcgcagcaagcattcaagccaaaatagacgaactcaaacgtcaactcgccgaccggatcgccaccggaaaaaacctcggcaaagaacaagaccccacaggcgtcgaacccggcgaccacctcaaagaacgctccatgctcagctacggcaacgtactagacctcaaccacctcgacatcgatgaacccaccggccaaaccgccgactggctctccatagtaatctacctaacctccagcgtggtcccgatcctcctaaaagccctgtacatgctaacaacccggggccgccaaaccaccaaagacaacaaaggaaccagaatccgcttcaaagatgactcctccttcgaggacgtaaacggcatccgcaaacccaaacacctctacgtctcactcccaaacgcccaatcctccatgaaagccgaagagatcacacctggccgttaccgaacagccatctgcggcctctaccccgcacaaataaaagcgcgccaaatgatatcccccgtaatgaatgtcatcggattcttagccctcgccaaagactggagcgaccgaatcgaacagtggctctctgagccatgcaaactactccccgacaccgcagcagtatcactacacggcggacccgccaccaaccgcgactacctccgccaacgacaagtcgccctaggcaacatggaaactaaagaatccaaagcaatacgccaacacgcagaaagcgccggctgctcaatggtcgaagacatcgaaagccccagctccatctgggtcttcgccggagcccccgaccgctgcccccccacatgcctcttcatagcaggaatcgcggaactaggagcgttcttctccatcctccaagacatgcgcaacaccatcatggccagcaaaaccgtcggcacatccgaagaaaaactacgcaaaaaatcctccttctaccaatcctacctccgccgcacacaaagcatgggcatccaactcgaccaacgcataatcgtactcttcatggtcgcctggggcaaagaagcagtcgacaacttccacctcggcgacgacatggaccccgaactccgcacgctagcacagtcactaatcgacgtaaaagttaaagagatctccaaccaagaacccctcaaactctaa

SEQ ID NO: 7788 - RNA, 1290 nt, synthetic construct
  misc_feature 1..1290: note = derived and/or modified CDS sequence (opt11) from HTNV(CGHu1)__EU092218.1__N
  source 1..1290: mol_type = other RNA
atggccaccatggaggaactccagagagaaataaacgcccacgaaggccaactcgtcatcgcccgccaaaaagtacgcgacgccgaaaaacaatacgaaaaagacagcgacgaactaaacaaacgaacactcacagaccgagaaggcgtagccgtctccatacaagccaaaatagacgaactcaaacgccaactcgccgaccgcatcgccacaggcaaaaacctaggaaaagagcaagaccccacaggcgtagaacccggagaccacctcaaagaacgctccatgctctcctacggaaacgtcctggacctgaatcacctcgacatcgacgaaccaacaggccaaaccgccgactggctcagcatagtcgtatacctaaccagcctagtcgtcccgatcctactaaaggcactatatatgctcaccaccaaaggccgccaaactaccaaagacaacaaaggaacccgcataagattcaaagacgactcatccttcgaagacgtaaacggaatcaggaaacccaaacatctctacgtatccctactgaacgcacaatcctccatgaaagcggaagaaatcacccccggccgctaccgaaccgcaatctgcggaccataccccgcccaaataaaagcacggcaaatgatatcccccgtcatgtccgtcatcggattcctagcactagcaaaagactggtccgaccgcatagaacaatggctatcagaaccctgcaaattactccccgacacagccgcagtctccctgctaggcggaccagccaccaaccgcgactacctccgacaacgacaagtagcactaggcaacatggaaacaaaagaaagcaaagcaatccgacaacacgccgaagcggcaggctgctccatgatcgaagacatcgaatcaccctcatccatctgggtctcagccggagcccccgaccgctgcccacccacatgcctgttcatcgccggcatagcagaactcggagccttcttcagcatcctacaagacatgcgcaacaccatcatggcatctaaaaccgtcggaaccagcgaagaaaaactccggaagaaaagctcattctaccaatcatacctccgacgaacacaaagcatgggcatacaactggaccaacgcatcatcgtactattcatggtcgcctggggaaaagaagccgtcgacaacttccacctgggcgacgacatggacccagaacttcgaaccctcgcacaatccctcattgacgttaaagtgaaagaaatctcaaaccaggagcccctaaaactctaa

SEQ ID NO: 7789 - RNA, 1290 nt, synthetic construct
  misc_feature 1..1290: note = derived and/or modified CDS sequence (opt11) from HTNV(CGHu2)__EU363813.1__N
  source 1..1290: mol_type = other RNA
atggcaaccatggaagaactacaacgagaaatcaacgcccacgaaggccaactcgtcatcgcaagacaaaaagtcagagacgcagaaaaacaatacgaaaaagacccagacgaactcaacaaacgaacactcaccgaccgcgagggcgtcgccgcgtccatacaagccaaaatagacgaactaaaacgccaactcgccgaccgaatcgccacaggcaaaaacctaggcaaagaacaagacccaacaggcgtagaaccaggagaccacctcaaagagcgatcaatgctcagctacgggaacgtcctagacctaaaccacctcgacatagacgaaccaacaggccaaacagcagactggctatccattgtcatatacctcacctccctagtcgtcccaatcctactcaaagcactatacatgctcacaacaagaggaagacagacaacaaaagacaacaaaggcacccggatccgattcaaagacgacagctccttcgaagacgtcaacggcatacgcaaaccgaaacacctatacgtctccctccccaacgcacaatccagcatgaaagcggaagaaatcacccccggccgctaccgcacagcaatctgcggactatacccagcccaaatcaaagcacgccaaatgatcagcccggtaatgagcgtaatcggcttccttgccctagccaaagactggagcgaccgaatagaacaatggctcagcgaaccctgcaaactactacccgacacagcagcagtatcactccacggagggccagccaccaaccgagactacctccgtcaaagacaggtagccctcgggaacatggaaaccaaagaaagcaaagcaatccgccaacacgccgagtcagccgggtgctccatggtcgaagacatcgaaagccccagctcaatctgggtcttcgcaggagccccagacagatgcccccccacctgcctatttatcgccggcatcgcagaacttggagcgttcttcagcatcagccaagacatgcgcaacaccataatggcaagcaaaaccgtcggcacaagcgaagaaaaactccggaaaaaaagctccttttaccaatcctacctccgacgaacccaatccatgggaatacagctcgaccagcgcatcatcgtcctcttcatggtggcctggggcaaagaagcagtcgacaacttccacctcggcgatgacatggacccagaactccgcaccctcgctcagagcctcatcgacgtcaaagtgaaagaaatctccaatcaagaacccctaaaactatag

SEQ ID NO: 7790 - RNA, 1290 nt, synthetic construct
  misc_feature 1..1290: note = derived and/or modified CDS sequence (opt11) from HTNV(CGHu3612)__EF990909.1__N
  source 1..1290: mol_type = other RNA
atggccactatggaggaactccaacgcgaaataaacgcccacgagggacaactcgtcatcgcccgccaaaaagtccgcgacgccgaaaaacaatacgaaaaagaccccgacgaacttaacaaacgcgccctcaccgaccgcgaaggactagcagcatcaatccaagccaaaatcgacgaactcaaacgccaactcgccgaccgggtcgcaactggcaaaaacctcggcaaagaacaagacccaacaggcgtcgaaccgggcgaccacctcaaagagcgctccatgctctcatacggtaacgtcctcgacctaaaccacctcgacatcgacgaacccaccggccaaaccgccgactggctatctatcgtaatctacctaacttctttcgtcgtccccatcctcctcaaagccctatacatgctcaccacgcgcggtcgacaaacgaccaaagacaacaaaggcacccgcatcagattcaaagacgactcctcatttgaagacgtcaacggcatccgaaaacccaaacacctatacgtctcactgcccaacgcccaatcgtccatgaaagcagaagaaataacacccggccgataccgcaccgccatctgcggcctctaccctgcccaaataaaagccagacaaatgatatcacccgtaatgtccgtaataggcttcctcgccctcgccaaagactggtccgacagaatagaacaatggctctcagaaccctgcaagctcctcccggacaccgcagccgtcagcctacacggaggcccagccacaaaccgcgactacctccgccaacgccaagtcgccctcggaaacatggaaacaaaagagtccaaagccatcagacaacacgcagaatccgccggctgcagcatggtcgaggacatcgaatcaccctcatccatctgggtctttgccggcgcccccgaccgctgcccacccacatgcctcttcatcgcaggaatcgccgaactaggagcgttcttctccatcctccaagacatgcgaaacaccatcatggccagcaaaaccgttggcacctccgaagaaaaactccgcaagaaatccagcttctaccaaagttacctccgccgtacccaatccatgggaatccaactagaccaaagaatcatcgtactcttcatggtagcatggggaaaagaagcagtcgacaacttccacctcggcgacgacatggaccccgaactcagaacactcgcccaatccctcatagatgtcaaagtacgcgaaatatccaaccaagaacccctcaaactttaa

SEQ ID NO: 7791 - RNA, 1290 nt, synthetic construct
  misc_feature 1..1290: note = derived and/or modified CDS sequence (opt11) from HTNV(CGRn15)__EU363810.1__N
  source 1..1290: mol_type = other RNA
atggccacaatggaagaactccagcgcgaaatcaacgcccacgaaggccaactggtcatagcacggcaaaaagtcagggacgccgaaaaacaatacgaaaaagaccccgacgaactaaacaaacgcaccctaaccgacagagaaggcgtagccgccagcatccaagctaaaatcgatgaactcaaacgacaactagccgaccgcatcgcaacaggcaaaaacctaggaaaagaacaagaccccaccggagtcgaaccaggagaccacctaaaagagcgcagcatgcttagctacggcaacgtcctcgacctaaaccacctcgacatagacgaacccaccggacaaacggccgactggctaagcatcgtaatctacctaacatcattcgtagtccccatcctcctcaaagccctatacatgctaacgacccgaggcagacaaaccaccaaagacaacaagggcaccagaatccgattcaaagacgacagctccttcgaggacgtgaacggcatcagaaaaccaaaacacctctacgtaacactcccaaacgcgcaatcctccatgaaagccgaagaaatcacacccggacgataccgcaccgccatctgcggcctataccccgcacaaatcaaagcacgccaaatgatcagccccgtaatgagcgtcatcggcttcctcgccctcgcaaaagactggtcagaccgcatcgaacaatggctctccgagccctgcaaactactcccagacaccgccgcagtctcactccacggcggccccgccaccaaccgagactacctccgacaacgacaagtcgccctaggcaacatggaaacaaaagagagcaaagccatccgccaacacgccgaatcagccggctgctccatggtagaagacatcgaatccccatcctcaatctgggtattcgcaggcgccccggatcgatgcccaccaacctgcctattcatagcgggaatagcagaactcggagccttcttcagcatcctccaagacatgcgcaacaccatcatggcatcaaaaaccgtcggcacaagcgaagaaaaactccgaaagaaaagctccttctaccaaagctacctccgcagaacacaaagcatgggcatacaactggaccagcgcatcatcgtactcttcatggtcgcatggggaaaagaagccgtcgacaactttcacctaggcgacgacatggaccccgaactccgcaccctagcccaatcgctaatcgacgtcaaagtcaaagaaatctcgaaccaagaaccgctcaaactctaa

SEQ ID NO: 7792 - RNA, 1290 nt, synthetic construct
  misc_feature 1..1290: note = derived and/or modified CDS sequence (opt11) from HTNV(CGRn2616)__EU363811.1__N
  source 1..1290: mol_type = other RNA
atggccaccatggaagaactacaacgcgaaatcaacgcccacgaaggacaacttgtcatcgcccgacaaaaggtccgcgacgcaggaaaacaatacgaaaaagacccggacgaactaaacaaacgcaccctcacagaccgagaaggcgtcgccgcatccatccaggccaaaatcgacgaactgaaaagacaactcgccgaccgaatagccaccggcaaaaacctcggcaaagaacaagaccccacaggagtcgaaccaggagaccacctaaaagaacggagcatgctaagttacggcaacgtcctcgacctgaaccacctagacatcgacgaaccaacaggccaaaccgccgactggctaagcatcgtcatctacctgaccagctttgtagtccccatcctactaaaagcactatacatgctgacaacacggggccgccaaacaaccaaagacaacaaagggacccgcatcagattcaaagacgacagctccttcgaggacgtgaacggcatccgcaaaccaaaacacctctacgtctccctcccaaacgcacaatcaagcatgaaagccgaagaaatcacaccaggccgctaccgcacagccatctgcggactctaccccgcccaaataaaagcccgccaaatgatcagccccgtcatgagtgtcatcggattcctcgccctagcaaaggactggagcgaccgtatagaacaatggctatccgaaccctgcaaactgctcccggacaccgccgcagtatccctccacggcggccccgcgaccaatcgtgactacctccgacaacgccaagtcgccctaggaaacatggaaaccaaagaaagcaaagccatccgccaacacgcagaatccgccggctgcagcatggtcgaagacatcggctccccaagttccatctgggtcttcgccggcgcacccgaccgctgcccacccacgtgcctcttcatcgccggaatcgccgaactgggcgccttcttcagcatactccaagacatgcgcaacaccatcatggcaagcaaaaccgtaggcaccagcgaagaaaaactccgcaaaaagtcctccttctaccaatcctacctccgacgcacccaaagcatgggcatacaactagaccaacgtataatcgtactcttcatggttgcctggggaaaagaagccgtcgacaacttccacctaggcgacgacatggaccccgaactccgcacactagcacaatccctcatagacgtggaagtgaaagaaatcagcaaccaggaacccctgaagctctaa

SEQ ID NO: 7793 - RNA, 1290 nt, synthetic construct
  misc_feature 1..1290: note = derived and/or modified CDS sequence (opt11) from HTNV(CGRn53)__EF990907.1__N
  source 1..1290: mol_type = other RNA
atggcaaccatggaagaactacaacgcgaaatcaacgcacacgaaggacaactcgtcatagcccgccaaaaagtccgagacgcagaaaaacaatacgaaaaagatccagacgaactaaacaaaagagcactaacagaccgcgaaggtgtagcagcatccatacaagcaaaaatcgacgaactcaagcgccaactagccgaccgcatcgcaacaggcaaaaacctcggcaaagaacaagacccaaccggcgtcgaaccaggtgaccaccttaaagaacgctccatgctcagctacggcaacgtactcgacctaaatcacctcgacatcgacgaaccaaccggtcaaacagccgactggctcagcatcgtaatctacctgacctcattcgtcgtcccaatactcctaaaagccctctacatgctaacaacccgcggcagacaaacaaccaaagacaacaaaggcacgcgcatccgcttcaaagacgactcctccttcgaagacgtcaacggaatccgaaaaccaaaacacctctacgtcagcctccccaacgcacaatcaagtatgaaagccgaagaaataactcccggacggtaccgaacagccatttgcggactctaccccgcccaaatcaaagcccgccaaatgatctccccagtcatgtccgtgatcggcttcctcgccctcgcaaaagactggagcgaccgcatcgaacaatggctgagcgaaccctgcaaactcctcccagacacagccgcggtctcgctccacggcggccctgccaccaaccgcgactacctccgccaacgacaagtcgccctcggaaacatggaaacaaaagaatccaaagccatccgccaacacgctgaagcagccggttgctcaatgatcgaagacatcgaaagcccatcctccatatgggtcttcgcaggagcaccagaccgctgcccgcccacatgccttttcatcgcaggcatagccgaactcggagccttcttcagcatcctacaagacatgagaaacaccatcatggcatccaaaaccgtgggcacatccgaagaaaaactccgcaagaaaagctcattctaccaatcctacctccgccgcactcaatcaatgggcatccaactagaccaacgcatcatcgtcctattcatggtcgcctggggcaaagaggctgtagacaacttccacctgggcgacgacatggaccccgaactacgcaccctcgcccaaagcctcatcgacgtaaaagttaaagaaatatccaaccaagaacccctcaaactctaa

SEQ ID NO: 7794 - RNA, 1290 nt, synthetic construct
  misc_feature 1..1290: note = derived and/or modified CDS sequence (opt11) from HTNV(CGRn5310)__EF990906.1__N
  source 1..1290: mol_type = other RNA
atggccaccatggaagaactccaaagagaaataaacgcccacgaaggccaactcgtaatcgcccgccaaaaagtgcgcgacgcagaaaagcaatacgaaaaagacccagacgaaccaaacaaacgcgccctaacagaccgcgaaggcgtagccgcctccatccaagccaaaatagacgaactcaaacgccaactcgccgaccgcatcgcaaccggcaaaaacctgggaaaagagcaagaccccaccggcgtagaacccggcgaccacctcaaagaacgaagcatgctatcctacggcaacgtcctcgacctcaaccacctcgacatagacgaacccacaggccaaactgccgactggctcagcatcgtaatctacctcacgtcattcgtagtccccatcctcctaaaagccctgtacatgctcactaccagaggacgacaaaccaccaaagacaacaaaggcaccagaatccgcttcaaagacgactcatcattcgaagacgtcaacggcatacgcaaacccaaacacctctacgtatccctaccaaacgcccaatccagcatgaaagcagaagaaatcacccccggacgctaccgcaccgccatctgcggcctctaccccgcccaaatcaaagcacgccaaatgatctcaccagtcatgtcagtcataggattcctcgccctagccaaagactggagcgaccgaatagaacaatggctctctgaaccatgcaaactcctccctgacactgcagcagtatccctccacggcggcccagccaccaaccgggactacctcagacaacgacaagtagcactaggaaacatggaaacaaaggaatccaaagcaatacgccaacacgctgaggccgccggatgctccatgatagaagacatagagtccccttcaagcatatgggtcttcgccggggcacccgaccgctgcccacctacctgccttttcatagcaggcatagcagaactcggagccttcttctcgatcctacaagatatgagaaacacaatcatggcctcaaaaaccgtaggcaccagcgaagaaaaactccgtaagaaaagctccttctaccaatcctacctccgacggacccaatcaatgggaatccaattagaccaacgaatcatcgtactcttcatggtcgcctggggcaaagaagcagtcgacaacttccacctcggcgacgacatggaccccgaactccgcaccctggcccaaagcctgatcgacgtgaaagtcaaggaaatcagcaaccaagaacccctcaaactataa

SEQ ID NO: 7795 - RNA, 1290 nt, synthetic construct
  misc_feature 1..1290: note = derived and/or modified CDS sequence (opt11) from HTNV(CGRn93MP8)__EF990905.1__N
  source 1..1290: mol_type = other RNA
atggccacaatggaagaactccaacgcgaaatcaacgcgcacgaaggccaactcgtcatagcccgacaaaaagtccgggacgccgaaaaacaatacgaaaaagaccccgacgaactaaacaaacgtgccctcaccgaccgcgagggcgtagccgccccaatccaggccaaaatcgacgaactcaaacgccaactcgccgaccggatcgccaccggcaagaacctaggcaaagaacaagacccaaccggcgtcgaacccggcgaccacctcaaagagcgtagcatgctaagctacggaaacgtcctcgacctcaaccacctagatatcgacgaacccaccggacaaaccgccgactggctctcaatagtcatctatctaacctcattcgttgtccccatcctactcaaagccctctacatgctaaccacacgcggccgccaaaccacaaaagacaacaaaggctctcgcatccgcttcaaagacgactcatcattcgaagacgtaaacggaatccgcaaacccaaacacctctacgtatcactacccaacgcacaatcctccatgaaagcagaagagatcaccccaggacgataccgcaccgcaatatgcggcctctaccccgcccagataaaagcacgacaaatgatcagccccgtcatgtccgtcatcggcttcctcgcccttgccaaagactggtcagaccgcatagaacaatggttatccgaaccctgcaaacttctcccggacacagccgccgtatccctccacggcggccccgccaccaaccgcgactacctccgccaacgccaagtagcccttggcaacatggaaacaaaagaatccaaagcaatccgccaacacgccgaagccgcaggctgctccatgatcgaagacatcgaaagccccagctcaatatgggtcttcgccggagcccccgacagatgcccacctacctgcctattcatcgccggcatcgccgaactaggagcattcttctccatactccaagatatgcgaaacaccatcatggcaagcaaaaccgtcggtacctccgaagaaaaactccgcaagaagtcctccttctaccaatcatacctacgcagaacccaatcaatgggcattcaactcgaccaacgcattatagtactattcatggtcgcctggggcaaagaagcagtcgacaacttccacctcggcgacgacatggaccccgaactccgcaccctcgcacaaagcctgatcgacgtaaaagtaaaagaaatatcaaaccaagaacccctaaaactctaa

SEQ ID NO: 7796 - RNA, 1290 nt, synthetic construct
  misc_feature 1..1290: note = derived and/or modified CDS sequence (opt11) from HTNV(CGRn93P8)__EF990904.1__N
  source 1..1290: mol_type = other RNA
atggccaccatggaagaactccaacgcgaaatcaacgcccacgaaggccagctagtcatcgcccgacaaaaagtccgcgacgccgaaaaacaatacgaaaaagaccccgatgagctaaacaaacgcgcactgaccgaccgagaaggagtagccgcatccatccaagcaaaaatcgacgaactcaagagacaactagccgaccgcatcgccaccggcaaaaacctcggcaaagaacaagatcccaccggagtggaaccgggagaccacctaaaagaacgcagcatgctctcctacggaaacgtcctggacctaaaccatctcgacatagacgagccaaccggacaaacagcagactggctctccatcgtcatctacctaacctcattcgtcgtccctatcctgctaaaagcattatacatgctaacaacccgcggtcgccaaacaaccaaagacaacaaaggaacccgcatccgattcaaagacgactcatccttcgaagacgtaaacggcatccgcaaacccaaacacctctacgtcagtctccccaacgcccaatcctcaatgaaagccgaagaaatcacccccggcagataccgcaccgccatctgcggactctaccccgcccaaatcaaagcccgccaaatgataagccccgtcatgtccgtcataggcttcctcgcccttgccaaagactggtccgaccgcatagaacaatggctctccgaaccctgcaaactcctccctgacaccgccgccgtaagcctacacggcggacccgccaccaaccgcgactacctacgacaacgacaagtagccctcggaaacatggaaactaaagaatccaaagccatcagacaacacgccgaagcagcaggctgctcaatgatagaagacatagaatcaccctcctccatctgggtcttcgccggcgcacccgacagatgcccaccaacctgccttttcatagccggaatagccgaactcggcgccttcatcagcatacttcaagacatgcgaaacaccatcatggcaagcaagacagttggcaccagcgaagaaaaactccgcaacaaatccagcttctatcaatcatacctaagacgcacccaaagcatgggcatccaactcgaccaacgcatcatagtactattcatggttgcctggggcaaagaagccgtcgacaacttccacctcggcgacgacatggaccccgaactccgcaccctcgcacaatccctgatcgacgtcaaagtcaaagaaatatccaaccaagaacccctcaaactctaa

SEQ ID NO: 7797 - RNA, 1290 nt, synthetic construct
  misc_feature 1..1290: note = derived and/or modified CDS sequence (opt11) from HTNV(CGRni1)__EU363812.1__N
  source 1..1290: mol_type = other RNA
atggccacaatggaagaactccaacgcgaaatcaatgcccacgaaggccagctggtaatcgccagacaaaaagtccgagacgcagaaaaacaatacgaaaaagaccccgacgaactcaataaacgcaccctcaccgacagagaaggagtcgccgcctcaatccaagcaaaaatcgacgaactcaagcgacaactcgccgacagaatcgccaccgggaaaaacctcgggcgagaacaagaccccaccggcgtcgaaccaggcgaccacctcaaagaacgatccatgctctcctacggaaacgtccttgacctcaaccacctcgacatagacgaacccacaggccaaaccgccgactggctatcaatcgtaatatacctcacctcattcgtcgtccccatactcctaaaagccctctacatgctaactacccgcggccgacaaacaaccaaagacaacaaaggcacccgaatacgcttcaaagacgactcgtcattcgaagacatcaacggcatccgcaaaccaaaacacctttacgtatcactacccaacgcccaatcgtccatgaaagccgaagaaataacccccggccgataccgcaccgccatctgcggactgtatcccgcccaaatcaaagccaggcaaatgatcagccccgtcatgtccgtcatcggcttcctagccctcgcaaaagactggtcagaccgcatcgagcaatggctatccgaaccatgcaaactcctcccagacaccgcagccgtctccctccacggcggccccgccacaaaccgcgactacctccgacaacgccaagtagccctcggcaacatggaaacaaaagaaagcaaagccatacgacaacacgccgagtcagccggctgctccatggtcgaagacatcgaatccccctcctccatttgggtcttcgcaggcgcaccagaccgctgtcccccaacctgcctgttcatcgccggtatcgcagaactaggggcgttcttctccatcctccaggacatgcgcaacaccataatggcatcaaaaaccgtcggcaccagcgaagaaaaactccgcaagaaatcctccttctaccaatcctacctccgccgcacccaaagcatgggaatccagctcgaccaacggatcatcgtactcctaatggtcgcgtggggaaaagaagccgtcgacaacttccacctcggcgacgacatggaccccgaactccgcaccctcgcccaatcactcatagacgtcaaagtcaaagaaatctccaaccaagaaccgctaaaactctaa

SEQ ID NO: 7798 - RNA, 1290 nt, synthetic construct
  misc_feature 1..1290: note = derived and/or modified CDS sequence (opt11) from HTNV(CJAp93)__EF208929.1__N
  source 1..1290: mol_type = other RNA
atggccacaatggaagaactacaacgagaaatcaacgcacacgaaggacaactcgtcatcgccagacaaaaagtacgcgacgcagaaaaacaatacgaaaaagaccccgacgaactcaacaaacgcaccctcaccgaccgcgaaggcgtagcagtctccatccaagccaaaatagacgaacttaaacgacaactcgcggaccgcatcgcaacaggcaaaaacctaggaaaagaacaagaccccacaggcgtcgaaccaggcgaccacctaaaagaacgcagcatgctcagctacggcaacgtcctcgacctgaaccacctcgacatcgacgaacccacaggacaaaccgccgactggctatcaatagtggtgtacctcaccagcttcgtcgtcccaatactactgaaagccctatacatgctaaccacacgaggccgccaaaccaccaaagacaataaaggcacccggatccgattcaaagacgacagctccttcgaagacgttaatggcatacgcaaacccaaacatctatacgtctccctccccaacgcccaatccagcatgaaagccgaagaaatcacccccggacgctaccgcacagccatatgcggcctgtacccagcccaaatcaaagcccgacaaatgatcagcccggtcatgagcgtcatcggcttcctagccctggccaaagactggagcgacagaatcgagcaatggctctcagaaccctgtaaactactacccgacaccgccgccgtcggcctcctaggaggccccgcaacaaaccgcgactacctacgccagagacaagtcgccctcggaaacatggaaaccaaagaatccaaagccatccgtcaacatgccgaagcagccggctgctctatgatcgaagacatcgaaagcccaagctcaatctgggtcttcgccggcgcccccgaccgctgccctcccacatgcctcttcatcgccggtatcgccgagctcggagcctttttcagcatcctacaagacatgcgcaacaccatcatggccagcaaaaccgtcggcacatccgaagaaaaactccgcaagaaaagctcattctaccaatcgtacctacgccgaacccaatccatgggcatccaactagatcaacgaatcatcgtcctcttcatggtcgcatggggcaaagaagccgtcaacaacttccacctcggcgacgacatggaccccgaactcagaacactagcccaatccctcatcgacgtaaaagtcaaagaaatctcaaaccaagaaccactaaaactgtaa

SEQ ID NO: 7799 - RNA, 1290 nt, synthetic construct
  misc_feature 1..1290: note = derived and/or modified CDS sequence (opt11) from HTNV(Aa14_207)__KX687234.1__N
  source 1..1290: mol_type = other RNA
atggccaccatggaagaactccaacgcgaaatcaacgcacacgaaggacaactcgtaatcgcacgccaaaaagtccgagacgccgaaaagcaatacggcaaagacccagacgaactcaacaaacgagccctaacagaccgcgaaggcgtcgcagtctcaatacaagccaaaatcgacgaactaaaacgacagctcgccgaccggatcgcaaccgggaaaaacctcggaaaagaacaagacccaaccggagtcgaacccggagaccacctcaaagaacgcagcatgctctcctacggcaacgtactagacctcaaccacctcgacatagacgaaccgaccggccaaacagccgactggctttccatcgtcgtctacctcacatccttcgtcgtcccgatcctcctaaaagctctatacatgctaaccacccgcggccgacagaccaccaaagacaacaaaggcacacgaatacgcttcaaagacgactcctcgttcgaagacgtaaacgggatccgaaaaccgaaacatctatacgtctccctacccaacgcccaatccagcatgaaagccgaagaaatcacaccgggccggtaccgcaccgccgtatgcggcctctaccccgcacaaatcaaagcccgccaaatgatatcccccgtcatgagcgtaataggattcctggccctcgccaaagactggagcgaccgcatcgaacaatggctcagcgagccatgtaaacttctaccggacaccgccgccgtctccctactgggcggacccgcaaccaaccgagactacctccgccaacgccaagtcgcactcggcaacatggaaaccaaagaaagcaaagccatccgccagcacgcagaagcagccggttgctccatgatcgaagacatagaaagcccctcctccatatgggtcttcgccggcgcacccgaccgctgcccaccaacctgcctcttcgtcgccggcatagccgaactaggcgcattcttctccatactccaagacatgcgaaacaccatcatggccagcaaaaccgtaggaaccagcgaagaaaaactccgaaagaaaagctcattctaccaatcatacctccgccgaacccaaagcatgggcatccaactagaccaacgcattatagtcctcttcatggtagcctggggcaaagaagcagtcgacaacttccacctaggagacgacatggaccccgaactgcgcaccctcgcccaatcactcatagacgtcaaagtcaaagaaatctccaaccaagaacccctaaaactctga

SEQ ID NO: 7800 - RNA, 1290 nt, synthetic construct
  misc_feature 1..1290: note = derived and/or modified CDS sequence (opt11) from HTNV(Aa14_234)__KX687235.1__N
  source 1..1290: mol_type = other RNA
atggcaaccatggaagaactccagcgcgaaatcaacgcacacgaaggacaactcgtcatcgcccgccaaaaagtacgcgacgccgaaaaacaatacgaaaaagacccggacgaactaaacaaaagagccctaaccgaccgcgaaggcgtagccgtcagcatacaagcaaaaatcgacgaactcaaaaggcaactagcagaccgcatagcaaccggcaaaaacctcggaaaagaacaagatcccacaggcgtcgaacctggcgaccacctcaaagaacgctccatgctcagctacggcaacgtcctagacctgaaccacctagacatcgacgaaccgacagggcaaacagccgactggctcagcatagttgtatacctcacctcattcgtcgtccccatcctcctcaaagccctatacatgctaactactcgaggcagacaaacaaccaaagacaacaaaggaacccgcatccgcttcaaagacgacagctcattcgaagacgtaaacggaatccggaaacccaaacatctatacgtctcactgccgaacgcacaatcaagcatgaaagccgaagaaatcacacccggccgatatcgcacagccgtctgcggcctctaccccgcccaaatcaaagcgagacaaatgatatcccccgtcatgagcgtcatcggattcctggcactagccaaagactggagcgaccgcatagaacaatggctaggagaaccctgcaagctcctcccagacacggccgcagtcagcctcctaggcggccccgccacaaacagagactacctacgccaacgacaagtagccctcggaaacatggaaacaaaagaaagcaaagccatacgacaacacgcagaagcagcaggctgctcaatgatagaagacatcgaaagccccagcagcatatgggtcttcgcaggcgcccccgaccgatgcccgcccacatgcctttttattgccggaatagcagaactaggcgcgttcttctccatcctacaagacatgcgaaacaccataatggccagcaaaaccgtgggaaccagcgaagaaaaactacgaaagaaaagctccttctaccaaagctacctgcgccgcacccaaagcatgggcatccaactcgaccagcgcatcatagtgctattcatggtcgcctggggcaaagaagcagtagacaacttccacctcggcgacgacatggacccagaattacgcaccctagcacaatccctcatagacgtaaaagtcaaagaaatctccaaccaagaaccactaaaactctaa

SEQ ID NO: 7801 - RNA, 1290 nt, synthetic construct
  misc_feature 1..1290: note = derived and/or modified CDS sequence (opt11) from HTNV(Aa14_239)__KX687236.1__N
  source 1..1290: mol_type = other RNA
atggccacaatggaagaattacaacgcgaaatcaacgcacacgagggccaacttgtcatcgcccgacaaaaagtacgagacgcagagaaacaagacggcaaagaccccgacgaactcaacaaacgagccctgaccgaccgcgaaggcgtcgcagtatccatccaagcaaaaatcgacgaactgaagagacaactcgccgacagaatcgccacaggcaaaaacctaggcaaagaacaagaccccaccggagtagaacccggagaccacctgaaagaaagatccatgctaagctacggtaacgtcctagacctaaaccacctagacatcgacgaacccacaggccaaaccgccgactggctctccatcgtcgtctacctaaccagcttcgtagtacccatactcctaaaggcactgtatatgctcaccacacgaggccgccaaaccaccaaagacaacaaaggcacccgcattcgcttcaaagacgacagctcattcgaagacgtaaacggcatacgcaaacctaaacacctctacgtatcactaccaaacgcccaatcatcgatgaaagcagaagaaataaccccaggcagataccgcacagccgtctgcggcctgtaccctgcccaaatcaaagcacgccaaatgatcagcccagtaatgtccgtcatcggcttcttagccctcgcaaaggactggtccgaccgaatcgaacaatggcttggcgaaccctgcaaactactccccgacaccgccgccgtctcactcctaggaggccccgccacgaaccgagactacctccgccaacgccaagtcgccctcggcaacatggaaacaaaggaatccaaagccatccgccaacacgccgaagccgccggctgctcgatgatcgaggacatagaaagcccatcctccatctgggtcttcgccggcgccccagaccgctgcccacccacgtgcctattcatagcaggcatcgcagagctcggcgccttcttcagcatcctccaagacatgcgaaacaccatcatggcctctaaaaccgttggcacctccgaagaaaaactccgcaagaaatcctcattctaccaaagctacttacgccgaacacaaagcatgggcatccaactagaccaacgcatcatcgtactattcatggtagcctggggcaaagaagctgtcgacaatttccacctaggcgacgacatggaccccgaactgcgcaccctagcccaatcactaatcgacgtaaaagtcaaagaaatcagcaatcaagaacccctaaaactctag

SEQ ID NO: 7802 - RNA, 1290 nt, synthetic construct
  misc_feature 1..1290: note = derived and/or modified CDS sequence (opt11) from HTNV(AY133/2011)__KY807166.1__N
  source 1..1290: mol_type = other RNA
atggccaccatggaagaactccaacgcgaaataaacgcacacgaagggcaactcgtcatagccagacaaaaagttcgcgacgccgaaaaacaatacgaaaaagaccccgacgaactcaacaaacgagccctaaccgaccgcgagggcgtagcagcctccatccaagccaaaattgacgaactcaaacgccaactcgccgaccgaatcgcaaccggcaaaaacatcggaaaagaacaagaccccaccggagtagaaccaggcgaccacctaaaagaacgatccatgctcagctacggcaacgtcctcgacctaaaccacctcgacatagacgaacccaccgggcaaactgccgactggctgagcatcgtcatctacctcaccagcttcgtcgtacccatcctcctcaaagccctgtacatgctaaccacacgtggccgccaaaccaccaaagacaacaaaggcacacgaatccgattcaaggacgatagctccttcgaagacgtatccgggatccgcaagccaaaacacctctacctgtccctaccaaacgcccaaagcagcatgaaagccgaagagatcaccccaggccgataccgaaccgccatctgcgggctataccccgcccaaatcaaagctagacaaatgatcagcccagtcatgagcgtcatcgggttcctcgccctcgccaaagactggtcagaccgcatcgaacaatggctatccgaaccctgcaaactccttcccgacaccgccgccgtatccctacacggcggccccgccaccaatcgcgactacctccgtcaacgacaagtcgcactcggcaacatggaaaccaaagaaagcaaggccatacgccaacacgcagaaaccgccggatgctccatgatcgacgacatcgaaagcccctcctccatatgggtcttcgccggcgccccagacagatgcccacccacatgcctcttcatcgccggcatcgccgaactgggtgccttcttctcaatcctacaagacatgcgcaataccatcatggcatccaagacggtcggcacatccgaagaaaaactacgaaagaaaagcagcttctaccaatcctacctccgacgcacccaaagtatgggcatacaactagaccaacgcattatcgtactcttcatggtcgcctggggaaaagaagcggtcgacaactttcacctgggcgacgacatggaccccgaactgcgaaccctcgcccaatccctcatcgacgtcaaagtcaaagaaatctcaaaccaagaacccctcaaactctaa

SEQ ID NO: 7803 - RNA, 1290 nt, synthetic construct
  misc_feature 1..1290: note = derived and/or modified CDS sequence (opt11) from HTNV(GAN13/2011)__KY807168.1__N
  source 1..1290: mol_type = other RNA
atggctaccatggaagaactacagcgcgaaatcaacgcccacgaaggccagctagtcatcgcccggcaaaaagtccgcgacgcagaaaaacaatacgaaaaagacccagacgaactcaataaacgcgcactcacagaccgagaaggagtggccgccagcatccaagcaaaaatcgacgaactaaaacgccaactagccgaccgcatcgcaaccggcaaaaaccttggaaaagaacaagaccccacaggcgtagaacccggcgaccacctcaaagaacgaagcatgctaagttacggcaacgtcctggacctcaaccacctagacatagacgaaccaaccggccaaacagccgactggctcagcatagtcatctacctaacatccttcgtcgtccccatactcctcaaagcactatacatgctaaccacacgcggacgccaaaccacaaaagacaacaaaggaacacgcatacgcttcaaggatgacagctccttcgaagacgtcaacggaatccgaaaaccaaaacacctctacctctccctccccaacgcccaatcaagcatgaaagccgaagaaataacgccaggccgctaccgcacagccatatgcggcctataccccgcccaaatcaaagcgcgccaaatgataagccccgtaatgtcagtaataggcttcctggccctcgcgaaagactggtcagacagaatagaacaatggctcagcgaaccctgtaaactcctacccgacacagcggcggtatccctccatggcggccccgcaaccaaccgagattacctccgccaacgacaagtagctctcggcaacatggaaaccaaagagagcaaagccatccgacaacacgcagaaacggccggctgctcaatgatcgacgacatcgaatcccccagctcgatctgggtcttcgctggagcacccgaccgatgcccaccaacatgcctgttcatcgccggaatcgccgaactgggcgcattcttcagcatcctccaagacatgcgcaacaccataatggcaagcaaaaccgtaggcacaagcgaagaaaaactccgcaagaaaagctccttctaccaatcgtacctccgccgcacccaaagcatgggcatacaactagaccaacgcatcatcgtccttttcatggtcgcctggggaaaagaagcagtcgacaacttccacctcggcgacgacatggacccggaactccgcacactagcccaatcactcatagacgtaaaagtaaaagaaatctcaaaccaggaacccctaaaactatag

SEQ ID NO: 7804 - RNA, 1290 nt, synthetic construct
  misc_feature 1..1290: note = derived and/or modified CDS sequence (opt11) from HTNV(GAN19/2011)__KY807172.1__N
  source 1..1290: mol_type = other RNA
atggccaccatggaggaactacaacgcgagatcaacgcccacgaaggacagctagtaatcgcccgccaaaaagtcagagacgccgaaaaacaatacgaaaaagacccagacgaactcaacaaaagggccctcaccgaccgcgaaggagtagccgcaagcatccaagccaaaatcgacgaactaaaacgacaactcgccgaccgaatcgcaaccgggaaaaacctaggaaaagaacaagaccccaccggagtggaacccggtgaccacctaaaagaacgctccatgctcagctacggaaacgtccttgacctaaaccacctcgacatcgacgaacccaccgggcaaacggcagactggctcagcatagtcatatacctaacctccttcgtggtacccatccttctaaaggcgctctacatgctcacaacccgcggcagacaaaccaccaaagacaacaaaggaacccgaatcagattcaaagacgactcatcattcgaggacgtaaacggcatccgaaaacccaaacacctgtacctatcactcccgaatgcgcaatcatccatgaaagccgaagaaataacccccggcagataccgaaccgccatctgcggactctaccccgcacaaataaaagccagacaaatgaccagccccgtcatgagcgtcatcggcttcctcgccctcgcaaaggactggtccgaccgcatcgaacaatggctgagcgaaccctgcaaactcctaccagacaccgccgccgtatccctacacggcggcccagccacatcgcgagactacctacgccaacgccaagtagcccttgggaacatggaaacaaaagaatctaaagccatccgtcaacacgcagagacagccggatgctcaatgatagacgacatagaaagccccagctcgatatgggtcttcgccggagcaccagacagatgcccacccacatgcctgttcatagccggcatcgccgaactaggcgccttcttcagcatactccaagacatgcgaaacaccataatggcaagcaagacagtcggcacctccgaagaaaagctacgcaagaaatcctccctctaccaatcctaccttcgccggacacagagcatgggcatacaactggaccaacgaatcatcgtcctcttcatggtagcctggggcaaagaagcggtcgacaacttccacctcggcgacgacatggacccagaactccgcacactcgcacaatcactaatagacgtaaaagtaaaagaaatctcaaaccaagaaccactcaaactataa

SEQ ID NO: 7805 - RNA, 1290 nt, synthetic construct
  misc_feature 1..1290: note = derived and/or modified CDS sequence (opt11) from HTNV(LR1)__AF288294.1__N
  source 1..1290: mol_type = other RNA
atggccacaatggaagagctacaacgcgaaatcaacgcccacgaaggacaactagtcatagcccgccaaaaagtccgagacgctgaaaaacaatacgaaaaagaccctgacgagctcaacaaacgagccctcaccaaccgcgaaggcgtcgcagtatccatccaagccaaaatcgacgaactaaaaatgcagctcgcagacagaatcgcaacaggcaaaaacctaggcaaagaacaagacccaaccggtgtcgaacccggcgaccacctcaaagaacgaagcatgctatcctacggcaacgtcctcgacctgaaccacctcgacatcgacgaacctaccggccaaacagccgactggctcagcataatcgtatacctcacaagcttcgtcgtacccatactcctcaaagccctctacatgctcaccaccagaggccgccaaacgacaaaagacaacaaaggcacacgaatccgcttcaaagacgacagctcattcgaagacgtaaacggaatccgcaaaccgaaacacctctatgtatcactccccgacgcacaatcctcaatgaaagccgaagaaataacaccaggccgctaccgcaccgccgtctgcggtctctaccccgcccaaatcaaagcccgccaaatgatcagccccgtcatgtccgtcataggattcctagccctcgccaaagactggtccgaccgaatcgaacaatggctcatcgaaccctgcaaactactcccagacacagccgcagtctccctcctcggcggacccgcaaccaaccgcgattacctccgccaacgccaagttgccctcggaaacatggaaaccaaagaaagcaaagccatccgccaacacgccgaagccgcaggctgctctatgatagaagacatagaatcaccaagctccatatgggtcttcgccggagccccagaccgctgcccaccaacctgcctattcatcgccggcatagccgagctgggggccttcttctccatactccaagacatgagaaacaccatcatggccagcaaaaccgtaggcacctccgaagaaaaactcagaaaaaaaagctccttctaccaaagctacctgcggagaacacaatcaatgggcatccaactagaccaacgaatcatcgtcctcttcatggtcgcctggggaaaagaagccgtcgacaacttccacctgggcgacgacatggaccccgaactccgaaccctagcacagtcccttatcgacgtcaaagtaaaagagatatccaatcaagaacccctcaaactataa

SEQ ID NO: 7806 - RNA, 1290 nt, synthetic construct
  misc_feature 1..1290: note = derived and/or modified CDS sequence (opt11) from HTNV(RG9)__AF288296.1__N
  source 1..1290: mol_type = other RNA
atggcaaccatggaagaactccaacgcgaaatcaacgcccacgaaggccaactcgtaatcgcacgccaaaaagtaagagacgcagaaaaacaatacgaaaaagaccccgatgaactaaacaaacgcaccctaacagaccgcgaaggcgtagctgcatcaatccaggccaaaatcgacgaactgaaacgccaactcgccgaccgcatcgccacaggcaaaaacctcggaaaagaacaagaccccaccggcgtcgaacccggcgaccacctcaaagaacgctccatgctctcctacggtaacgtcctcgacctaaaccaccttgacatcgacgaacccactggacaaacagccgactggctctccatcgtcatatacctcacctcattcgtggtccccattctcctcaaagccctctacatgctcacaaccagaggaagacaaacaaccaaagacaacaagggcacccgcatccgcttcaaagacgactcctccttcgaagacgtcaacggaataagaaaacccaaacacctctacgtatcactccccaacgcccaatcatccatgaaagctgaagaaattacccccggccgataccgcaccgccatatgcggcctctatcccgcccaaatcaaagcccgtcaaatgatctcccccgtcatgtcggtcatcggcttcctcgccctggccaaagactggtcagaccgcatcgaacaatggctatcagaaccctgcaaactactacccgacacagcagccgtgtccctccacggaggcccagcaaccaaccgcgactacctacgccaacgccaagtagccctcggaaacatggaaaccaaagaaagcaaagccatcagacaacacgcagaatccgcaggctgctcaatgatcgaagacatcgaatctccatcctccatatgggtattcgcaggcgcccccgaccgctgccctcccacatgccttttcatcgccggcatagccgaactcggcgccttcttcagcatcctccaagacatgcgaaacacaataacagcctccaaaactgtcggcacaagcgaagagaaactccgaaagaaatcctccttctaccaatcctacctccgccgaacacaatccatgggaatccaactcgaccaacgcatcatcgtcctgttcatggtcgcctggggcaaagaagcagtcgacaacttccacctcggcgacgatatggaccccgaactgcgaacactcgcacaatcactcatcgacgtcaaagtaaaagaaatcagcaaccaagaacccctcaaactataa

SEQ ID NO: 7807 - RNA, 1290 nt, synthetic construct
  misc_feature 1..1290: note = derived and/or modified CDS sequence (opt11) from HTNV(S85-46)__AF288659.1__N
  source 1..1290: mol_type = other RNA
atggccaccatggaggaactacaacgcgaaatcaacgcccacgaaggccaactcgttatcgcccgccaaaaagtcagagacgccgaaaaacaatacgaaaaagaccccgacgagctcaacaaatccgcactcacaaaccgcgaaggcgtagctgtctcaatacaagcaaaaatcgacgaactcaaaatgcagctcgcagaccgcatcgcaacaggcaaaaacctcgggaaagaacaagacccaaccggcgtcgaacccggcgaccacctcaaagaaagatcaatgctatcctacggcaacgtcctggacctgaaccacctcgacatcgacgaacccaccggacaaacagcagactggctctcaattatcgtctacctcacctccttcgtagtaccaatactactcaaagccctctacatgctcaccacccgaggacgccaaaccacaaaggacaacaaaggaacacgaatccgattcaaagacgacagcagcttcgaggacgtaaacggaatccgaaaacccaagcacctgtacgtctccctccccaacgcccagagctccatgaaagcagaagaaataacccccggccgctaccgcaccgccgtctgcggcctctacccagcacaaatcaaggcccgccaaatgataagcccagtcatgagcgtcataggcttcctcgccctcgcgaaggactggtccgaccgcatcgaacaatggctaatagaaccctgcaaactgctccccgacacagccgcagtctcactgctaggaggccccgcaaccaaccgcgactacctccgccaacgacaagtcgccctaggaaacatggaaacaaaagagagcaaagccatccgccaacacgccgaagcagccggatgctccatgatagaagacatagaaagcccctcatcaatctgggtattcgccggcgcccccggcagatgcccacccacatgcctcttcatcgcaggaatagcagaactgggagccttcttctccatcctccaggacatgagaaacaccatcatggcctccaaaacagtaggcacgtccgaagaaaaactacgaaagaaaagctccttctaccagtcctacctccgccgcacccaatccatgggaatccaactcgaccaacgaatcatagtcctgttcatggtcgcatggggcaaagaagcagtcgacaacttccacctcggcgacgacatggaccccgaactgcgcacactagcccaatcactaatcgacgtcaaagtaaaagaaatctccaaccaagaaccactcaaactctaa

SEQ ID NO: 7808 - RNA, 1290 nt, synthetic construct
  misc_feature 1..1290: note = derived and/or modified CDS sequence (opt11) from HTNV(SN7)__AF288657.1__N
  source 1..1290: mol_type = other RNA
atggccaccatggaagaactccaacgagaaatcaacgcccacgaaggccagctcgtcatagcccgccaaaaagtccgagacgccgaaaaacagtacgaaaaagaccccgacgaactcaacaaacgtacccttaccgaccgcgaaggcgtcgccgcctcaatacaagcaaaaatcgacgaactcaaacgccaactcgcggaccgcatcgcaaccggcaaaaacctcggaaaagaacaagaccccacaggcgtcgaacccggcgaccacctcaaagaacgcagcatgctatcctacggaaacgtcctcgacctaaatcacctcgacatcgacgaacccacaggacaaaccgccgattggctaagcatcgtcatctacctcacctcattcgtagtccccatattactcaaagctctctacatgctaaccacacgcggtcgccaaaccacaaaagacaacaaaggcacacgcatccgcttcaaagacgactcctcattcgaagacgtcaatggtatccgcaaacccaaacacctctacgtctccctacccaacgcacaatcatccatgaaaaccgaagaaatcacccccggccgctaccgaacagctatctgcggcctctaccccgcacaaatcaaagcccgacaaatgataagccccgtaatgtccgtaatagggttcctagccctcgccaaagactggtcagaccgaatcgaacaatggctctccgaaccctgcaaactcctacccgataccgccgcagtatccctccacggcggccccgccacaaaccgagactacctccgccaacgacaagtagcactcggcaacatggaaaccaaagaatccaaagccatccgacaacacgcagaatcagctggttgctcaatgatagaggacatcgaatcaccctcaagcatctgggtattcgctggagcccccgaccgatgcccaccaacctgcctattcatagccggaatagcagaactcggcgccttcttctcaatcctccaagacatgcgaaacactatcatggcctccaaaacagtcggcacctccgaagaaaaactccgaaagaaatcatccttctaccaatcctacctccgccgcacccaatccatgggcatccaactcgaccaacgaatcatagtactcttcatggtggcctggggcaaagaagccgtcgacaacttccacctcggagacgacatggaccccgaactaagaacactagctcaatccctcatcgacgtaaaagttaaagaaatcagtaaccaagaacccctcaaactctaa

SEQ ID NO: 7809 - RNA, 1290 nt, synthetic construct
  misc_feature 1..1290: note = derived and/or modified CDS sequence (opt11) from HTNV(84FLi)__AF366568.1__N
  source 1..1290: mol_type = other RNA
atggccaccatggaagaactacaacgagaaatcaacgcccacgaagggcagctagtaatcgcccgacaaaaagtccgcgacgccgaaaaacaatacgaaaaagaccccgacgaactaaacaaaagaacactaactgaccgcgaaggcgtcgcagcctccatccaagccaaaatagacgaacttaaaagacaactcgccgaccgcatagccaccggcaaaaacctcggcaaagaacaagacccaaccggagtagaacccggagaccacctaaaagaaagatccatgctctcatatggcaacgtacttgacctcaaccatctagacatcgacgaacccaccggccaaaccgccgactggctttccatcgtcatctacctaacatccttcgtcgtcccaatactactaaaagccctatacatgctcaccacccgcggccgccaaacaaccaaagacaacaaaggcacccgcataagattcaaagacgactcctccttcgaagacgtcaacggtatccgcaaaccaaaacacctatacgtatcactccccaacgcccaaagctcaatgaaagccgaagaaatcacaccaggaagataccgcaccgcaatctgcggcctctaccccgcacaaatcaaagcacgccaaatgataagccccgtaatgtccgtcatcggcttcctagccctcgccaaagactggtctgaccgaatagaacaatggctctccgaaccctgcaaactcctacccgacaccgccgccgtatccctccacggcggccccgcgaccaaccgagactacctacgccaaagacaggtcgcgctcggcaacatggagacaaaagaatccaaagccatccgccaacacgccgaatctgcaggctgctcaatgatcgaagacatagaatccccatccagcatctgggtattcgctggagcacccaaccgatgccctcccacgtgcctattcatcgccggcatcgccgaactaggagccttcttctccatcctacaagacatgcgcaacaccatcatggcatctaaaacagtcggcacctctgaagaaaaacttagaaagaaaagctccttctaccaatcttaccttcgccgaacccagagcatgggaatacaactagaccaacgaatcatagtcctattcatggtagcctggggcaaagaagccgtcgacaacttccacctgggcgacgacatggaccccgaactacgcaccctcgcccaaagcctcatcgacgtcaaagtaaaagagatctccaaccaagaaccgctaaaactctag

SEQ ID NO: 7810 - RNA, 1290 nt, synthetic construct
  misc_feature 1..1290: note = derived and/or modified CDS sequence (opt11) from HTNV(KHF,clone:4)__LC209206.1__N
  source 1..1290: mol_type = other RNA
atggcaaccatggaggaactccagcgcgaaataaatgcacacgaaggacaactcgtcatagccagacaaaaagtccgggacgcagaaaaacaatacgaaaaagacccagacgaactaaacaaacgaacactgaccgaccgagaaggcgtagccgtaagcatacaagcaaaaatagacgagctaaaacgacagctagccgaccggatcgcaaccggcaaaaacctcggcaaagaacaagaccccaccggcgtcgaaccgggggaccacttaaaagaaagatcaatgctatcctacggcaacgtcctcgacctaaaccacctcgacatcgacgaaccaaccggacaaaccgcggattggctatcaatagtcgtatacctgacatcattcgtcgtccccatactactcaaggccctctacatgctcacaacccgcggccgacaaacaaccaaggacaacaaagggaccagaatcagattcaaggacgactcatcattcgaggacgtaaacggaatccgcaaaccaaagcacctatacgtcagcctccccaacgcccaatccagcatgaaagcggaagaaataacgcccggccgataccgcacagcagtatgcgggctctaccccgcacaaataaaagcccgtcaaatgatcagcccagtaatgagcgtaatcggattcctcgccctagccaaggactggagcgaccgaatagaacaatggctgagcgaaccctgcaagctactcccagacacagcagcagtctcgctcctaggcgggcccgcaaccaacagagactacctacgccagcgccaagtcgcgctaggaaacatggaaacaaaagaaagcaaagccatcagacaacacgcagaagcagccggctgctcaatgatagaagacatcgaaagcccatcatccatctgggtcttcgccggcgccccagaccgctgtccgccaacatgcctcttcatagcagggatcgcagaactcggcgccttcttctcaatactccaagacatgcgaaacaccatcatggcaagtaaaaccgtcggcacctcagaagaaaaactccgcaagaaaagctcattctaccaatcatacctacgcagaacccagagcatgggcatacagctagaccagcgcatcatagtgctattcatggtcgcctggggcaaagaagcagtagacaacttccacctaggcgacgacatggacccagaactccgcaccctcgcacagtcactcatagacgtaaaagtcaaagaaatctcaaaccaagaacccctcaaactctaa

SEQ ID NO: 7811 - RNA, 1287 nt, synthetic construct
  misc_feature 1..1287: note = derived and/or modified CDS sequence (opt11) from LANV(510B)__AF005727.1__N
  source 1..1287: mol_type = other RNA
atgagtaatctacaagaagtccaagaaggaatcaccctccacgaacaacaactcgtagccgcacgccaaaaactcaaggacgcagaaaaggccgtagaagtcgacccagacgatgtaaacaaaagcaccctccaaagccgcagagccgccgtctcagccctcgaaaacaaactcgccgaactcaaacgccaactcgcggacctcgtcgccgcacaaaaactcgcagccaaaccagtcgaccccaccggcctagaacccgacgaccacttaaaagaaaaatccgccctacgctacggcaacgttctcgacgtaaacgccatagacttagaagaaccatcgggccaaaccgcagactggaaagccatcggcgcctacatactcggattcgtaatccccataatcctcaaagcactctacatgctcagcacacgcggaagacaaacagtcaaagaaaacaaaggcacacgcatccgcttcaaagacgactcctccttcgaagaagtcaacggaatccgaaaacccaaacacctatacgtctccatgcccaccgctcaaagcacaatgaaagccgacgaaattaccccaggccgcttcaggaccatcgcctgcggcctattccccgcccaaataaaagcccgaaacataatctcccccgtaatgggcgtcatcggcttcggacacttcgtgaaggactggatggaacgcatcgacaacttcctcggagaagactgccccttcctcccaaaagcacgcgtacaatccgaggcattcatgagcaccaacagagcctacttcctaaaccgccaacgccaagtcgacgaatcccgcatccaagacatcgtcgacctcatacaagccgcagaagcaagcagcgccaccctcttcaacgacatcgcaactccccactccgcctgggtcttcgcctgcgccccagaccgctgcccacccaccgccctatacgtagctggagtccccgaactcggagcattcttcgccatactccaagacatgagaaacaccatcatggcttccaaaagcgtcggcacagccgaagaaaaactcaaaaagaaatctgcattctaccaatcatacctacgaagaacccaatccatgggaatacaactagaccagaaaataataatactctatatgctctcctggggcaaagaagccgtcaatcacttccacctcggcgacgacatggacccagaactccgccaactagcccaaaccctaatagacgccaaagtaaaagaaatcagcaaccaagaacccctcaaactataa

SEQ ID NO: 7812 - RNA, 1287 nt, synthetic construct
  misc_feature 1..1287: note = derived and/or modified CDS sequence (opt11) from LANV(12234)__ALD61435.1__N
  source 1..1287: mol_type = other RNA
atgtccacactccaagaagtccaagaaggcataaccctacacgaacaacaactggtagccgcccgacaaaaactgaaagacgccgaaaaagcagtcgaagtcgatcccgacgacgtgaacaaatccaccctacaatcaagacgagccgccgtttcggcactcgaaaacaaactcgcagaactcaaacgacaactcgcagacctcgtcgccgcccaaaaactcgccgcaaaaccagtagaccccaccggcctcgaaccagacgaccacctaaaagaaaaatccgccctacgctacggaaacgtcctcgacgtcaacgctatagacctagaagaaccctccggccaaaccgccgactggaaagcaatcggagcctacatactaggattcgtcatcccaatcatcctcaaagccctctacatgctttccacccgcggccgacaaaccgtcaaagaaaacaaaggaacccgcatacggttcaaagacgactcctccttcgaagaagtcaacgggatccgcaaacccaaacaactatacgtctccatgccaaccgcccaatccaccatgaaagcagatgaaatcaccccgggcagattccgaaccatcgcctgcggcctgttccccgcccaaatcaaagccagaaacatcataagtccagtcatgggagtcataggtttcagccacttcgtcaaggactggatggaacggatcgacgacttcctcgccgcagactgcccattcctacccaaaccacgcgtacaatccgaagccttcatggcaaccaaccgagcctacttcatcaaccgccaacgccaaatcgacgaaagccgcatgcccgacatcatggacctcatacaggccgccgaagccggatcagcaacactcttcaacgacatagccaccccacactcagcatgggtcttcgcctgcgcccccgacagatgccctccaaccgctctctacgtcgcaggagtacccgaactcggcgctttcttcgccatcctacaagacatgcgcaacaccatcatggcctcaaaatccgtcggcacagccgaagagaaactaaagaagaaatccgcattctaccaatcctacctcagacgaacccaaagcatgggcatccaactcgaccagaaaatcatcatactatacatgctcagctggggcaaagaagccgtaaaccacttccacctcggggacgacatggaccccgaactccgccaactcgcccaaaccctcatcgacaccaaagtaaaagaaatcagcaaccaagaaccactcaaactctaa

SEQ ID NO: 7813 - RNA, 1272 nt, synthetic construct
  misc_feature 1..1272: note = derived and/or modified CDS sequence (opt11) from LQUV(Longquan-Rs-32)__JX465422.1__N
  source 1..1272: mol_type = other RNA
atggcaaccgggcgagacctccaagacgaactcgaacaaatcgaacaagaaatcacccaagcaaaagccaagtacgaaaaacagaaagccgctataggcgaagaacccgacacaatcgaactcaaagtactccaacaaagagaagaaacaatccatatgctcgaagaaaaacgcaaagaactactacaacgcatcgcccaacaaatgaaatcaccccgccaacccgtcaaaggaagagacctagacgaagacgaacaccttagcgaaagaagcaccctccgctacggcaacgtcatcgacctcgaagaactcgacatcgacgaaccagcaggcggcagcgctgactggctagctatcggaatatacatattctccttccccgtacaactactgctcaagacactgtatatactcaccacacgggggcgacaaaccatcaaagaaaacaagggcaaccgcctacgcttcaaagacagcagcagcacaatggacgtcaacggcgtcaagaccccacgccacctctacatcagcctcccaaccgcccaatcctccatgaagacagaagaaatcacacccggacgctaccgcaccgtcgcatgcggaatcctcagcggcgaaatgagggcccgcaaactggtctccccagtcatgggcgttatcggcttcaactacctcgccgaaaaatggggcgaatacatcgacgccttccttatgaaacaaagcccacacctaccagtcagcacagggtcacccgaatccgccaccaacttcgcctacctcatccaacgccaagacgtcctaaacaaatccaaaacagtcgaatacctagaactatgggaacaagccgaaaaagccggccgccacctagtcgaccgcatcgaatcacccctcaccccctggctattcgcaggctcccccgaccgatgcccacccaccagcctctacgtcgccggcatcgccgaactcggcgccttcttcagcatcctccaagacatccgcaacgcgatcatggcttccaaactcgtcggcaccgccgaagaaaaactcaaacgaaaatccagcttctaccaatcatacctccgccgaacccaatccatgggggtccagctagaccaacgcatcatcatactctacatgatggaatggggcaaaatgatggtagaccacttccacctcggagacgacatggactcagaactccgaaaggcctgccaaagcctaatcgacgaaaaagtcgcccaagtctccaaccaagaagcactcaaactataa

SEQ ID NO: 7814 - RNA, 1272 nt, synthetic construct
  misc_feature 1..1272: note = derived and/or modified CDS sequence (opt11) from LQUV(Longquan-Ra-14)__JX465414.1__N
  source 1..1272: mol_type = other RNA
atggccaccggccgcgacctccaagacgaattagaacaaatagaacaagaaataacccaagccaaagcaaagtacgaaaaacaaaaggcagcaatcggagaagaacacgacaccatagaactaaaagtactccaacaaagagaagaaaccatccacatgctcgaagaaaaacgcaaagaactactacaacgcatcgcacaacaaatgaaaagcccccgacaaccagtcaagggcagagacctggacgaagacgaacacctatccgaacgctcaaccctccgctacggcaacgtaatcgacctagaagaactcgacatcgacgaacccgccggcggctcggccgactggctagccattggcatctacatcttctccttccccgtccaactactactcaagaccctctacatcctcaccacacgcggccgccaaaccatcaaagaaaacaagggaaaccgactacgattcaaagactcgagctccacaatggacgtaaacggcgtcaagaccccaagacacctctacatatcactccccacagcccaatcatccatgaaaacagaagaaatcacccccggccgctaccgcaccgtcgcctgcggcatcctcagcggagaaatgcgcgcccgaaaactcgtaagccccgtcatgggcgtaatcggcttcaactacctagccgaaaaatggggagaatacatagacgccttcctcatgaaacaatccccacacctccccgtctcaaccggctcccccgaatccgcaaccaacttcgcctacctcatccaacgccaagacgtactaaacaaatccaaaacagtcgaatacctagagctctgggaacaagccgaaaaagccggccgccacctagtagaccgcatcgagagcccacttacaccctggctgttcgccggctctccagaccggtgcccacccacctcactatacgtcgcaggcatcgccgaactcggggccttcttcagcatcttacaagacatccgcaacgccataatggcctccaaactcgtcggaacagccgaagagaagctgaaacgaaaatcctcattctaccaatcctacctccgccgaacccaatcaatgggcgtccagctcgaccaacgcataatcatactctacatgatggaatggggaaaaatgatggtcgaccacttccacctcggggacgacatggacagcgaactccgtaaagcgtgccaatccctcatcgacgaaaaagtcgcccaagtatcaaaccaagaagccctcaaactataa

SEQ ID NO: 7815 - RNA, 1272 nt, synthetic construct
  misc_feature 1..1272: note = derived and/or modified CDS sequence (opt11) from LQUV(Longquan-Ra-25)__JX465415.1__N
  source 1..1272: mol_type = other RNA
atggcaaccggacgcgacctacaagacgaactagagcaaatcgaacaagaaataacccaggccaaagccaaatacgaaaaacaaaaagccgccataggagaagaacccgacacaatcgaactcaaagtactccaacaaagagaagaaacaatccacatgctagaagaaaaacgcaaggaactcctacaacgcatcgcccaacaaatgaaaagccccaaacaacccgtcaaaggaagggacctcgacgaggacgaacacctatccgaacgcagcaccctacgatacggcaacgtcatcgacctcgaagaactcgacatcgacgaacccgccggaggctccgccgactggctagccatcggcatctacatcttcagcttccccgtccaactcctactcaaaacactatatatcctcaccacaagaggccgccaaaccatcaaagaaaacaaaggcaaccgcctccgcttcaaagacagcagctcaaccatggacgtaaacggcgttaaaaccccacgacacctatacataagcctgcctaccgcccaaagctcgatgaaaacagaagaaatcacacccggccggtacagaaccgtagcctgcggaatcctctcaggagaaatgcgcgcccgaaaacttgtcagccccgtcatgggcgtaatcggattcaactaccttgccgaaaaatggggcgaatacatcgacgccttcctcatgaaacaaagcccacacctacccgtcagcaccggtagccccgaaagcgcaaccaacttcgcctacctcatccaacgccaggacgtcctaaacaaaagcaaaactgtagaatacctcgaactgtgggaacaagccgaaaaagccggccgccacctcgtggaccgcatcgaatccccactcaccccctggcttttcgccgggagcccggaccgatgcccacccacaagcctatacgtagccggcatagccgaactcggcgccttcttctccatcctacaggacatccgcaacgccataatggccagcaaactggtgggaacagccgaagaaaagctaaaacgaaaaagctccttctaccaatcctacctacgtcgcacccagagcatgggcatacaactagaccaaagaatcataatcctctacatgatggaatggggcaaaatgatggtcgaccacttccacctaggagacgacatggactcagaactccgcaaggcttgccaatcactcatagacgaaaaagtagcccaagtatccaaccaagaagcactaaaactctaa

SEQ ID NO: 7816 - RNA, 1287 nt, synthetic construct; identical to SEQ ID NO: 6432
  misc_feature 1..1287: note = derived and/or modified CDS sequence (opt11) from NYV(RI-1)__U09488.1__N
  source 1..1287: mol_type = other RNA

SEQ ID NO: 7817 - RNA, 1302 nt, synthetic construct
  misc_feature 1..1302: note = derived and/or modified CDS sequence (opt11) from PUUV(K27)__L08804.1__N
  source 1..1302: mol_type = other RNA
atgtccgacctcaccgacatccaagaagaaatcacccgccacgaacagcaactggtagtcgcccgacaaaagctcaaagacgccgaacgcgccgtcgaagtataccccgacgacgtcatcaaaaatacactacaagccagacagcaaacagtcagcgccctcgaagacaaactagccgactacaaaagacgcatggccgacgcagtctcacgcaagaaaatggacaccaaacccacagacccaaccggaatagaacccgacgaccacctaaaagaacgatcctccctccgctacggtaacgtactcgacgtcaacgccatcgacatcgaagaaccatccggccaaactgccgactggtacacaatcggcgtctacgtcataggcttcaccatccccatcatcctaaaagccctatacatgctctcaacccggggccggcaaacagtcaaagaaaacaaaggcacccggatccgcttcaaagacgacacctccttcgaagacattaatggcatccgccgcccaaaacacttatacgtatccatgccaaccgcacaatcaacaatgaaagcagaagaactcaccccaggacgcttccgcaccatcgtctgcggcctcttccccacacaaatccaagtccgcaacatcatgtcccccgtcatgggagtcatcggattctccttcttcgtcaaagactggcccgaaaagatacgcgagttcatggaaaaagaatgccccttcatcaaacccgaagtcaaacccggcacccccgcccaagaagtcgagttcctcaaacgcaaccgcgtctacttcatgacccgacaagacgtcctcgacaaaaaccacgtagccgacatcgacaaactgatcgactacgctgcctctggcgaccccacctcacccgacgacataaaaagccccaacgcaccatgggtcttcgcatgcgccccagaccgatccccacccacttgcatatacgtagccggcatggccgaactcggcgccttcttcagcatcctccaagacatgcgtaacacaataatggcctccaagaccgtcggcaccgccgaagaaaagctaaaacgtaaatcatcgttctaccaatcctacctaagacgcacacaatccatgggcatacaactagaccaacgcatcatcctcctatacatgctcgaatggggaaaagaaatggtcgaccatttccacctaggcgacgacatggatcccgaactgcgcggactcgcccaaagcctcatcgaccagaaagtcaaagaaatctccaaccaagaacccctaaaaatctaa

SEQ ID NO: 7818 - RNA, 1302 nt, synthetic construct
  misc_feature 1..1302: note = derived and/or modified CDS sequence (opt11) from PUUV(KS13/855)__KX815394.1__N
  source 1..1302: mol_type = other RNA
atgtccgacctaacagacatacaggaagacataacacgccacgaacaacaactggtagtcgccaggcaaaaactcaaagacgccgaaaaagcagtcgaaatggaccccgacgacgtcaacaagaacaccctacaagcccgccagcaaacggtcagcgccctggaagacaaactcgccgacttcaaacgccgtatggccgacgcagtctcacgcaaaaaaatggacacaaaacctacagaccccaccggcatcgagcccgacgaccacctcaaagaacgcagcagcctccgctacggcaacgtactggacgtcaacgccatcgacatcgaagaacccagcggccaaaccgccgactggtacaccataggcgtctacgtaatcggattcaccctacctatcatcctcaaggccctatacatgctatctacccgaggacgccaaaccgtcaaagaaaacaaaggaacacgcatccgcttcaaagacgacacctcattcgaagacatcaacggcataaggcgccccaaacacctctacgtctcaatgccaaccgcacaatcaacaatgaaagcggaagagctcacaccaggacgtttccgcaccatcgtctgcggcctctttcccacccaaatccaagtccgcaacatcatgagccccgtcatgggagtcatcggcttttcgttcttcgtcaaagactgggccgagcgaatacgagaattcatggaaaaagaatgcccattcatcaaacccgaggtcaaacccgggacaccggcccaagaagtggaattcctaaaaaaaaacaaagtatactttatgcaacgacaggacgtgctcgacaaaaaccacgtcgccgacatcgacaaactaatagactacgccgcctcaggcgacccaaccagcccggacaacatcgaaagcccaaacgcaccatgggtcttcgcctgcgcccccgacagatgcccacccacctgcatctacgtagcgggcatggccgaactcggcgccttcttctcaatcctacaagacatgcgaaacaccatcatggcctccaaaacagtcggcaccgccgaagaaaaactcaaaaaaaaaagctcattctaccaatcctacctccgcagaacccaaagcatgggcatccagctcgaccaacgcatcatcctactatacatgctagaatggggcaaagaaatggtcgaccacttccacctcggcgacgacatggacccagaactgcgcggactagcacaagcactcatcgaccaaaaagtcaaagaaatatcaaaccaggaacccctaaaaatataa

SEQ ID NO: 7819 - RNA, 1302 nt, synthetic construct
  misc_feature 1..1302: note = derived and/or modified CDS sequence (opt11) from PUUV(KS14/118)__KX815395.1__N
  source 1..1302: mol_type = other RNA
atgtccgacctaaccgacatccaagaagacatcacccgccacgaacaacagctagtcgtagcccgacaaaaactcaaagacgcagaacgcgccgtagaagtagatccagacgacgtaaacaaaaacaccctacaagctcgacaacaaaccgtctccgccctggaagacaaactagccgacttcaaacgccggatggccgacgcagtctcacgcaagaaaatggacacaaaaccaacagaccccacaggcatcgaacccgacgaccacctcaaagaacgcagctcactccgatacggcaacgtcctcgacgtcaacgccatcgacatagaagaaccctccggacagacagccgactggtacaccatcggcgtttatgtcatcggattcacaatccccatcatcctcaaagccctctacatgctctcaacacgcggacgccaaaccgtgaaagaaaacaaaggcacccgaatcaggttcaaagacgacacatccttcgaagatatcaacggcatccgccgcccaaaacatctctacgtatcaatgccaaccgcacaatccacaatgaaagccgaagaactaaccccaggccgcttccgaacaatagtctgcggcctcttcccaacccaaattcaagtccgcaacatcatgtcacccgtaatgggagtcatcggcttctccttcttcgtcaaaaactggccagaacgcataaaagagttcatggaaaaagaatgccctttcatcaaacccgaagtcaaacccggcaccccagcccaagaagtagagttcctaaaacgcaacaaagtatacttcatgaaccgccaagacgttctagacaaaaaccacgtagccgacatcgacaaactcatcgattacgcagcctccggcgaccccacctcaccagacgacatcgaatccccgaacgccccatgggtcttcgcctgcgccccagaccgatgcccaccaacctgcatatacgtcgccggcatggcagaactaggagccttcttcagtatactccaagacatgcgcaacaccatcatggcctctaaaaccgtcggcacagccgaagaaaaactaaagaaaaagagctcgttctaccaatcctacctccgccgcacccagtccatgggcatccaactagaccaacgaatcatcctcctctatatgctcgaatggggcaaagaaatggtcgaccactttcacctcggcgacgacatggaccccgaactaagaggactcgcacaggcgctaatagaccaaaaagtgaaagaaatatccaaccaagaacccctcaaaatttaa

SEQ ID NO: 7820 - RNA, 1302 nt, synthetic construct
  misc_feature 1..1302: note = derived and/or modified CDS sequence (opt11) from PUUV(LT15/201)__KX757841.1__N
  source 1..1302: mol_type = other RNA
atgagcgacctcaccgacatccaagaagacatcacccgacacgaacaacaactcgtagtcgctcgacagaaactcaaagacgcagaaaaagcagtcgaaatggaccccgacgacgtaaacaaaaacacactccaagccagacaacagaccgtcagcgccctagaagacaagctagcagacttcaaacgccggatggccgacgcagtaagccgcaagaaaatggacacaaaaccaatcgaccccaccggaatcgaacccgacgaccacctaaaagaacgcagctcactaagatacggaaacgtgctagacgtcaacgcaatagacatagaagaaccatccggccaaaccgcagactggtacaccataggcgtctacgtcatcggcttcacacttcccatcatccttaaagccctctacatgctcagcacccgaggacgacaaaccgtcaaagaaaacaaaggcacacgaatccgattcaaagacgacaccagtttcgaagacatcaacggaatacgccgaccaaaacacctctacgtctccatgcccaccgcccaaagcaccatgaaagccgaagaactaacccccggacgattccgtaccatcgtctgcggcctattccccacccaaatacaagtccgaaacataatgagcccagtcatgggcgtcatcggattctcattcttcgtcaaagactgggccgaacgcatccgggagttcatggaaaaagagtgccccttcatcaaacccgaagtaaagccaggcacccccgcccaagaagtcgaatttctcaagaaaaacaaagtatacttcatgcaaagacaagacgtcctggacaaaaaccacgtcgcggacatcgacaaactcatcgactacgcagccagcggagaccccacctcccccgacaacatagaaagccccaacgcaccctgggtattcgcatgcgcccccgaccgctgcccacccacatgcatctacgtagccggaatggccgaactaggcgcattcttctcaatcctgcaagacatgcggaacaccatcatggcctccaaaacggtaggcaccgccgaagaaaaactcaaaaagaaaagcagcttctaccaatcctacctacgccgcacccaatcaatgggaatccaactcgaccaacgaatcatactcctgtacatgctcgaatggggaaaagaaatggtcgaccacttccacctaggcgacgacatggacccagaactacgcggcctcgcacaagccctaattgaccagaaagtcaaagaaataagcaaccaagaaccactcaaaatataa

SEQ ID NO: 7821 - RNA, 1302 nt, synthetic construct
  misc_feature 1..1302: note = derived and/or modified CDS sequence (opt11) from PUUV(PUU/Ernstbrunn/Cg641/1995)__AJ888752.1__N
  source 1..1302: mol_type = other RNA
atgagcgacctaacagatatacaggaggacatcacacgacacgaacaacaactcgtcgtagcacgccaaaaactaaaagacgcagaaaaggcagtagaaatggaccccgacgacgtaaacaaaaacacccttcaagcccggcaacaaaccgtctccgccctcgaagacaaactagcagacttcaaacgacgaatggccgacgcagtctcccgcaagaaaatggacacaaaacccacagaccccacaggcatcgaacccgacgaccacctaaaagagcgctcatccctacgatacggaaacgtactcgacgtcaacgccatcgacatcgaagaaccctccggccaaaccgccgactggtacaccatcggcgtgtacgtcatcggcttcacactacccatcatcctaaaagccttgtacatgctctcaacgagaggccgacaaacagtcaaagaaaacaaaggcacccgaatccgattcaaagacgacaccagcttcgaagacatcaacggcatcaagcgccccaaacacctctacgtctccatgcccaccgcccaatctacaatgaaagccgaaaagctaacccccggacgattccgaacaatcgtctgcggactattcccaacccaaatccaagtgagaaacatcatgtcccccgtcatgggcgtcatcggcttctccttcttcgtaaaagactggtcagaacgagtacgcgacttcatggaaaaagaatgcccctttatcaagcccgaaatcaagcccggcacccctccccaagaagcggagttcctaaaacgcaacaaagtctacttcatgcaacgacaagacgtcctagacaagaaccacgtcgcagacatcgacaaactcatcgactacgcagcatcaggagaccccacctcccccgacaacctcgaatcccccaacgcaccctgggtcttcgcatgtgcccccgaccgctgcccacccacatgcatatacgtcgccggaatggccgaactgggcgcattcttctccatcctccaagacatgcgcaacacaatcatggcatccaaaaccgtcggaacagccgaagaaaaactcaaaaagaaaagcagcttctaccaatcatacctgcgccgaacccaatccatgggcatccaactcgaccaacgaatcatcctactctacatgttagaatggggcaaagaaatggtcgaccacttccacctgggcgacgacatggaccccgaactacgaggactcgcccaagccctcatcgaccaaaaagtcaaagaaataagcaaccaagaacccctaaaaatctaa

SEQ ID NO: 7822 - RNA, 1302 nt, synthetic construct
  misc_feature 1..1302: note = derived and/or modified CDS sequence (opt11) from PUUV(PUU/Klippitztoerl/Cg9/1995)__AJ888751.1__N
  source 1..1302: mol_type = other RNA
atgtcagacctcaccgacatacaagaagacataacccgccacgaacaacaactcgtcgtagcccgccaaaaactcaaagatgccgagaaagccgtcgaaatggaccccgacgacgtcaacaaaaacaccctccaggcacgacaacagacagtctccgccctagaagacaaactcgccgacttcaaacgccgaatggccgacgccgtcagccgcaagaaaatggacaccaaacccaccgacccaaccggcatcgaacccgacgaccacctaaaagaacgctcctccctaagatacggaaacgtcctcgacgttaacgccattgacatcgaagaacctggcggacaaaccgccgattggtacacaataggcgtctacgtgatcggcttcaccctcccaataatcctaaaagccctctacatgttcagcacccgcggacgacaaacagtcaaagaaaacaaaggcacccgcatccgattcaaagacgacacctccttcgaagacatcaacggaatccgccgccccaaacacctgtacgtcagcatgcccacagcccaaagcacaatgaaagccgaagaactcacaccaggccgcttccgcaccattgtctgcggcctcttccccacccaaatccaagtccgaaatatcatgagccccgtcatgggcgtcatcggcttcagcttcttcgtcaaagactggtccgaacgagtccgcgacttcatggaaaaagaatgccccttcatcaaacccgagatcaaacccggcaccccaccccaagaagccgagttccttaaacgcaacaaagtatacttcatgcaacggcaggacgtactagacaaaaaccacgtcgcggacatagacaaactcatcgactacgccgcctcaggcgaccccacctccccagacaacctcgaatcacccaacgcaccatgggtcttcgcctgcgctcccgaccgatgcccaccaacctgcatatacgtagccggaatggcagaactcggcgcatttttctcaatcctacaggacatgagaaacacaatcatggccagcaaaaccgtcggaacagccgaagaaaaactcaaaaagaaatcctccttctaccaatcataccttcggcgcacccaaagcatgggcatccaactggaccaaagaatcatactcctatacatgctggaatggggcaaagaaatggtcgaccacttccacctcggtgacgacatggaccccgaactccgcggcctagcccaagccctcatcgaccaaaaagtcaaagaaatcagcaaccaagaacccctcaagatctaa

SEQ ID NO: 7823 - RNA, 1302 nt, synthetic construct
  misc_feature 1..1302: note = derived and/or modified CDS sequence (opt11) from PUUV(Balkan-1)__AJ314600.1__N
  source 1..1302: mol_type = other RNA
atgtcagacctcaccgacatccaagaagacataacccgccacgaacaacaactcgtcgtggcacgccaaaaactcaaagacgccgaaaaagccgtcgaaatggaccccgacgacgtcaacaaaaacaccctccaagcccgccaacaaaccgtctccgccctcgaagacaaactcgccgacttcaaacgaaggatggccgacgctgtatcccgcaagaaaatggacaccaaacccaccgacccaacaggcatagaacccgacgaccacctgaaagaacgatcctccctacgatacggcaacgtcctcgacgtgaacgccatagacatcgaagaacccagcggccagaccgccgactggtacaccataggagtctacgtcatcggcttcacactccccataattctaaaagccctctacatgctctcgacacgaggccgccaaacagtaaaagaaaacaaaggcacccggatccgcttcaaagacgacacctctttcgaagacatcaacggcatccgcagacccaaacacctctacgtatcgatgcccacagcacaatcaacaatgaaagccgaagaactcacccccggacgcttccgcacaatcgtctgcggccttttccccacccaaatccaagtccgcaacatcatgtccccggtaatgggcgtaatcggcttctccttcttcgttaaagactggtccgaacgagtccgagaatttatggaaaaagaatgccccttcataaaacccgaaatcaaacccggcaccccaccccaagaagcagagttcctaaaacgcaacaaagtctacttcatgcaacgccaggacgtcctcgacaaaaaccacgtagccgacatcgacaaactactcgactacgccgcctccggcgaccccacctcacacgacaatatcgaaagccccaacgcaccctgggtcttcgcatgcgcacccgaccgctgcccgcccacatgcatatacgtcgccggcatggcagaactaggcgcgttcttctccatccttcaggacatgcgcaacaccatcatggcctccaaaacagtcggaacagcagaagaaaaactgaaaaagaaaagctccttctaccaatcgtacctccgccgcacccaaagtatgggcatacaactcgaccaacgaataatactgctatacatgctcgaatggggcaaagaaatggtcgaccacttccacctgggagacgacatggaccccgaactgcgaggcctcgcgcaagcactcatcgaccagaaagtcaaagaaatctccaaccaagaacccctcaaaatctga

SEQ ID NO: 7824 - RNA, 1302 nt, synthetic construct
  misc_feature 1..1302: note = derived and/or modified CDS sequence (opt11) from PUUV(Balkan-2)__AJ314601.1__N
  source 1..1302: mol_type = other RNA
atgagcgacctaacagacatccaagaagacatcacacgccacgaacaacagctagtcgtggcccgccaaaaactaaaagacgccgaaaaagcggtagaaatggaccccgacgacgtcaacaaaaacacccttcaagcacgccagcaaacagtctccgccctcgaagacaaactcgccgacttcaaacgcaggatggcagacgcagtctcccgaaagaaaatggacacaaaaccgaccgaccccacaggcatagaacccgacgaccacctaaaagaacgatcatccctccgatacggcaacgtcctcgacgtcaacgccatcgacatcgaagaaccctccggccaaaccgccgactggtacaccatcggcgtctacgtcatcggcttcactctccccataatcctaaaagccctctacatgctctccacccgtggccgacaaaccgtcaaagaaaacaaaggaaccagaatccgtttcaaagacgacacctcattcgaagacatcaacggcatccgcagaccaaaacacctctacgtctcaatgcccaccgcccagtcgaccatgaaagcagaagaactaaccccaggccgcttccgcaccatcgtattcggcctattccccacacaaatccaagtacgaaacatcatgtcacccgtaatgggcgtcataggtttctcattcttcgtaaaagactggtcagaacgcgtccgcgagttcatggaaaaagaatgcccattcatcaaacccgaaatcaaacccggcgccccaccccaagaagccgagttcctcaaacgcaacaaggtctacttcatgcaaagacaagacgtcctagacaaaaaccatgtggccgacatcgacaaactcatcgactacgccgcctcaggagaccccacatcccccgacaacattgaatccccaaacgcgccctgggtcttcgcctgcgccccagaccgctgcccacccacatgcatctatgtcgccgggatggcagaactcggcgcattcttcagcatcctgcaagacatgcgaaacacaatcatggcctcaaaaacagtcggcaccgccgaagaaaaactaaagaagaaatccagcttctaccaatcatacctccgacgcacccaatccatgggaatccaactcgaccaacgcatcattctcctttacatgctggaatggggcaaagaaatggtcgaccacttccacctcggagacgacatggaccccgaactccgcggactagcccaagccctcatcgaccaaaaagtaaaagaaatctcaaaccaggaacccctaaaaatataa

SEQ ID NO: 7825 - RNA, 1302 nt, synthetic construct
  misc_feature 1..1302: note = derived and/or modified CDS sequence (opt11) from PUUV(Baltic/205Cg/00)__AJ314599.1__N
  source 1..1302: mol_type = other RNA
atgtcagacctggcagacatacaagaagacatcacacgtcacgaacaacaactcgtcgtcgcacgacaaaaactcaaagacgccgaacgcgcagtcgaagtcgacccggatgacgtcaacaaaaacaccctccaagccaggcaacaaaccgtctcagccctcgaagacaagctcgccgactacaaacgacgcatggcagacgccgtctcccgaaagaaaatggacactaaacccaccgaccccaccggaatagaacccgacgaccacctcaaagagcgctcatcactcagatacggaaacgtcctggacgtcaacgcaatcgacatagaagaaccctcaggacaaaccgcagactggtacacaatcggagtctacgtaataggattcaccctcccaatcatactcaaagccctgtacatgctctccacccgcggacgacaaaccgtcaaagaaaacaaaggcaccagaatcagattcaaagacgacacctccttcgaagacatcaacggcatcagacgaccaaaacacctctacgtctccatgccgaccgcccaatcaacaatgaaagcagaagaactcacccccggccgattccgcaccatcgtatgcggactattcccgacacaaatccaagtccgcaacatcatgtcacccgtgatgggcgtaatcggcttctccttcttcgttaaagactggcccgaacgcataaaagagttcatggaaaaagaatgccccttcatcaaaccagaagtcaaacccggaacccccacccaagaagtcgagttcctaaaacgcaacaaagtctacttcatgaaccgacaggacgtactcgacaaaaaccacgtcgccgacatcgacaaactcatcgactacgcagcatccggcgaccccaccagccccgacgacatcgaatcccccaacgcaccctgggtcttcgcatgcgcccccgaccgctgcccgcccacatgcatctacgtcgcaggaatggccgaactcggcgccttcttctccatcctccaagacatgcgatcaacaatcatggccagcaaaaccgtcggcaccgcagaagaaaaactcaaaaagaaatcatcattctaccaatcatacctacgccgcacccaatcaatgggaatccaactagaccaacgcatcatactcctgtacatgctagaatggggcaaggaaatggtcgaccacttccacctcggagacgacatggatccagaactccgaggcctcgcgcaagcactaatcgaccaaaaggtcaaagaaatctcaaaccaagaacccctaaaaatctag

SEQ ID NO: 7826 - RNA, 1302 nt, synthetic construct
  misc_feature 1..1302: note = derived and/or modified CDS sequence (opt11) from PUUV(Baltic/49Cg/00)__AJ314598.1__N
  source 1..1302: mol_type = other RNA
atgtcagacctagccgacatccaagaagacataacccgccacgaacaacaactcgtagtcgcccgccaaaaactcaaagacgctgaaagagccgtcgaagtcgacccggacgacgtcaacaaaaacacactccaagcacgacaacaaaccgtctccgccctcgaagacaaactagctgactacaagagacggatggcagacgccgtctcacgtaaaaagatggacaccaaacccacagaccccaccggcatagaaccagacgaccacctcaaagaacgctcctcactccgctacggcaacgtcctagacgtcaacgcaatagacatcgaagaaccctccggacaaaccgcagactggtacaccatcggcgtctacgtcatcggattcacactccccatcatcctcaaagccctatacatgctctccacccgaggccgccaaacagtaaaagaaaacaagggcaccagaatccgattcaaagacgacaccagctttgaagacataaacggaatccgccgccccaaacacctctacgtctcaatgcccaccgcccaatccacgatgaaagccgaagaactcacccccggccgcttccgcactatcgtctgcggccttttccccacacaaatccaagtacgcaacatcatgtcacctgtcatgggagtcataggcttctctttcttcgtcaaagactggccagaacgcataaaagaattcatggaaaaagaatgccccttcatcaaaccagaagtcaaacccggaacccccgcccaagaagtcgaattcctgaaacgaaacaaagtctacttcatgaaccgccaagacgtcctcgacaaaaaccacgtagcagacatcgacaagctgatcgactacgcagcctccggagaccctacctcgccagacgacatcgaatcaccaaacgcaccctgggtcttcgcctgcgcccccgaccgctgcccccccacctgcatctacgtcgccggcatggccgaactcggcgcattcttctccatactccaagacatgagaaacacaatcatggcaagcaaaaccgtaggaaccgcagaagaaaaactaaaaaaaaaatcctccttctaccaatcatacctacgaagaacccaaagcatgggcatccagctagaccaacgcataatcctcctctacatgctagaatgggggaaagaaatggtagaccacttccacctgggcgacgacatggacccagaactgagaggcctcgcccaagccctaatagaccaaaaggtaaaagaaatctccaaccaagaaccactaaaaatataa

SEQ ID NO: 7827 - RNA, 1302 nt, synthetic construct
  misc_feature 1..1302: note = derived and/or modified CDS sequence (opt11) from PUUV(Pallasjarvi/63Cg/98)__AJ314597.1__N
  source 1..1302: mol_type = other RNA
atgtccgacctcaccgacatccaagaagacataacacgacacgaacaacagctagtagtagcccgccaaaaactcaaagacgcggaacgcgcagtcgaagtagaccccgacgacgtaaacaaaaacacactccaggccagacaacaaaccgtttctgccctggaagacaaactagccgactacaaacgccgaatggcggacgccgtaagccgcaagaaaatggacaccaaacccaccgaccccaccggcatcgaacccgacgaccacctaaaagagcgatcaagcctcagatacggcaacgtcctcgacgtaaacgccatcgacatcgaagaaccctcaggacaaaccgccgactggtacacaatcggcgtatacgtcatcggcttcaccctccccatcatactcaaagcactctacatgctctcaacaagaggccgacaaaccgtcaaagaaaacaaaggcacccgcatccgattcaaagacgacacctccttcgaagacatcaacggcatacgccgacccaaacacctctacgtctccatgccgaccgcacaatcaacaatgaaagccgaagaactcaccccaggaagatttcgcaccatagtctgcggcctcttccccacccaaatccaagtacgcaacatcatgagcccggtaatgggagtaatcggattctcattcttcgtaaaagactggtccgaacgaatccgtgagttcatggaaaaagaatgccccttcataaaacccgaagtcaaacccggcacccccgcacaggaagttgaaatgctcaaacgcaacaaaatctacttcatgcaacgccaggacgtactcgacaaaaaccacgtagccgacatcgacaaactcatagactacgccgcatccggagaccccacatcaccagacaacatcgactcccccaacgcaccatgggtattcgcctgcgcccccgaccgctgcccgccaacctgcatatacgtagccggcatggccgaactgggagccttcttcagcatcctccaagacatgcgcaacaccatcatggccagcaaaacagtcggcactgccgaagaaaaactcaaaaagaaatcatccttctaccaatcatacctacgccgaacccaatccatgggaatacaactggaccaacgcataatcctcctcttcatgctcgaatggggcaaagaaatggtcgaccacttccacctaggcgacgacatggacccagaactccgcggcctagcccaagccctcatcgaccaaaaagtaaaagaaatatcaaaccaggaaccactcaagatctaa

SEQ ID NO: 7828 - RNA, 1302 nt, synthetic construct
  misc_feature 1..1302: note = derived and/or modified CDS sequence (opt11) from PUUV(Sotkamo 2009)__HE801633.1__N
  source 1..1302: mol_type = other RNA
atgagcgaccttaccgacatccaagaagacataacccgccacgaacaacaactcatcgtcgcacgccaaaaactgaaagacgccgaacgcgccgtagaggtagacccagacgacgtcaacaaaaacaccctacaagcacgacaacaaacagtctccgcactcgaagacaaactagccgactacaaacgccgcatggcagacgccgtttcacgcaagaaaatggacaccaaacccaccgaccccaccggcatagaacccgatgaccacctaaaagaacgctcctcactccgctacggaaacgtcctagacgtaaacgcaatcgacatcgaggaacccagcggacaaaccgcagactggtacaccatcggcgtatacgtcatcggcttcaccctaccgatcatcctcaaagccctctacatgctaagcacccgcggcagacaaaccgtcaaagaaaacaaagggacccgaatcagattcaaagacgacacctccttcgaagacatcaacggcattcgccgccccaaacacctatacgtatcaatgcccaccgcccaatcaaccatgaaagccgaagaactgacacccggccgcttccgcaccatagtctgcggcctcttccccacacaaatccaagtcagaaatatcatgtcgcccgtcatgggagtaatcggcttcagcttcttcgtcaaagactggtcagaacgcatacgagagttcatggaaaaagaatgccccttcatcaaacccgaagtaaaacccggaaccccagcccaagaaatcgaaatgctcaaacgcaacaaaatatacttcatgcaaagacaagacgtactagacaaaaaccacgtagcagacatcgacaaactaatcgactacgccgcatctggcgaccccacctcacccgacaacatcgactcaccaaacgccccatgggtattcgcctgcgcccccgaccgctgcccacccacatgcatctacgtagccggaatggccgaactaggcgctttcttcagcatcctccaagacatgcgaaacaccatcatggcatcaaagaccgtcggcacggcagaagaaaaactcaaaaagaaaagctcattctaccaaagctacctccgccgaacccaatccatgggaatccagctcgaccaacgcatcatactcctattcatgctcgaatggggcaaagaaatggtcgaccacttccacctcggcgacgacatggacccggaactccgcggcctagcacaagccctaatagaccaaaaagtgaaagaaatcagcaaccaagaacctctcaaaatctaa

SEQ ID NO: 7829 - RNA, 1302 nt, synthetic construct
  misc_feature 1..1302: note = derived and/or modified CDS sequence (opt11) from PUUV(CG 13891)__U22423.1__N
  source 1..1302: mol_type = other RNA
atgtcagacctaaccgacatacaagaagatatcacccgccacgaacaacagctagtagtcgcccgccaaaaactcaaagacgccgaaaaagccgtcgaaatggaccccgacgacgtcaacaaaaacacactacaagcacgccaacaaacagtatcagcacttgaagacaaactcgccgacttcaagcgccaaatggccgacgccgtctcaagaaagaaaatggacaccaaacccacagaccccacaggcatcgaaccagacgaccacctcaaagaacgcagcagcctccgctatggcaacgtcctggacgtcaacgccatcgacatcgaagaacccagcggacaaaccgcagactggtacacaataggcgtctacgtgatcggatttacactccccatcatcctcaaagccctctacatgctcagcacccgaggccgacaaaccgtaaaagaaaacaaagggacacgcatccgcttcaaagacgacacatcgttcgaagacattaacggcatccgccgtccgaaacacctctacgtctccatgcccaccgcccaatccaccatgaaagccgaagaactaacaccaggacgcttccgcacaattgtatgcggactcttccccacccaaatacaagtccgcaacataatgagccccgtcatgggagtaataggcttctccttcttcgtaaaagactgggccgaccgcatccgcgaatcaatggaaaaagaatgcccattcctcaaacccgacgtcaaacccggcacccccgcccaagaaaccgagttcctcaagcgcaacaaaatatacttcatgcaacgtcaagaagtactcgacaagaaccacgtcgcagaaatcgacaaactaatagactacgccgcttccggagaccccacctccccagacaacatcgaaagccccaacgcaccctgggtattcgcctgcgcccccgaccgatgcccaccaacctgcatatacgtcgcaggcatggccgaactcggagccttcttctccatactacaagacatgcgcaacaccataatggcctctaaaaccgtcggaaccgccgaagaaaaacttaaaaagaaatcctccttctaccaatcatacctccgacgcacacaaagcatgggcatccaactcgaccagcgcatcatcctactatacatgctggaatggggcaaagaaatggtcgaccacttccaccttggcgatgacatggaccccgaactccgaggccttgcccaagcactaatcgaccaaaaagtaaaagaaatctccaaccaagaaccactcaaaatctaa

SEQ ID NO: 7830 - RNA, 1302 nt, synthetic construct
  misc_feature 1..1302: note = derived and/or modified CDS sequence (opt11) from PUUV(CG1820)__M32750.1__N
  source 1..1302: mol_type = other RNA
atgtccgacctcaccgacatccaagaagaaataacgcgacatgaacaacagctagtagtcgccagacaaaaactcaaagacgcagaacgcgcagtcgaagtcgaccccgacgacgtcaacaaatccaccctacaagcccgccaacaaaccgtctcagccctagaggacaaactcgccgactacaaaagaagaatggccgacgccgtctcacgcaagaaaatggacacaaaaccaacagatcccaccggcatcgaacccgacgaccacctcaaagaaagatcatccctccgttacggcaacgtcctcgacgtaaacgccatcgacatcgaggaaccctccggacaaaccgccgactggtacacaataggcgtatacgtaataggattcaccatccccatcatcctcaaagccctctacatgctctcaacacgtggccggcagaccgtcaaagaaaacaaaggcacacgcatccgattcaaagacgacaccagcttcgaagacataaacggcatacgccgccccaaacacttatatgtctccatgcccaccgcacaatcaaccatgaaagccgaagaactcacccctggacgattccgcacaatcgtatgcggcctattccccacccaaatccaagtccgcaacatcatgagccccgtcatgggagtcatcggcttctccttcttcgtaaaagactggccagagaaaatccgcgaatttatggaaaaagaatgccccttcatcaaacccgaagtcaaacccggtacacccgcacaagaagtcgagttcctaaaacgtaaccgcgtatacttcatgacacgacaggacgtcctcgacaaaaaccacgtcgccgacatcgacaaacttatcgactacgcagccagcggcgaccccaccagccccgacgacatcgaatcccccaacgcaccctgggtcttcgcctgcgcccccgaccgatgcccaccaacctgcatatacgtcgcaggaatggccgaactcggagccttcttctccatcctacaagacatgcgcaacaccatcatggcgagcaagaccgtcggcacggcagaagaaaaactcaaaaagaaaagcagcttctaccaatcctacctccgccgaacacagtccatgggaatccaactcgaccaacgcataatactactatacatgctagaatggggccgagaaatggtggaccacttccacctcggagatgacatggaccccgaactccgcggactcgcacaatctctaatcgaccaaaaagtcaaagaaatctccaaccaagaacccctcaaaatctag

SEQ ID NO: 7831 - RNA, 1302 nt, synthetic construct
  misc_feature 1..1302: note = derived and/or modified CDS sequence (opt11) from PUUV(Bussjo_95-1)__AM746297.1__N
  source 1..1302: mol_type = other RNA
atgtcagatctgacagacatccaagaagacataacccgccacgaacagcaacttgtggtagcccggcaaaaactcaaagacgccgaaaaagcagttgaaatggacccggacgacgtcaacaaaaacaccctacaagcccgccagcaaaccgtatcagccctcgaagacaaactcgccgatttcaaaagacgcatggccgatgccgtctcacgcaaaaaaatggacaccaaacccaccgacccaaccggcatagaacccgacgaccacttaaaagaaagaagctcactacgatacggcaacgtactagacgtaaacgccatagacatcgaagaacccagcggccaaacggccgactggtacaccatcggcgtctacgtcataggcttcacactcccaatcatactcaaagccctgtacatgctatccaccagaggacgacaaacagtaaaagaaaacaaaggcacccggatcagattcaaagacgacaccagcttcgaagacatcaacggcatcagacgcccaaaacacctctacgtctcgatgcccaccgcgcaatccacaatgaaggccgaagagctaacccccggccgcttccgcacaatcgtctgcggactattccccacccaaatccaagtacggaacatcatgagcccagtcatgggcgtcatcggcttctccttcttcgttaaagactggcccgaccgcatccgcgaattcatggaaaaagaatgccccttcatcaaacccgaggtcaaacccggcacaccaacccaagaaatcgagttcctaaaaaaaaacaaagtctacttcatggaccgccaaaacgtcctcgacaaaaaccacgtcgccgacatagacaaactcatcgactacgcagcctccggcgaccccaccagccctgacaacatcgaaagccctaacgccccctgggtcttcgcctgcgcccccgaccgatgcccaccaacatgcatctacgtagccggcatggccgaactcggcgccttcttctccatcctccaagacatgcgaaacacaataatggccagcaaaaccgtcggcaccgccgaagaaaaacttaaaaaaaaaagctccttctaccaatcctacctacgccgcacccaatccatgggcatacaattagaccaacgcatcatcctcctctacatgctagaatggggcaaagaaatggtcgaccacttccacctaggcgacgacatggacccagaactacgcggcctagcccaagccctaatagatcaaaaagtcaaagaaatatcaaaccaggaccccctcaaaatctaa

SEQ ID NO: 7832 - RNA, 1302 nt, synthetic construct
  misc_feature 1..1302: note = derived and/or modified CDS sequence (opt11) from PUUV(CG144)__AF367064.1__N
  source 1..1302: mol_type = other RNA
atgtcagacctcaccgacatccaggaagacataacccgacacgaacaacagctagtagccgcccgccaaaaactaaaagacgcagaacgcgccgtagaaatggaccccgacgacgtcaacaaaaacaccctccaagcccgccaacaaaccgtctccgccctcgaagacaagctcgccgactacaaacgccgaatggctgacgcagtctcccgcaagaaaatggacaccaaacccgcagaccctacaggcatcgaacccgacgaccacctcaaagaacgctcatcactccgctacggcaacgtcctagacgtcaacgccatcgacatagaagaaccctctggccaaacggcagactggtacacaatcggcatctacgtcatcggattcacactaccaatcatcctcaaagccctctacatgctatccacccgaggacgacaaacagtcaaagaaaacaaaggcacccgcatccgcttcaaagacgacaccagcttcgaagacataaacggcatacgaagacccaaacacctatacgtcagcatgccaaccgcacaaagcaccatgaaagcagaagaactcacccccggccgcttccgcactatagtctgcggcctattccctacacaaatccaagtccgcaacatcatgtctcccgtaatgggagtcatcggcttctccttcttcgtcaaagactggcccgaacgtatccgcgagttcatggaaaaagaatgcccattcatcaaacccgaagtcaaacccggcacccccgcccaagaaatcgaaatgctcaaaaagaacaaaatctacttcatgcaccgccaagacgtactagacaaaaaccacgtagccgacatcgacaaactcatcgactacgcagcctccggagaccccacatcacccgacaacatcgactcacccaacgccccctgggtctttgcatgcgcccccgacagatgcccaccaacgtgcatctacgtagcaggcatggccgaactaggcgccttcttcagcatcctacaagacatgcgcaacacaatcatggcctccaaaaccgtaggcacagccgaagaaaaactcaaaaagaaatcgtcattctaccaatcatacctccgccgaacccaatcaatgggcatccagctcgatcaacgcatcatactcctttacatgctagaatggggaaaagaaatggtcgaccactttcacctaggcgacgacatggaccccgaactccgcggcctcgcacaagccctcatcgaccaaaaagtcaaagaaatctctaaccaagaacccctaaaaatctaa

SEQ ID NO: 7833 - RNA, 1302 nt, synthetic construct
  misc_feature 1..1302: note = derived and/or modified CDS sequence (opt11) from PUUV(CG168)__AF367065.1__N
  source 1..1302: mol_type = other RNA
atgtccgacctcaccgacatccaagaagacatcacacgtcacgaacaacaactcgtcgctgcccgacaaaaactcaaagacgccgaacgcgccgtggaaatggaccccgacgacgtcaacaaaaacaccctacaagcacgccaacaaacagtctccgccctcgaagataaacttgccgactacaaacgacgcatggcagacgccgtctcccgcaagaaaatggacaccaaaccggcagaccccaccggcatcgaacccgacgaccacctcaaagagcgctcctccctccgttacggcaacgtactcgacgtcaacgcaatcgacatcgaagaaccaagcgggcaaacagcagactggtacaccatcggcgtctacgtcataggattcaccctccccataatactcaaagcactctacatgctaagcacccgaggccgccaaactgtcaaagaaaacaaaggaacacgaatccgattcaaagacgacacctccttcgaagacatcaacggcatccgccgccccaaacacctatacgtctcaatgccaaccgcccaatccaccatgaaagccgaagaactcacacccggcagattccgcaccatcgtctgcggcctcttccccacccaaatccaagtacgaaacatcatgtccccagtcatgggcgtcatcggcttctcattcttcgtcaaagactggcccgaacgcatccgagagttcatggaaaaagaatgccccttcataaaacccgaagtcaaacccggcataccagcacaagaaatcgaaatgctcaagaaaaacaaaatatacttcatgcaccgccaagacgtactcgacaaaaaccacgtcgccgacatcgacaaactaatcgactacgccgcctcaggcgacccaacctcccccgacaacatcgacagccccaacgcaccctgggtcttcgcgtgcgcccccgaccgctgcccacccacatgcatctacgtcgccgggatggccgaactaggcgcgttcttctccatcctacaagacatgcgaaataccatcatggcatccaaaaccgtcggaaccgcagaagaaaaactcaaaaagaaatcgtccttctaccaatcgtacctccgacgcacccaaagcatgggcatacaactcgaccaacgcatcatactcctatacatgctagaatggggaaaagaaatggtcgaccacttccacctcggcgacgacatggaccccgaactccgcggactcgcccaagcactaatcgaccagaaagtgaaagaaatatccaaccaagaacccctcaaaatctaa

SEQ ID NO: 7834 - RNA, 1302 nt, synthetic construct
  misc_feature 1..1302: note = derived and/or modified CDS sequence (opt11) from PUUV(CG17/Baskiria-2001)__AF442613.1__N
  source 1..1302: mol_type = other RNA
atgtccgacctagccgatatacaagaagaaataacccgccacgaacaacagctagtcgcagctcgacaaaaactaaaagacgccgaacgtgccgtggaagtcgaccccgacgacgtaaacaaaaacaccctacaagcacgccaacaaacggtcagcgcactggaagacaaactcgcggactacaaacgccggatggcagacgccgtatcccgcaagaaaatggacaccaaaccaacagaccccacaggcatagaaccagacgaccacctcaaagaacgcagcagcctccgctacggcaacgtactcgacgtaaacgcaatcgacatagaggaaccatccggccaaacggccgactggtacactatcggggtctacgtgataggcttcacgatacccataatcctcaaagccctatacatgctctccacccgcggcagacaaaccgtcaaagagaacaaaggcacccgcatccgcttcaaagacgacacctcattcgaggacataaacggaatcagaagacccaaacacctctacgtatccatgccaacagctcaatcaaccatgaaagccgaggaactcacccccggccgattccgcaccatcgtatgcggactcttccccacccaaatccaagtccgaaacatcatgagccccgtcatgggcgtcatcggcttctcattcttcgtcaaagactggcccgagaaaatccgagagttcatggaaaaagaatgccccttcataaagcccgaagtcaaacccggcacacccgcacaagaagtcgagttcctcaaacgcaaccgcgtatacttcatgacccgccaagacgtgctagacaaaaaccacgtcgccgacatagacaaactcatcgactacgcagcctcaggcgaccccacaagccccgacgacatcgaatcaccgaacgccccctgggtattcgcctgcgcccccgaccgatgcccacccacatgcatatacgtagccggaatggcggaactcggcgcattcttcagcatcctccaagacatgcgcaacaccatcatggcaagcaaaaccgtaggcacagccgaagaaaaactaaagaagaaatcatccttctaccagtcatacctccgccgcacccaatcaatgggcatccaactagaccagcgcataatcctcctctacatgctagaatggggaaaagaaatggtagaccacttccacctcggagacgacatggaccccgaactacgaggactagcgcaatccctcatcgaccaaaaagtcaaagaaatctccaaccaagaaccactaaaaatataa

SEQ ID NO: 7835 - RNA, 1302 nt, synthetic construct
  misc_feature 1..1302: note = derived and/or modified CDS sequence (opt11) from PUUV(CG215)__AF367066.1__N
  source 1..1302: mol_type = other RNA
atgtcagacctcacagacatccaagaagacatcacccgtcacgaacaacaactcgtcgccgcccgacaaaaactcaaagacgcagaacgcgccgtcgagatggaccccgacgacgtcaacaaaaacacactacaagctcgacaacaaaccgtcagcgccctcgaagacaaactagccgactacaaacgccgaatggccgacgcagtatcccgcaagaaaatggacacaaaacccgccgaccccaccggcatcgaacccgacgaccacctcaaagaacgatcctccctccgctacggaaacgttctcgacgtcaacgcaatcgacatcgaagaaccatccggccaaaccgcagactggtacaccatcggcgtttacgtaatcggcttcaccctccccataatcctaaaagccctttatatgctctccacacgaggacgccaaaccgtcaaagaaaacaaaggcacacgcatacgattcaaagacgacacctctttcgaagacatcaacggcatccgccgacctaaacacctctacgtctcaatgcccacagcccaaagcaccatgaaagccgaagaactcacccccggccgattccgcaccatagtatgcggactcttcccaacccaaatacaagtccgcaacatcatgtcccccgtcatgggcgtaatcggcttctccttcttcgtcaaagactggcccgaacgcatcagagagttcatggaaaaagaatgccccttcataaaacccgaagtcaaaccgggaaccccagcccaagaaatagaaatgctaaagaaaaacaaaatctacttcatgcaccgccaagacgttctcgacaaaaaccacgtcgccgacatcgacaaactcatcgactacgccgcaagcggagacccaacctcacccgataatatcgacagcccaaacgctccctgggtattcgcctgcgcacccgaccgctgcccaccaacctgcatctacgtcgcaggcatggccgaactaggcgcattcttctccatcctacaagacatgcgcaacaccatcatggcctcaaaaacagtagggaccgcagaagaaaaactcaaaaagaaaagctcattctaccagtcctacctaagaagaacacaatccatgggaatccaactcgaccaacgcatcatactactctacatgctcgaatgggggaaagaaatggtcgaccacttccacctgggcgacgacatggaccccgaactacgcggactcgcccaaacactaatagaccaaaaagtaaaagaaatatccaaccaagaacccctaaaaatatag

SEQ ID NO: 7836 - RNA, 1302 nt, synthetic construct
  misc_feature 1..1302: note = derived and/or modified CDS sequence (opt11) from PUUV(CG315)__AF367068.1__N
  source 1..1302: mol_type = other RNA
atgtcagacctcacagacatccaagaagacatcacacgccacgaacaacaactcgtcgcagcacggcaaaaactgaaagacgctgaacgcgccgtcgaaatggaccccgacgacgtcaacaaaaacaccctccaagccagacaacaaaccgtgtccgctctagaagacaaactagccgactacaaacgccgaatggcagacgccgtctcacgaaagaaaatggacacaaaacccgccgaccccacaggaatagaacccgacgaccacctcaaagaacgatcaagccttcgctacggcaacgtactagacgtaaacgccatagacatcgaagaaccctccggccaaaccgccgactggtacacaatcggcgtatacgtcattggatttaccctccccatcatcctcaaagccctatacatgctatcaacccgcggacgccaaacagtcaaagaaaacaaaggaacccgcatccgattcaaagacgacacctccttcgaagacatcaacggcatccgccgcccaaaacacctatacgtatccatgcccaccgcccaatccaccatgaaagccgaagaactaacaccaggccgcttcagaaccatcgtatgcggcctcttccccacccaaatacaagtacgtaacatcatgtcccccgtcatgggggtcatcggcttctccttcttcgtcaaagactggcccgaacgcatccgcgagttcatggaaaaagaatgccccttcatgaaacccgaagtaaagcccggcaccccggcccaagaaatcgaaatgctcaagaaaaacaaaatctacttcatgcaccgccaagacgtcctagacaagaaccacgtcgccgatatcgacaaactaatcgactacgccgcttcaggagaccccacctcacccgacaacatcgactcccccaacgcaccctgggtgttcgcctgcgcgcccgaccgctgcccaccaacctgcatctacgtcgcagggatggcagaactaggagccttcttctccatactccaagacatgagaaacacaatcatggcatccaaaactgtaggcacagccgaagaaaaactgaaaaagaaatcgtctttctaccaatcctacctacgccgcacacaatccatgggaatacaactcgaccaacgaatcatcctcctatacatgctagaatggggaaaagagatggtagaccacttccacctaggcgacgatatggaccccgaactccggggcctagcccaagccctcatcgaccaaaaagtcaaagaaatcagcaaccaagaacccttaaaaatctaa

SEQ ID NO: 7837 - RNA, 1302 nt, synthetic construct
  misc_feature 1..1302: note = derived and/or modified CDS sequence (opt11) from PUUV(CRF161)__AF367069.1__N
  source 1..1302: mol_type = other RNA
atgtcagacctcaccgacatccaagaagacataacacgccacgaacaacagctagtcgccgcccgccaaaaactcaaagacgccgagcgagccgttgaaatggacccggacgatgtcaacaaaaacaccctccaagcccgacaacaaaccgtctcagcactagaagacaaactagccgactacaaacgacgaatggccgacgccgtctcccgtaagaaaatggacaccaaacccgccgaccccaccggcatcgagccagacgaccacctcaaagagagatcctccctgcgctacggcaacgtcctcgacgtaaacgccatagacatcgaggaaccaagcggacaaaccgccgactggtacaccataggcgtctatgtcatcggattcactctaccaataatcctcaaagccctctacatgctctccacccgaggccgccaaacagtcaaagaaaacaagggcaccaggatacgcttcaaggacgacacatccttcgaagacatcaacggcatccgcagacccaaacacctctacgtatccatgccgaccgcccaatccaccatgaaagccgaagaactgacacccggacgattccgcacaatagtctgcggactattccccactcaaatccaagtccgcaacataatgtcccccgtcatgggagtaatcggcttctccttcttcgtaaaagactggccagaacgcatccgagagttcatggaaaaagaatgcccattcatcaaaccagaagtcaaacctggcacccccgcccaagaaatagaaatgctaaagaaaaacaaaatctacttcatgcacagacaagacgtactagacaaaaaccacgtcgccgacatcgacaaactcatagattacgccgcatcaggcgaccccacgtccccagataacatcgacagccccaacgcaccctgggtcttcgcatgcgcaccagaccgatgcccaccaacctgcatctacgtcgcaggtatggccgaactaggagccttcttctccatcctccaagatatgcgcaatacaataatggcatccaaaaccgtcggaacagcagaagaaaaactgaagaagaaatcctccttctaccaatcctacctccgacgaacccaatcaatgggcatccaactagaccaacgcatcatactcctctacatgctcgaatggggcaaagaaatggtcgaccacttccacctaggagacgacatggaccccgaactccgcggcctcgcccaagccctcatcgaccaaaaagttaaagaaatcagcaaccaagaacccctaaaaatataa

SEQ ID NO: 7838 - RNA, 1302 nt, synthetic construct
  misc_feature 1..1302: note = derived and/or modified CDS sequence (opt11) from PUUV(CRF308)__AF367070.1__N
  source 1..1302: mol_type = other RNA
atgagcgaccttaccgacatccaagaagacataacacgccacgaacaacaactcgtagcagcacgccagaaactaaaagacgccgaaagagccgtcgaaatggacccagacgacgtcaacaaaaacacacttcaagcccgccaacaaaccgtcagcgccctcgaagacaaactcgcagactataaaagacgaatggccgacgcagtctcccgaaaaaaaatggacaccaaacccgcagacccaaccggaatcgaacccgatgaccacctcaaagaaagatcctccctccgctacggcaacgtcctggatgtcaacgctatagacatagaagaacccagcggacaaaccgcagactggtacacaatcggcgtctacgtaatcggattcaccctacccatcatactaaaagccctctatatgctctccaccagagggcgtcagaccgtaaaagaaaataaaggcacacgcatacgattcaaagacgacaccagcttcgaagacataaacggcatacgccgacccaaacacctttacgtcagcatgccaacagctcaatcaacaatgaaggccgaagaactcacccccggacgcttcaggacaatcgtatgcggcctcttccccacccaaatccaggtcagaaacatcatgtcacccgtaatgggagtcatcggattctccttcttcgtcaaagactggcccgaacggatccgagaattcatggaaaaagagtgccctttcatcaaaccagaagtaaaacccggcacgcccgcgcaagaaatcgaaatgctcaaaaaaaacaaaatctacttcatgcaccggcaagacgtcctagacaaaaaccacgtcgccgacatggacaaactcatcgactacgccgcaagcggcgacccaacctcacccgacaacatcgactcacctaacgccccctgggtcttcgcctgcgcaccagacagatgcccaccgacctgcatctacgtcgcaggcatggcagagcttggtgccttcttctcgatcctacaagacatgcgcaacaccatcatggcctccaaaaccgtcggcacagccgaagaaaaactcaaaaaaaaatcctcattctaccaaagctacctccgacgaacccaatcaatgggaatacaactcgaccaacgaatcatcctcctctacatgctcgagtggggcaaagagatggtcgaccacttccacctcggagacgacatggacccagaactaagaggactcgcccaggcattaatcgaccaaaaagtcaaagaaatctccaaccaagaacccctcaaaatctaa

SEQ ID NO: 7839 - RNA, 1302 nt, synthetic construct
  misc_feature 1..1302: note = derived and/or modified CDS sequence (opt11) from PUUV(CRF366)__AF367071.1__N
  source 1..1302: mol_type = other RNA
atgaccgacctaacagacatccaagaagacataacacgacacgaacaacaactcgtcgccgcacgccaaaaactcaaagacgccgaacgagccgtagaaatggaccccgacgacgtcaacaagaacacactacaagcacgacaacaaacagtatcagcactcgaagacaagctagccgactacaagcgccgaatggccgacgccgtcagccgcaagaaaatggacacaaaacccgccgaccccacaggaatagaacccgacgaccacctgaaagaacgctcaagcctccgatacggaaacgtcctagacgtaaacgccatcgacatcgaagaaccctcaggccaaaccgccgactggtacacaatcggtatctacgtcatcggcttcaccctccccatcatcttaaaagcactctacatgctcagcacacgaggacgccaaaccgtcaaagaaaacaaaggaacccgcatccgcttcaaagacgacaccagcttcgaagacatcaacggcatccgcagacccaagcacctttacgtatccatgcccacagcacagagcaccatgaaagccgaagaacttacccccggccgcttccgcacaatcgtctgcggcttattcccaacccaaatccaagtccgcaacatcatgagccccgtaatgggcgtcatcggcttcagcttcttcgtcaaagactggcccgaacgcatacgcgagttcatggaaaaagaatgccccttcatcaaaccggaagttaaaccaggcacacccgcccaagaaatcgaaatgctaaagaaaaacaaaatctacttcatgcaccgccaagacgtcctcgacaaaaaccacgtcgcagacatcgacaaactaatcgactacgcagcctccggtgacccaacctcccccgacaacatcgactcacctaataccccatgggtattcgcctgcgcccccgaccgatgcccaccaacctgcatctacgtcgcgggaatggccgaactcggcgcattcttcagcatcctccaagacatgcgaaacaccatcatggcctcaaaaacagtcggcaccgctgaagaaaaactcaaaaagaaatcctccttctaccaatcctacctcagacgcacccaatccatgggcatccaactcgatcaacgcatcatcctactttacatgctcgaatggggcaaagaaatggtcgaccacttccacctcggcgacgacatggatcccgaactccgcggcctagcccaggccctcatcgaccaaaaagtcaaagaaatcagcaaccaagaacccctcaaaatctaa

SEQ ID NO: 7840 - RNA, 1302 nt, synthetic construct
  misc_feature 1..1302: note = derived and/or modified CDS sequence (opt11) from PUUV(Djaknebole_98-1)__AM746310.1__N
  source 1..1302: mol_type = other RNA
atgtcagacctgaccgacatccaagaagacatcacgcgccacgaacaacaactcgtagtcgcacgacaaaaactcaaagacgcggaaaaagccgtggaaatggacccggacgacgtaaacaaaaacaccctacaagcgcgccaacaaacagtctccgcactcgaagacaaactcgctgacttcaaacgccgcatggcggacgccgtctcccgcaaaaaaatggacaccaaacccaccgaccccacaggaatcgaacccgacgaccacctaaaagagcgctcctcactcagatacggcaacgtcctcgacgtcaacgccatcgacatagaagaaccatcaggccaaaccgccgactggtacaccatcggcgtctacgtcatcggcttcaccctcccaatcatactcaaagccctgtacatgctcagcaccagaggccggcaaaccgtcaaagaaaacaaaggcacccgaatccgcttcaaagacgacacatcattcgaagacatcaacggcatccgccggccgaaacacctatacgtctctatgcccaccgcacagtccacaatgaaagccgaagaactcacaccaggccgcttcagaacaatcgtctgtggcctcttccccacccaaatccaagtacgaaacatcatgtccccagtcatgggagtcatcggattcagcttcttcgtcaaagactgggccgaccgaatcagagaattcatggaaaaagaatgcccattcatcaaaccggaagtcaaaccaggaaccccgacccaagaaatagaattccttaaaaaaaacaaagtctacttcatggaccgccaaaacgtactcgacaagaaccacgtagctgacatcgacaaactcatagactacgcagctagcggcgaccccacatccccagacaacatagagtccccgaacgcaccctgggtcttcgcctgcgcccccgaccgatgcccccccacctgcatatacgtagccggcatggcagaactcggcgccttcttctccatcctccaagacatgcgcaacaccataatggccagcaaaaccgtcggcaccgccgaggagaaactaaaaaaaaaatccagcttctaccagtcctacctccgccgaacccaaagcatgggcatacaactagaccaacgaataatactcctctacatgctcgaatggggcaaagaaatggtcgaccacttccacctcggcgacgacatggaccccgaactcagaggcctagcacaagcactcatagaccaaaaagtaaaagaaatcagcaaccaagacccactaaaaatctaa

SEQ ID NO: 7841 - RNA, 1302 nt, synthetic construct
  misc_feature 1..1302: note = derived and/or modified CDS sequence (opt11) from PUUV(Fusong 114-05)__EF488804.1__N
  source 1..1302: mol_type = other RNA
atgtccgacctcaaagacattcaagaagacatagcccgccacgaacaacagctagtagtagcacgacaaaaactccgggacgccgaaaaagccgtagaaatggacccagacgacgtcaataaaaacaccctccaagcccgccaacaaacagtctcagccctcgaagacaaaatagcagacttcaaacgccgcatggcagacatcgtcagccgcaagaaaatggacacaaaacccgcagacccaacaggcatcgaacccgacgaccacctgaaagaacgctcgtccctccgctacggcaacgtactagacgtcaacgcaatcgacatcgaagaacccagcggccaaacagcggactggtacaccattggcgtatacataatagagttcaccctccccatcatactaaaagccctatacatgctcagcacacgaggccgacaaaccgccaaagaaaacaaaggcacccgcatccgattcaaagacgacacctccttcgaagacgtcaacggcatccgccgacccaagcacctatatgtatccatgcccaccgcgcaatcaacaatgaaagcagaagaactaaccccaggacgctttcgcacaatagtctgcggcctcttccccacccaaatacaagttcgaaacatcatgtcccccgtcatgggcgtaatcggcttcagcttcttcgccaaagactggccagaccgaatcaaagagttcatggaaaaagaatgccccttcatcaaacccgaagtgaaaccagggacacccgccaaagaagtagaaatcctcaaacgcaacaaaatctacttcatgcaaagacaaggcgttctcgacaaaaaccacgtccccgacatcgacaaactcatagactacgccgcctccggcgacccaaccagcccccgcaacatcgactcccccaacgcaccctgggtcttcgcctgcgcccccgaccgctgcccaccgacgtgcatctacgtcgcaggcatggccgaactcggggccttcttctccatcctccaagacatgcgcaacaccatcatggcctccaaaactgtcggcaccgccgaagaaaaactcaaaaagaaatcctccttctaccaaagctaccttcgacgcacccaatccatgggaatacaactcgaccaacgcattatcctactctacatgcttgaatggggaaaagaaatggtcgaccacttccacctcggagacgacatggaccctgaactccgctcactcgcccaagcgctcatcgaccaaaaagtaaaagaaatctccaaccaagaaccactaaaaatatag

SEQ ID NO: 7842 - RNA, 1302 nt, synthetic construct
  misc_feature 1..1302: note = derived and/or modified CDS sequence (opt11) from PUUV(Fusong 199-05)__EF488803.1__N
  source 1..1302: mol_type = other RNA
atgtccgacctcaaagacatccaagaagacatcgcaagacacgaacaacagctcgtcgcagcccgacagaaactacgggacgccgaaaaagccgtcgaaatggaccccgacgacgttaacaaaaacacactccaagcccgccaacaaacagtctcagccctcgaggacaaaatcgcagacttcaaacgccgaatggccgacatcgtatcccgcaagaaaatggacaccaaacccgcagaccccaccggcatcgaacccgacgaccacctaaaagaacgctcaagcctacgctacggcaacgtcctagacgtaaacgccatagacatcgaagaacccagcggccaaaccgcggactggtacacaataggcgtatacatcatcggcttcaccctccccatcatactaaaagccctctacatgctctcaacccgcggccgacaaactgtcaaagagaacaaaggaacccgcatcagattcaaagacgacaccagcttcgaagatgtaaacggcatccgccggcccaaacacctctacgtcagcatgcccaccgcacaatccacaatgaaagccgaagaactcacccccggccgattccgcaccatcgtctgcggcctcttccccacccaaatccaagtacgcaacatcatgagccccgtcatgggcgtaatcggcttctccttcttcgccaaagactggccagaccgtatcaaagagttcatggaaaaagaatgcccattcatcaaacccgaagtcaaaccaggaacacccgccaaagaagtcgaaatcctaaaacgcaacaagatctacttcatgcaacgccaagacgtcctagacaaaaaccacgtccccgacatcgacaaactcatagactacgcagcctccggagaccccacatcacccgaaaacatcgactcaccaaacgcgccatgggtcttcgcctgcgcaccagaccgatgcccaccaacctgcatatacgtcgccggcatggccgaactaggcgccttcttctcaatactacaggacatgcgcaacaccataatggcatccaaaaccgtcggcaccgccgaagaaaaactaaagaagaaaagctccttctaccaatcttacctcagacggacccaatccatgggcatccaactagaccaacgaatcattctcctatacatgctcgaatggggaaaagaaatggtagaccacttccacctcggagacgatatggaccccgaactccgatcgttagcacaagccctgatcgaccaaaaagtcaaagaaatatccaaccaagaacccctaaaaatctaa

SEQ ID NO: 7843 - RNA, 1302 nt, synthetic construct
  misc_feature 1..1302: note = derived and/or modified CDS sequence (opt11) from PUUV(Fusong 200-05)__EF211820.1__N
  source 1..1302: mol_type = other RNA
atgagcgacctcaaagacatccaagaagacatcgcccgacacgaacaacaactcgtagtcgcacgccaaaaactccgcgacgcagaaaaagccgtcgaaatggaccccgacgacgtaaacaaaaacaccttacaagcccgacaacaaacggtctcagccctcgaagacaaaatagcagacttcaaacgccgcatggccgacatcgtcagccgcaaaaaaatggacacaaaaccagccgaccccacaggaatcgaacccgacgaccacctcaaggaacgctccagcctgcgctacggcaacgtactcgacgtaaacgcaatcgacatcgaagaaccttcaggccaaacggcagactggtacaccataggcgtctacataataggcttcacactacccatcatcctcaaagcactatacatgctctcgacccgcggacgccaaaccgtaaaagaaaacaaaggcacccgcatacgcttcaaagacgacacatccttcgaagacgttaatggaatccgccgaccaaaacacctctatgtctccatgcccaccgcacaaagcaccatgaaagcagaagagctaaccccaggacgcttccgcacaatcgtctgcggcctcttcccaacccaaatacaagtccgcaacatcatgtccccagtcatgggagtcatcggcttctccttcttcgcaaaagactggccagaccgcatcaaagaattcatggaaaaagaatgccccttcatcaaaccagaagtaaaacccggaacccccgccaaagaagtggaaatcctcaaacgcaacaaaatctacttcatgcaacgccaagacgtcctagacaaaaaccacgtacccgacatcgacaaactcatagattatgccgcttccggcgacccaacctcccccgaaaacatcgacagcccaaacgccccctgggtctttgcctgcgcacccgatcgctgcccccccacctgcatctacgtcgccggaatggcagaactcggagccttcttcagcatcctccaagacatgcgcaacacaatcatggcttccaaaacagtcggcacagcagaagaaaaactgaaaaaaaaatcatcattctaccaatcctacctacgccgaacacaatcaatgggaatccaactcgaccaacgaataatcctgctctacatgctagaatggggaaaagaaatggtcgaccacttccacctcggtgacgacatggaccccgagctcagatccctcgcccaggccctcatcgaccaaaaagtaaaagaaatatccaaccaagaacccctcaaaatctaa

SEQ ID NO: 7844 - RNA, 1302 nt, synthetic construct
  misc_feature 1..1302: note = derived and/or modified CDS sequence (opt11) from PUUV(Fusong 900-06)__EF488806.1__N
  source 1..1302: mol_type = other RNA
atgtccgatctcaaagacatacaagaagacatagcccgccacgaacaacaacttgtcgtcgccaggcagaaactccgagacgcagagaaagccgtcgaaatggaccccgacgacgtaaacaaaaacacactacaagcccgccaacaaaccgtctcagccctcgaagacaaaatcgccgacttcaaacgacgaatggcggacatcgtcagccgcaaaaagatggacaccaaacccgccgaccccacaggcatcgaacccgacgaccacctcaaagaacgatcctcactccgctacggcaacgtactagacgttaacgccatagacatcgaagaaccatctggccaaaccgccgactggtacaccatcggagtctacatcatcggctttacactgccaataatcctcaaagccctatacatgctatccacccgcggccgtcaaaccgtcaaagaaaacaaaggaacccgaatccgcttcaaagacgacaccagcttcgaagacgtaaacggcatccgacgacccaaacacctctacgtctcaatgcccaccgcacaatcaaccatgaaggccgaagaactaaccccaggcagattccgtacaatcgtctgcggcctcttcccaacacaaatccaagtccgaaatatcatgtcccccgtaatgggcgtaatcggattctccttcttcgccaaggactggcccgaccgcatcaaagagttcatggaaaaagaatgccccttcatcaaacccgaagtaaaacccggaacccccgccaaagaagtagaaatactaaaacgcaacaaaatctacttcatgcagcgacgagacgtcctcgacaaaaaccacgtacccgacatagacaaactcatagactacgccgccagcggcgacccaacatcccccgaaaacatcgactcccccaacgccccatgggtcttcgcctgcgcccccgacagatgcccaccaacctgcatatacgtcgcaggcatggccgaactaggcgccttcttctccatactccaagacatgcgaaacacaatcatggcctccaaaaccgtaggcacggccgaagaaaaactcaaaaagaaaagcagcttctacaaatcctacctaagaagaacccaatcaatgggcatacaactcgaccaacgcatcatcctcctatacatgctcgaatggggcaaagagatggtagaccacttccacctcggtgacgacatggaccccgaactacgctcactcgcccaagccctaatcgaccaaaaagtgaaagaaatcagcaaccaagaacccctcaaaatctag

SEQ ID NO: 7845 - RNA, 1302 nt, synthetic construct
  misc_feature 1..1302: note = derived and/or modified CDS sequence (opt11) from PUUV(Gumboda_98-2)__AM746316.1__N
  source 1..1302: mol_type = other RNA
atgtcggacctcacagacatccaagaagacataacccggcacgaacaacaactcgtcgtagccagacagaaactcaaagacgccgaaaaagcagtcgaaatggaccccgacgacgtcaacaaaaacacgctccaagcacgccaacaaacagtctccgccctagaagacaaactcgccgacttcaaaagacgaatggccgatgccgtttcacgcaagaaaatggacaccaaacccactgaccctaccggcatagaaccagacgaccacctcaaagaacgatcatccctccgctacggcaacgtactggacgtcaacgccatcgacatcgaagaaccatccggccaaaccgccgactggtatactatcggcgtatacgtcatcggattcacactacccatcatcctcaaagccctctacatgctatccacccgcggccgccagaccgtcaaagaaaacaaaggcacccgaatacgcttcaaagacgacacctccttcgaagacatcaacggcatacgccgccccaaacacctatacgtcagcatgcccacagcgcaatcaaccatgaaagccgaagaacttaccccgggacgcttccgcacaatcgtctgcggactattcccaacccaaatacaagtacgcaacatcatgtccccagttatgggagtcatcggcttcagcttcttcgtcaaagactgggccgaccgaatacgcgagttcatggaaaaagaatgccccttcatcaaacccgaggtaaaacccggcacacccacacaagaaatagagttcctaaagaaaaacaaagtctacttcatggacagacaaaacgtactagagaaaaaccacgtggcagacatcgacaaactcattgactacgccgcctccggcgaccccacctcccccgacaacatcgaatcccccaacgccccctgggtcttctcctgcgcacccgaccgctgcccaccaacctgcatatacgtagccggcatggcagaactaggcgccttcttcagcatactccaagatatgcgcaacaccatcatggcctccaaaaccgtcggcaccgccgaagaaaaactcaaaaagaaatcctccttctaccaatcctacctccgccgcacccaatcaatgggcatacagctcgaccaacgaatcatactcctctacatgctcgaatggggaaaagaaatggtcgaccacttccacctcggcgacgacatggaccccgaactccgaggcctagcccaagccctcatcgaccaaaaagtcaaagaaatctccaaccaggaccccctcaaaatataa

SEQ ID NO: 7846 - RNA, 1302 nt, synthetic construct
  misc_feature 1..1302: note = derived and/or modified CDS sequence (opt11) from PUUV(Gumboda_98-4)__AM746318.1__N
  source 1..1302: mol_type = other RNA
atgtccgacctaaccgacatccaagaagacatcaccagacacgaacaacaactcgtcgtcgcacgccagaaactcaaagacgccgaaaaagccgtcgaaatggaccccgacgacgtaaacaaaaacaccctgcaagccagacagcaaaccgtatcagccctagaagacaaactcgcggacttcaaacgacgaatggccgacgcagtctcccgaaagaaaatggacacaaaacccaccgaccccaccggcatcgaacccgacgaccaccttaaagagcgctcatccctccgctacggcaatgtcctggacgtcaacgccatcgacatcgaagaaccctccggccaaaccgccgactggtacaccataggagtatacgtaatcggattcacgctccccattatcctcaaagccctatacatgctatccacacgcggccgccaaaccgtcaaagaaaacaaaggcacccggatccgcttcaaagacgacacctcgttcgaagacatcaacggaatacgcagacctaaacacctctacgtctcaatgcccaccgctcaatctaccatgaaagccgaggaactaacacccgggcgatttcgaaccatcgtctgcggcctgttccccacccaaatccaagtacgaaacatcatgtcgcccgttatgggcgtcatcggattctccttcttcgtcaaagactgggccgacagaatccgagagttcatggaaaaagaatgccccttcatcaaaccagaagtcaaacccggcacacccacccaagaaatcgagttccttaagaaaaacaaagtatacttcatggacagacaaaacgtcctcgacaaaaaccacgtcgccgacatcgataaactcatcgactacgccgcctccggcgaccccacctcccccgacaacatcgaatcccccaacgccccctgggtcttcagctgcgcaccagaccgctgcccaccaacctgcatatacgtcgccggcatggcagaactcggcgcatttttctccatcctccaagacatgcgaaacaccatcatggcatccaagacagtcggcaccgccgaagaaaaactaaagaagaaatccagcttctaccaatcctacctacgcagaacccaaagcatgggcatacaactagaccaacgcatcatcctcttatacatgctcgaatggggcaaagaaatggtcgaccactttcacctaggagacgacatggaccccgaactccgcggcctcgcacaagcactaatcgaccaaaaagtcaaagaaatctccaaccaggaccccctaaaaatataa

SEQ ID NO: 7847 - RNA, 1302 nt, synthetic construct
  misc_feature 1..1302: note = derived and/or modified CDS sequence (opt11) from PUUV(Kamiiso-8Cr-95)__AB010730.1__N
  source 1..1302: mol_type = other RNA
atgtctgacctaaaagacatacaagaagacatcacccgccacgaacaacaactcgtagtagcacgccaaaagctccgagacgcagaaaaagccgtcgaaatggaccccgacgacgtcaacaaaaacaccctccaagcccgacaacaaaccgtctcagcactagaagacaaactagcagacttcaaacgtcgcatggccgacgtcgtatcccgaaagaaaatggacaccaaaccagccgaccccacgggaatagaaccagacgaccacctcaaagaacgctcctccctacgctacggaaacgtcctcgacgtcaacgccatcgacatagaagaacccagcggccaaacagccgactggtacaccatcggggtctacattatcggattcaccctccccatcatcctcaaagccctatacatgctctcaacccgaggccgacaaacagtcaaagaaaacaaaggaacccgcatacgcttcaaagacgacacatccttcgaagacataaatggcatacgccgccccaaacacctctacgtcagcatgcccaccgcccagtcaacaatgaaagccgaagagatcacccccggacgcttccgcacaatcgtctgcggcctcttccccacacaaatccaagtccgcaacatcatgagccccgtcatgggagtcataggcttctccttcttcgtcaaggactggccagaacgaataaaagagttcatggaaaaagaatgccccttcatcaagcccgaagttaagcccggcaccccagccaaagaagtggaaatcctcaaacgcaacaaagtctacttcatgcaacgccaagacgtactcgacaaaaaccacgtccccgacattgacaaactaatcgactacgccgcatcgggcgacccaacctcacccgacaacatcgacagccccaacgccccctgggtcttcgcctgcgccccagaccgatgcccacccacatgtatatacgtggccggcatggcagaattaggcgccttcttcagcatcctacaagacatgcgcaacacaatcatggcctccaaaaccgtaggaaccgccgaagaaaaactgaaaaagaaaagctccttctaccaatcctacctccgcagaacccaatccatgggcatccaactcgaccaaagaataatcctcctgtacatgctagaatggggcaaagagatggtcgaccacttccacctcggcgacgacatggaccccgaactccggggcctcgcccaagcactaatagaccaaaaagtcaaagaaatatccaaccaggaacccctcaaaatctaa

SEQ ID NO: 7848 - RNA, 1302 nt, synthetic construct
  misc_feature 1..1302: note = derived and/or modified CDS sequence (opt11) from PUUV(Mu/07/1219)__KJ994776.1__N
  source 1..1302: mol_type = other RNA
atgtccgacctcaccgacatacaagaagacataacccgccacgaacagcaactggtagtggcccgccaaaaactaaaagacgccgaaaaggccgtggaaatggaccccgacgacgtaaacaaaaacaccctccaagctagacaacaaacggtctcagccctagaagacaaactagcagactacaaacgccgcatggccgacgcagtctcacgaaagaaaatggacaccaaacccacagacccaaccggcatagaaccagacgaccacctaaaagaacgatccagcctccgctacggcaacgtcctcgacgtcaacgcaatcgacatagaagaaccaagcggccaaaccgccgactggtacaccatcggcgtttacgtcatcggcttcaccctaccaataatccttaaagccctatacatgctctcaacccgcggccgccaaaccgtcaaagaaaacaaagggaccagaatcagattcaaagacgacaccagcttcgaagacatcaacggcatcagaagaccaaaacacctatacgtctccatgccgacagcccaatcaaccatgaaagcagaagaacttacccccggacgcttcagaaccatcgtatgcggcctgttcccaacccaaatccaggtccgaaacatcatgagcccagtcatgggagtaatcggattctccttcttcgtaaaagactgggccgaacgcatccgcgagttcatggaaaaagaatgtccattcataaaacccgaagtaaaacccggaacgcccgcccaagaagcggagttcctcaaacgcaacaaagtctacttcatgcaacgccaagacgttctcgataaaaaccacgtagccgacatagacaaactcatagattatgcagcctctggcgaccccacctccccagacaacatcgaaagccccaacgccccctgggtcttcgcatgcgcccccgaccgatgcccacccacatgcatatacgtcgccggaatggcagaactcggagcattcttcagcatcctccaagacatgcgcaacaccatcatggcatccaaaaccgtcggcacagcagaagaaaaactcaaaaagaaatccagtttttaccaatcctacctgcgcagaacccaaagcatgggcatacaactcgaccaacgcatcatactcctctacatgctcgaatggggaaaagaaatggtcgatcacttccacctcggcgacgacatggaccccgaactaagaggactagcccaagccctaatcgaccaaaaggtcaaagaaatctcaaaccaagaacccctgaagatctaa

SEQ ID NO: 7849 - RNA, 1302 nt, synthetic construct
  misc_feature 1..1302: note = derived and/or modified CDS sequence (opt11) from PUUV(Opina916)__AF294652.1__N
  source 1..1302: mol_type = other RNA
atgtccgacctcaccgacatacaagaagacataaccagacacgaacaacaactcgtcgtcgcccgccaaaaactaaaagacgcagaaaaagccgtcgaaatggaccccgacgacgtcaataaaaacaccctccaagcacgacaacaaaccgtatcggccctcgaagacaaattagccgacttcaaacgccgaatggcggacgccgtctcaagaaaaaaaatggacacaaaacccgtagacccaaccggcatcgaacccgacgaccatctaaaagaacgaagctctctaagatacggcaacgtactcgacgtcaacgccatcgacatcgaagagcccagcggccaaacagccgactggtacaccatcggcgtctacgtcatcggattcaccctccccataatcctaaaagccctatacatgctctccacacgcggccgacaaaccgtcaaagaaaacaaaggcaccagaatcagattcaaagacgacaccagtttcgaagacataaacggaatacgcagaccaaaacacctttacgtctcaatgcccaccgcacaatccaccatgaaagccgaagaactcacccccggccgcttccgcaccatcgtatgcggactattcccaacccaaatccaagtccgcaacataatgagccccgttatgggcgtaataggcttctccttcttcgtcaaagactgggccgaacgcatccgagaattcatggaaaaagaatgcccattcataaagcccgaagtgaaacccggaaccccagcgcaagaagccgaattcctcaaaaaaaaccgcatctacttcatgcaacgccaggaagtcctagacaaaaatcacgtggccgacatcgacaaacttatcgactacgcagcctccggagacccaacatccccagacaacatcgaatccccaaacgccccatgggtattcgcctgcgcccccgaccggtgcccccccacctgcatctacgtcgccggcatggcagaactcggcgccttcttctcaatcctccaagacatgcgcaacaccatcatggcaagcaaaaccgtcggcaccgccgaagaaaaactcaaaaaaaaatcctccttctaccaatcctacctccggcgaacacaaagcatgggcatccagctagaccaacgcataattctactctacatgctcgaatggggcaaagaaatggtcgaccacttccacctcggagacgacatggaccccgaactccgaggcctcgcccaagcactaatcgaccaaaaagtcaaagaaatctcaaaccaagaaccactaaaaatctga

SEQ ID NO: 7850 - RNA, 1302 nt, synthetic construct
  misc_feature 1..1302: note = derived and/or modified CDS sequence (opt11) from PUUV(Palbole_98-1)__AM746327.1__N
  source 1..1302: mol_type = other RNA
atgagcgacctcacggacattcaggaagacatcacatgccacgaacaacaactcgtcgtcgcccgccaaaaactcaaagacgccgaaaaagccgtagaaatggaccccgacgacgtcaacaaaaacacactccaggcccgtcaacaaaccgtcagcgcactcgaagacaaactagccgacttcaaacgccgcatggcagacgccgtatccagaaaaaaaatggacaccaaacccaccgaccccaccggcatcgaaccagacgaccacctcaaggaaagatcgtctctccgctacggcaacgtcctagacgtcaacgccatagacatcgaagaaccctccggacaaacagccgactggtacaccatcggagtctacgtcatcggcttcactctcccaatcatactcaaagccctatacatgctctccacaagaggacgccaaaccgtcaaagaaaacaaaggcaccagaatcaggttcaaagacgatacctccttcgaagacatcaacggcatacgccgccccaaacatctttacgtctcaatgcccaccgcacaatccacaatgaaagccgaagaactcacacccggacgcttccgcaccatagtctgcggcctattccccacacaaatccaagtccgcaacatcatgtccccagtcatgggcgtcataggcttcagtttcttcgtcaaagactgggcagaccgaatcagagaattcatggaaaaagaatgccccttcataaaacccgaagtcaagccaggcaccccaactcaagaaatcgaattcctcaaaaaaaacaaagtctacttcatggaccgccaaaacgtactcgacaaaaaccacgtcgccgacatcgacaaactcatcgactacgccgcaagcggcgaccccaccagccccgacaatatagaatcccccaacgccccctgggtattcgcctgcgcccccgaccgctgccccccgacctgcatctacgtcgccggcatggcagaactaggagccttcttcagcatcctacaagacatgcgcaacaccataatggctagcaaaaccgtcggcaccgcagaagaaaaactcaaaaaaaagagcagcttctaccaatcgtacctccgacgaacccaaagcatgggcatacaactagaccaacgaatcatcctcctctacatgctcgaatggggaaaagaaatggtggaccacttccacctaggagacgacatggaccccgaactccgcggactcgcccaagccctcatcgaccagaaagtaaaagaaatatcaaaccaggacccactcaaaatataa

SEQ ID NO: 7851 - RNA, 1302 nt, synthetic construct
  misc_feature 1..1302: note = derived and/or modified CDS sequence (opt11) from PUUV(Palbole_98-2)__AM746328.1__N
  source 1..1302: mol_type = other RNA
atgtcagacctcaccgacatacaagaagacatcacccgccacgaacaacaactcgtcgtagcccgccaaaagctaaaagacgctgaaaaagcagtcgaaatggaccccgacgacgtcaacaaaaacaccctccaagcccgccaacaaaccgtttccgccctggaagacaaactagccgacttcaaacgccgcatggccgacgccgtatcccgcaagaaaatggacaccaaacccaccgaccccaccggcatagaacccgacgaccacctcaaagaacgctcatccctccgatacggaaacgtcttagacgtcaacgctatcgacatcgaagaacccagcggccaaacagccgactggtacaccatcggagtatacgtcatcggcttcacactacccatcatcctcaaagcactctatatgctttccacacgcggccgacaaacagtcaaagaaaacaaaggaacacgcatccgattcaaagacgacacctccttcgaagacatcaacggcatacgacgccccaaacacctatacgtctccatgcccacagcacaatccaccatgaaagccgaagaactgacccccggccgcttccgcacaatcgtatgcggcctcttccccacccaaatccaagtccgaaacataatgtcaccagtcatgggagtcatcggcttctccttcttcgtaaaggactgggccgaccgcatacgcgagttcatggaaaaagaatgccccttcatcaaacccgaagtaaaacccggcaccccaacccaagaaatcgagttcctgaagaaaaacaaagtatacttcatggaccgccaaaacgtcctagacaagaaccacgtcgcggacatcgacaaactcatcgactacgccgcctccggagatccaacctccccagacaacatcgaaagccccaacgccccatgggtcttcgcctgcgccccagaccgatgccctccaacctgcatttacgtagccggcatggccgaactcggcgcattcttttccatactacaagacatgcgaaacaccatcatggcatcaaaaaccgtaggcacagccgaagaaaaactcaaaaagaaatccagcttctatcaatcctacctacgccgaacccaatcaatgggaatacaactagaccaacgcataatcctactttacatgctagaatggggcaaagaaatggtagaccacttccacctcggcgacgacatggaccccgaactcagaggattcgcccaagccctcatcgaccaaaaagtcaaagaaatcagcaaccaagaccccctaaagatataa

SEQ ID NO: 7852 - RNA, 1302 nt, synthetic construct
  misc_feature 1..1302: note = derived and/or modified CDS sequence (opt11) from PUUV(Palbole_98-3)__AM746329.1__N
  source 1..1302: mol_type = other RNA
atgtccgacctaaccgacatccaagaagacataacccgacacgaacaacaactcgtcgtcgcccgccaaaaactcaaagacgccgaaaaggccgtagaaatggaccccgacgacgtcaacaaaaacaccctccaagcccgacaacagacagtatccgcactggaagacaaactagccgacttcaaacgacgcatggcagacgccgtctcccgcaaaaaaatggacaccaagcccaccgaccccacggggatcgaaccagacgaccacctgaaagaacgcagcagcctacgctacggaaacgtcctagacgtcaacgccatcgacatagaagaaccctccggccagaccgcagactggtacaccatcggagtctacgtaatcggattcaccctcccaataatcctaaaagccctatacatgctatcaacccgcggcagacaaaccgtgaaagaaaacaaaggcacccgcataagattcaaagacgacacttccttcgaagacatcaacggaatcagacgccccaaacacctctacgtctccatgccgacagcccaatccaccatgaaagccgaagaactaacccccggacgcttccgcaccatcgtgtgcggcctcttcccgacacaaatacaagtaagaaacataatgtcacccgtcatgggcgtcatcggcttctccttcttcgtcaaagactgggcagaccgaatcagagaattcatggaaaaagaatgccccttcatcaaaccagaagtcaaacccggcacacccacccaagaaatcgaattcctcaaaaaaaacaaagtctacttcatggaccggcaaaacgtactcgacaaaaaccacgtggccgacatcgacaaactaatcgactacgccgcatccggcgacccaacctcccccgactccatcgaatcaccgaacgcaccttgggtgttcgcctgcgccccagacagatgcccgcccacatgcatctacgtcgccggaatggcagaactcggagccttcttcagcatcctccaagacatgcgcaacaccatcatggccagcaagaccgtaggaacggccgaagaaaaactcaaaaaaaaatcaagtttctatcaatcctacctacgacgcacccaatccatgggaatccaactcgaccaacgaataatcctcctatatatgctagaatgggggaaagaaatggtcgaccacttccacctaggagacgacatggaccccgagctccgcggactagcacaagcactgatcgaccagaaagtcaaagaaatctccaaccaagacccgctcaaaatctaa

SEQ ID NO: 7853 - RNA, 1302 nt, synthetic construct
  misc_feature 1..1302: note = derived and/or modified CDS sequence (opt11) from PUUV(PUUV/Ardennes/Mg156/2011)__KT247592.1__N
  source 1..1302: mol_type = other RNA
atgagcgacctcaccgacatccaagaagacatcacaagacacgaacaacaactcgtcgtcgcacgacagaaactcaaagacgccgaaaaagccgttgagatggaccccgacgacgtcaacaaaaacacactccaagcacgacaacaaacggtatcagccctcgaagacaaactcgcagacttcaaacgacaaatggccgacgccgtatcacgcaagaaaatggacaccaaacccaccgaccccaccggcatcgaaccagacgaccacctcaaagaacgctcatcactgcgctacggcaacgtactagacgtcaacgccatcgacatcgaagaaccctccggacagaccgccgactggtacaccatcggcgtctacgtcatcggcttcaccctacccatcatcctcaaagccctatacatgctctcaacccgaggccgacaaaccgtcaaagaaaacaaaggaaccagaatccgattcaaagacgacacttccttcgaagacatcaacggcattcgacgccccaaacacctctacgtctcaatgccaaccgcccaatccaccatgaaagccgaagaactaacacccggacgcttccgcaccatcgtgtgcggcctctttcccactcaaatccaagtccgaaacatcatgagccccgtcatgggagtaatcggattctcattcttcgtcaaagactgggccgaccgaatccgcgagttcatggaaaaagaatgccccttcataaaacccgaagtcaaacccggaacccccgcacaagaagtcgagtttctcaaacgcaacaaaatctacttcatgcagcgccaagacgtcctcgacaaaaaccacgtcgccgacatcgacaaactaatcgactacgccgcctcgggcgacccaaccagccccgacaacatcgaagcgcccaacgcaccctgggtattcgcatgcgcccccgaccgatgcccaccaacctgcatatacgtcgcaggaatggccgaactcggagcattcttctccatcctacaagacatgcgcaacaccatcatggcgtccaaaaccgtcggcacagcagaagaaaaactcaaaaagaaaagctcgttctatcaaagctacctccgcagaacccaatcaatgggcatacaactcgaccaacgaataatcctcctctacatgctggaatggggaaaagaaatggtagaccacttccacctaggagacgacatggatcccgaactgcgcggactcgcacaagcgctaatcgaccaaaaagtcaaggaaatcagcaaccaagaacccctcaaaatctaa

SEQ ID NO: 7854 - RNA, 1302 nt, synthetic construct
  misc_feature 1..1302: note = derived and/or modified CDS sequence (opt11) from PUUV(PUUV/Jelgava/Mg136/2008)__JN657230.1__N
  source 1..1302: mol_type = other RNA
atgtcagacctcgccgacatccaagaagacataacccgacacgaacaacaactagtcgtcgcccgccaaaaactcaaagacgccgaacgagccgtagaagtagaccccgacgacgtcaacaaaaacaccctgcaagcccgccaacaaacagtctccgcactcgaagacaaactcgcagactacaaacgtcgcatggccgacgccgtctcaagaaaaaaaatggacaccaaaccagcagaccccaccgggattgaacccgacgaccacctaaaagaacgcagcagcctccgctacggaaacgtcctcgacgtaaacgcaatagatatcgaagaacccagcggccaaacggccgactggtacaccatcggcgtctacgtaatcggattcaccctcccaatcatcctcaaagcactctacatgctctccacaagaggccgccaaacagtaaaagagaacaaaggcacccgcatacgattcaaggacgacaccagcttcgaagacataaacggaatacgccgccccaaacacctctacgtctcaatgcccacagcgcaaagcaccatgaaagcagaagaactaacccccggccggttccgcactgtagtctgcggcctcttcccaacacaaatacaagtccgaaacataatgtccccggtcatgggagtcataggcttcagcttcttcgtcaaagactggcccgacagaataaaagaattcatggaaaaagaatcaccattcatcaagcccgacgtcaaacccggcaccccagctcaagaagtcgaattcctcaaaaggaacaaagtctacttcatgaaccgccaagacgtcctcgacaagaaccacgtagccgacatcgacaagctaatcgactacgccgcctccggcgaccccacatcacccgacgacatcgaaagccccaacgcaccatgggtcttcgcctgcgcaccagaccgctgcccccccacatgcatctacgtcgccggaatggccgaactgggcgcattcttctccatccttcaggacatgcgaaacacaatcatggccagcaagaccgtcggcacggccgaagaaaaactaaaaaaaaaaagctcattctaccaatcatacctccgccgcacccaatcaatgggcatacaactagaccaacgaatcatcctcctatacatgctcgaatggggcaaagaaatggtcgaccacttccacctcggagacgacatggacccagaactgcgagggctagcacaagccctcatcgaccaaaaagtaaaagaaatcagcaaccaagaaccactcaagatctaa

SEQ ID NO: 7855 - RNA, 1302 nt, synthetic construct
  misc_feature 1..1302: note = derived and/or modified CDS sequence (opt11) from PUUV(PUUV/Jelgava/Mg140/2008)__JN657231.1__N
  source 1..1302: mol_type = other RNA
atgagcgaccttgcagacatccaggaagacatcaccagacacgaacaacagctagtagtcgcacgccaaaaactcaaagacgcggaacgcgccgtagaagtcgaccccgacgacgtaaacaaaaacaccctacaagcccgccaacaaactgtatccgccctagaagacaaactcgccgactacaaaagacgaatggccgacgccgtatcccgaaagaaaatggacaccaaacccgccgaccccacaggcatcgaacccgacgaccacctcaaagagcgatcatccctacgctacggcaacgtcctcgacgtcaacgccatagacatagaagaacccagcggacaaactgccgactggtataccatcggagtctacgtcatcggcttcaccctccccatcatcctaaaagcactatacatgctctccacacgcggacgccaaaccgtcaaagaaaacaagggcacccgcatccgcttcaaagacgacacatccttcgaagacataaatggcatccgccgacccaagcacctctacgtctccatgcccacagcacaatccaccatgaaagccgaagaactcacacccggccgcttcagaactgtcgtctgcggcctcttccacacccaaatacaagtccgaaacatcatgagccccgtcatgggagtaatcggcttctccttcttcgtcaaggactggccagaccgcatcaaagagttcatggaaaaggaatgccccttcatcaaacccgacgttaaacccggcacccccgcccaagaagtcgagttcctcaaacgcaacaaagtctacttcatgaaccgacaagacgtcctcgacaagaaccacgtcgctgacatcgacaaactaatcgactacgccgcatccggtgaccccaccagccccgacgacatagaatcccccaacgccccctgggtctttgcatgcgcaccagaccgatgcccgccaacctgcatctacgtagcaggaatggccgaactaggagcattcttctcaatactccaagacatgcgcaacaccatcatggcctcaaaaacagtcggcaccgccgaagaaaaactcaaaaagaaatcctcattctaccaatcatacctacgccgcacccagtccatgggcatacaactagaccaacgcataatcctgctttacatgctcgaatggggcaaagaaatggtcgaccacttccatctaggcgacgacatggatcccgaactcagaggccttgcccaagctctcatcgaccaaaaagtcaaagaaatctccaaccaagagcccctaaaaatctaa

SEQ ID NO: 7856 - RNA, 1302 nt, synthetic construct
  misc_feature 1..1302: note = derived and/or modified CDS sequence (opt11) from PUUV(PUUV/Jura/Mg2/2010)__KT247596.2__N
  source 1..1302: mol_type = other RNA
atgtcagacctcacagacatacaagaagacatcacacgccacgaacaacaactcgtcgtagcccgccaaaagctcaaagacgccgaaaaagccgtagagatggaccccgacgacgtcaacaaaaacaccctccaagcccgccaacaaaccgtctccgccctagaagacaaactagcagacttcaaacgaagaatggccgacgccgtatcccgcaaaaaaatggacactaaaccaaccgacccaacgggcatcgaacccgatgaccacctcaaagagcgctcctccctcagatacggcaacgtcctcgacgtcaacgccatcgacatagaagagccctcgggccaaaccgcggactggtacacaatcggcgtctatgtcataggcttcaccctcccaatcatcctcaaagccctctacatgctctcaaccagaggtcgacaaaccgtaaaagaaaacaaaggcacccgcatacgattcaaagacgacacctccttcgaagacatcaacggcatccgacgacccaaacacctatacgtatcgatgccaacagcccaatcaaccatgaaagccgaagaactcacaccaggccgcttccgcaccatcgtctgcggccttttccccacacaaatccaagtccgcaacatcatgagcccagtcatgggcgtcatcggcttcagcttcttcgtcaaagactgggcagaccgcatccgcgaattcatggaaaaagaatgccccttcattaaacccgaaatcaaacccggaacccccgcacaagaagcagaattcttaaaacgcaacaaaatctactttatgcaacgccaagacgtcctcgataaaaaccacgtcgccgacatcgacaaactcatcgactacgccgcatccggcgacccgaccagcccagacaacatcgaaagccccaacgccccatgggtcttcgcctgcgccccagaccgctgcccccccacctgcatctacgtagccggcatggcagaactcggcgccttcttctccatactccaagacatgcgcaacaccatcatggccagcaaaaccgtcggcacagccgaagagaaactaaaaaaaaaaagctcattctaccaaagctacctacgccgcacacaaagcatgggaatccaactcgaccagcgcatcatcctcctctacatgctcgaatggggcaaagaaatggtagaccacttccacctaggcgacgacatggaccccgaacttcgtggactcgcacaagcactcatagaccaaaaagtcaaagaaatctccaaccaagaacccctcaaaatctaa

SEQ ID NO: 7857 - RNA, 1302 nt, synthetic construct
  misc_feature 1..1302: note = derived and/or modified CDS sequence (opt11) from PUUV(PUUV/Madona/Mg233/2008)__JN657232.1__N
  source 1..1302: mol_type = other RNA
atgtcagacctcgccgacatacaagaagacatcacgcgccatgaacaacaacttgtcgtcgcacgacaaaaactcaaagacgcagaacgcgctgtagaagtcgaccccgacgatgtcaacaaaaacaccctccaagcccgccaacaaaccgtatctgccctagaagacaaactcgccgactacaaacgaagaatggccgacgccgtatcacgcaagaaaatggacacgaaaccgaccgaccccaccggaatcgaacccgacgaccacctaaaagaacgcagctccctaagatatggcaacgtcctagacgtcaacgcaatcgatatcgaggaaccctccggccaaaccgccgactggtacacaataggcgtctacgtcatctccttcacactccccatcatcctcaaagccctctacatgctatctacccgaggtcgccaaacagtaaaagaaaacaaaggcacacgcatccgattcaaagacgacaccagcttcgaggacatcaacggcatccgccgcccaaaacacctatacgtatcaatgcccaccgcccaatccaccatgaaagcggaagaactcacccccggacgattccgaaccatcgtatgcggactattccccacccagatccaagtcagaaacataatgtcaccagtcatgggcgtcatcggcttctcctttttcgtcaaggactggcccgaccgcatcaaagagttcatggaaaaagaatgccccttcataaaaccagacgtcaaacccggaacccccgcccaagaaatagagttcctcaaacgtaacaaagtctactttatgaaccgacaggacgtcctagacaaaaaccacgtcgccgacatcgacaagctcatcgactacgccgcctcaggcgaccccaccagcccagacgacatagaaagccccaacgccccatgggtattcgcttgcgccccagatcgatgtcccccaacctgcatatacgtagccggaatggcagaactcggcgcattcttcagcatccttcaagacatgcgaaacaccatcatggcaagcaaaaccgtaggcaccgccgaagaaaaactcaaaaagaaatccagcttctaccaatcctatctgcgccggacccaatccatgggcatccaactcgaccagcgaatcatcctactctacatgttagaatggggcaaagaaatggtcgaccacttccacctaggcgacgacatggacccagaactccgcggcctcgcccaagccctcatcgaccaaaaagtaaaagagatctccaaccaagaacccctcaaaatctag

SEQ ID NO: 7858 - RNA, 1302 nt, synthetic construct
  misc_feature 1..1302: note = derived and/or modified CDS sequence (opt11) from PUUV(PUUV/Orleans/Mg23/2010)__KT247594.1__N
  source 1..1302: mol_type = other RNA
atgtccgacctaaccgacatccaagaagtaataacccgacatgaacaacaactcgtcgtagcccgccaaaagctcaaagacgccgaaaaggcagtcgaaatggaccccgacgacgtcaacaaaaacaccctccaagcccgccagcaaaccgtcagcgccctagaagacaagctagctgacttcaaacgcagaatggccgacgccgtctcccgtaagaaaatggacaccaaaccggcagaccccaccggcatcgaaccagacgaccacctaaaagaaagatcctccctccgctacggaaacgtccttgacgtaaacgcaatcgacatcgaagaaccctccggccaaacagccgactggtacaccatcggcgtgtacgtcataggcttcacccttcccatcatactcaaagccctatacatgctttccaccagaggccgccaaacggtcaaagaaaacaaaggcacacgaatacgcttcaaagacgacacatcattcgaagacatcaacggaatacgccgaccgaaacatctctacgtctcaatgcccaccgcccaaagcaccatgaaagccgaagaactcacacccggacgcttccgcacaatcgtctgcggactattccccacccaaatccaagtacgcaacataatgagccccgtcatgggagtcatcggcttctcattcttcgtaaaagactgggccgaccgcatcaaagagttcatggaaaaagaatgcccctttatcaagcctgaagtcaaacccggtaccccagtaaaagaagccgagttcctcaagaaaaaccgcgtctacttcatgcaacgccaagacgtactcgacaaaaaccacgtcgcagacatcgacaaacttatcgactacgctgccgccggagaccctaccagccctgacaatatagaaagcccaaacgcaccctgggtcttcgcctgcgcaccagaccgctgcccacccacgtgcatctacgtcgccggcatggccgaactaggcgccttcttctccatactacaagacatgcgcaacacaatcatggcctcaaaaaccgtaggcaccgcagaagaaaaactgaagaagaaaagctcattctaccaatcctacctccgacggacccaaagcatgggcatacaactcgaccaacggatcatcctcctatacatgctagaatggggaaaagaaatggtagaccactttcacctaggagacgacatggaccccgaactacgaggcctcgcacaagcactcatcgaccaaaaagtaaaagaaatctcgaaccaagaacccctcaaaatctaa

SEQ ID NO: 7859 - RNA, 1302 nt, synthetic construct
  misc_feature 1..1302: note = derived and/or modified CDS sequence (opt11) from PUUV(Tobetsu-60Cr-93)__AB010731.1__N
  source 1..1302: mol_type = other RNA
atgtccgacctcaaagacatccaagaagacatcacccgccacgaacaacaactcgtcgtagcccgacaaaaactacgcgacgcagaaaaagccgtagaaatggaccccgacgacgttaataagaacaccctacaagcacgccaacaaaccgtcagcgccctcgaagacaaactggcagacttcaaacgacgcatggcagacgtagtctcacgtaagaaaatggacaccaaacccgccgaccccaccggaatcgaacccgacgaccacctcaaagaccgctcatcactacgctacggaaacgtactcgacgtcaacgcgatcgacatagaagaacccagcggccaaacagccgactggtacacaatcggcgtatacataatcggcttcaccctcccaatcatactcaaagccctgtacatgctcagcacccgcggtcgccaaaccgtcaaagaaaacaagggcacccgaatccgcttcaaagacgacacctcgttcgaagacatcaatggcatccgccgcccaaaacacctctacgtctccatgccaaccgcccaatccaccatgaaagccgaagaaatcacaccaggccgcttcagaaccatagtctgcggcctctttcccacacaaatacaagtccggaacatcatgagccccgtcatgggagtaatcggattctccttcttcgtaaaagactggcccgaacgcatcaaagagttcatggaaaaagaatgccccttcataaaacccgaagtaaaacccggcacccccgctaaagaagtagaaatcctaaaacgaaacaaagtctacttcatgcaacgacaagacgtcctcgacaaaaaccacgtccccgacatcgacaaactaatcgactacgccgcctccggagaccccacatccccagacaacatcgacagccccaacgcaccctgggtattcgcctgcgcccccgacagatgccctccaacctgcatatacgtcgcaggcatggcggaactcggtgccttcttcagcatcctacaagatatgcgcaacaccatcatggcctcaaaaaccgtaggcaccgccgaagaaaaactcaaaaagaaatcatctttctaccaatcctacctacgacgaacccaatccatgggcatccagctagaccaacgcatcatactcctttacatgctagaatggggaaaagaaatggtagaccactttcatctcggcgacgacatggaccccgaactacgcgggctcgcccaagcactaatcgaccaaaaggtaaaagaaatctcaaaccaagaacccctcaaaatctaa

SEQ ID NO: 7860 - RNA, 1302 nt, synthetic construct
  misc_feature 1..1302: note = derived and/or modified CDS sequence (opt11) from PUUV(Vranica)__U14137.1__N
  source 1..1302: mol_type = other RNA
atgtccgacctcacagacatacaagaagacatcacacgacacgaacagcagctagtcgtcgccagacaaaaactcaaagacgccgaaaaagcagtcgaaatgtacccggacgacgtaaacaaaaacaccctccaagcaagacaacaaaccgtctccgccctggaagacaaactagcagacttcaagcgccgaatggccgacgcagtcagccgcaagaagatggacacaaaacccaccgaccccacgggcatcgaacccgacgaccacctcaaagaacgaagcagcctaagatacggcaacgtcctcgacgtgaacgccatagacatcgaagaacccagcggccaaaccgcagactggtacaccataggcgtatacgtcataggattcaccctcccgataatactcaaagcactgtacatgctatcaacacgcggcagacaaaccgttaaagaaaacaaaggaacacgataccgcttcaaagacgacaccagcttcgaagacatcaacggcatccgccgcccaaaacacctatacgtcagcatgcccaccgcacaatccaccatgaaagcagaagaactaaccccaggaaggttccgcacaatcgtctgcggcctattccccacccaaatacaagtaagaaacatcatgagccccgtcatgggcgtcatcggcttcagcttcttcgtcaaagactgggcagaccgcatccgcgagttcatggagaaagaatgccccttcatcaaaccagaagtcaaacccggcacccccacccaagaaatcgagtttctcaagaaaaacaaagtctacttcatggaccgccaaaacgtgctcgacaagaaccacgtagcagacatagacaaactcatagactacgccgcatccggcgaccccaccagcccagacaacatcgaatcaccaaacgccccctgggtcttcgcctgcgcacccgaccgatgtcccccaacctgcatctacgtagccggcatggccgaactcggcgccttcttctccatcctacaagacatgcgcaacacaatcatggcgtccaaaaccgtgggcaccgccgaagaaaaactcaaaaagaaatcatccttctaccaatcctacctccgcagaacacaatccatgggaatacaactcgaccaacgaataatcctactatacatgctcgaatggggcaaagaaatggtagaccacttccacctcggcgacgacatggaccccgaactccgtggactcgcccaagccctaatcgaccaaaaagtcaaagaaatatccaaccaagaccccctgaagatataa

SEQ ID NO: 7861 - RNA, 1302 nt, synthetic construct
  misc_feature 1..1302: note = derived and/or modified CDS sequence (opt11) from PUUV(P360)__L11347.1__N
  source 1..1302: mol_type = other RNA
atgtcagacctgaccgacatccaagaagaaatcacccggcacgagcaacaacttgtcgtagccaggcaaaaactcaaagacgcagaacgagccgtcgaagtctaccccgatgacgttaacaaaaacaccctgcaagcccgacaacaaaccgtatcagccctagaagacaaacttgcagactacaaacgccgaatggcagacgcagtatcccgcaagaaaatggacaccaaaccgactgaccccacaggcatagaacccgacgaccacctaaaagaaagatcatccctacgctacggaaacgtcctcgacgttaacgccatcgatatcgaagaacccagcggccaaaccgccgactggtacaccataggcgtgtatgtgatcggcttcacaataccaataatactaaaagcactatacatgctctcgacacgcggccgtcaaaccgtaaaagaaaacaaaggcaccaggatacgattcaaagacgacacctccttcgaagacatcaacggcatccgacgacccaaacacctctacgtcagcatgcccaccgcccaatctacaatgaaagccgaggaactaacccccggccgattccgcaccatcgtctgcggcctcttcccaacacaaatccaagtccgaaacataatgagccccgtaatgggcgtcatcggcttctcattcttcgtcaaagactggccagaaaagatccgcgagttcatggaaaaagaatgcccattcatcaaacccgaagtcaaaccaggcaccccagcccaagaagtcgagttcctcaaacgaaaccgcgtctacttcatgacgcgacaagacgtcctagacaagaaccacgtcgccgacatcgacaaactcatagattacgccgcatcaggagaccccacctccccagacgacatagaatccccgaacgccccatgggtgttcgcctgcgcaccagaccgatgcccacccacttgcatatacgtcgccggcatggcagaactcggcgcattcttctccatcctccaagacatgagaaacaccatcatggcctccaaaaccgtcggcacagccgaagaaaaactcaaaaagaaatcctccttctaccaatcatacctccggagaacacaatcaatgggcatacaactcgaccaacgtatcatcctactctacatgctagaatggggcaaagaaatggtagaccacttccacctcggggacgacatggaccccgaactacgcggcctcgcccaatccctcatagaccaaaaagtcaaagaaatctcaaaccaagaaccgctaaaaatctag

SEQ ID NO: 7862 - RNA, 1302 nt, synthetic construct
  misc_feature 1..1302: note = derived and/or modified CDS sequence (opt11) from PUUV(Aijajarvi/Mg7/05)__GQ339476.1__N
  source 1..1302: mol_type = other RNA
atgtccgacctcaccgacatccaagaagacataacacgacacgaacaacagctagtcgtcgcacgacaaaaactcaaagacgcagaaaaagccgtcgaaatggacccagacgacgtaaataaaaacacactccaagcacgccaacaaacagtctcagccctcgaagacaaactcgccgacttcaagcgccaaatggcagacgccgtatcccgcaagaaaatggacacaaaaccaaccgaccccaccggcatagaaccagacgaccacctaaaagaacgatcctccctacgctacggcaacgtcctagacgtcaacgccatcgacatcgaagaacccagcggccaaacagccgactggtacacaataggagtatacgtcataggcttcacactcccaatcatcctcaaagccctctacatgctctccaccagaggccgacaaacagtcaaagaaaacaaaggaacccgcatccggttcaaagacgacacatccttcgaagacatcaacggcatccgccgcccgaaacacctctacgtctcaatgcccaccgcccaatccaccatgaaagcggaagaactcacaccaggacgcttccgcacaatcgtgtgcggcctcttccccacccaaatccaagtcagaaacatcatgagcccagtcatgggagtcatcggattctccttcttcgtcaaaggatgggcagacagaatccgtgagttcatggaaaaagaatgccccttcataaagcctgaagtcaaacccggcaccccgacccaagaagtcgagttcctcaaaaagaacaaagtctacttcctagatcgccaaaacgtccttgacaaaaatcacgtcgcagacatagacaagctaatcgactacgcagcctccggcgaccccaccagcccagacaacatagaatcccccaacgccccatgggtcttcgcatgcgcccccgaccgatgcccacccacatgcatctatgtagccggaatggccgaactcggagccttcttcagcatcctccaagacatgcgaaacacaataatggcatccaaaaccgtcggcaccgcagaagaaaaacttaaaaagaaaagcagcttctaccaatcctacctacgccgaacccaatccatgggcatccagctcgaccaacgcattatactcctctttatgctcgaatggggaaaagaaatggtcgaccacttccacctcggcgacgacatggaccccgaactacgcggccttgctcaagccctaatcgaccagaaagtcaaagaaatctccaaccaagaacccctcaaaatctag

SEQ ID NO: 7863 - RNA, 1302 nt, synthetic construct
  misc_feature 1..1302: note = derived and/or modified CDS sequence (opt11) from PUUV(Bavaria 151/05)__EU439968.1__N
  source 1..1302: mol_type = other RNA
atgtcagacctcacagacatccaagaagacatcacacgacacgaacaacaactagtcgtcgcccgccaaaaactcaaagacgccgaaaaagccgttgaaatggacccagacgacgtcaacaaaaacaccctccaagcccgccaacagactgtctcagccctagaagacaaactggccgactacaaacgacgcatggccgacgccgtctcccgcaaaaaaatggacaccaaacccacagacccaaccggcatcgaaccagacgaccacctaaaagaacgcagctcactccgctacggaaacgtcctggacgtcaacgccatcgacatagaagaaccgagcggacaaaccgccgactggtacaccatcggagtctacgtcatcggcttcaccctccccatcatactcaaagccctatacatgctctcaacccgcggaagacagaccgtaaaggaaaacaaagggacccggatacgattcaaagacgacacctccttcgaagacatcaacggaatacgccgccccaaacacctttacgtctccatgcccaccgcccaatccaccatgaaagcagaagaactcacaccgggacgcttccgaaccatcgtctgcggcctattccccacgcaaatccaggtacgaaacatcatgtcacccgtcatgggcgtcatcgggttctccttcttcgtcaaggactgggccgaacgcatccgcgaattcatggaaaaagaatgccccttcctaaaacccgaaataaagccaggcacccccgcacaagaagcggaattcctaaaaaaaaacaaagtatacttcatgcaacgccaagacgtcctagacaaaaaccacgtcgccgacatcgacaaactaatagactacgctgcctcaggagacccgacctcccccgacaacatcgaaagccccaacgccccctgggtcttcgcatgcgcgcccgaccgatgcccccccacctgcatatacgtcgccggcatggcagaacttggcgccttcttcagcatcctccaagacatgcgaaacaccatcatggcatccaaaaccgtaggaacagccgaagaaaagctaaaaaaaaaaagctcattctaccagtcgtacctaagacgaacacaaagcatgggcatacaactcgaccaacgaatcatcctactatacatgctggaatggggcaaagaaatggtcgaccacttccacctcggggacgacatggacccagaactccgcggtctcgcacaggcactaatagaccaaaaagtcaaagaaatctccaaccaagagcccctaaaaatctga

SEQ ID NO: 7864 - RNA, 1302 nt, synthetic construct
  misc_feature 1..1302: note = derived and/or modified CDS sequence (opt11) from PUUV(Bavaria 159/05)__EU439972.1__N
  source 1..1302: mol_type = other RNA
atgtcagacctaaccgacatccacgaagacatcacacgccacgaacaacaactagttgtagcccgccaaaaactcaaagacgccgaaaaagcagtcgaaatggacccagacgacgtcaacaaaaacacactccaagcacgccaacaaaccgtctcagccctcgaagacaaattagccgactacaaacgccgcatggcagacgcagtctccagaaaaaaaatggacacaaaacccaccgaccccacaggcatagaacccgacgaccacctaaaagaacgctcgagcctccgctacggcaacgtcctcgacgtcaatgccatagacatagaagaaccaagcgggcaaaccgccgactggtacaccatcggcgtgtacgtaatcggcttcaccctaccaatcatactcaaagccctctacatgctctcgacccgcggcagacaaacagtaaaagaaaacaaaggcacccgcatccgattcaaagacgacacctcattcgaagacatcaacggcatcagacgaccgaaacacctctacgtctccatgccaaccgcacaatcaaccatgaaagcagaagaacttacaccaggccgcttccgaaccatcgtatgcgggctattccccacacagatacaagtccgcaacattatgtcacccgtcatgggtgtcatcggattctccttcttcgtaaaagactgggccgaacgaatccgcgaattcatggaaaaagaatgccccttcataaaacccgaaatcaaaccaggcactccagcacaagaagccgaattcctcaaacgcaacaaagtctacttcatgcagcgccaagacgtcctcgacaaaaaccacgtggcagacatagacaaactcatcgactacgccgcctccggcgaccccacctcccccgacaacatcgaaagccccaacgcgccctgggtattcgcatgcgcccccgacagatgcccacccacctgcatatacgtagccggcatggcagaactaggagccttcttctccatactccaagacatgcgcaacaccatcatggcttcaaaaaccgtcggtaccgccgaagaaaaactcaaaaaaaagagctcattctaccaaagctacctgcgccggacccaatcaatgggcatacaactcgaccaacgcataatcctcctatacatgctagaatggggcaaagaaatggttgaccacttccacctcggcgacgacatggacccagaactacgaggcctcgcccaagcactcatcgaccagaaagtcaaagaaatatccaaccaagaaccactaaaaatctaa

SEQ ID NO: 7865 - RNA, 1299 nt, synthetic construct
  misc_feature 1..1299: note = derived and/or modified CDS sequence (opt11) from PUUV(Bavaria CG 33/04)__DQ016430.2__N
  source 1..1299: mol_type = other RNA
atgtcagacctaaccgacatacaagaagacataacccgacacgaacaacaactcgtcgtagcacgccaaaaactaaaagacgcagaaaaagccgtagaaatggaccccgacgacgtcaacaaaaacaccctccaagcccgccaacagacggtctccgcccttgaagacaaactcgcagactacaaacgacgcatggcagacgcagtctcacgaaaaaaaatggacacaaaacccaccgacccaaccggcatcgaaccagacgaccacctcaaagagcgttcatcactccgctacggaaacgtcctcgacgtaaacgccatcgacatcgaagaaccctccggacaaaccgcagactggtacaccatcggagtatacgtcatcggcttcaccctacccatcatacttaaagccctctacatgctatcaacccgcggacgacaaacggtcaaagagaacaaaggcacccgaatccgctttaaagacgacacctcattcgaagacataaacggcatacgccgccccaaacacctctatgtctcaatgcccaccgcccaatccaccatgaaagcagaagaactcacaccaggccgcttccgcaccatcgtctgcggcctcttccccacccagattcaggtacgcaatatcatgagcccagtcatgggagtaatagggttcagcttcttcgtcaaagactgggccgaaagaatacgagaattcatggaaaaagaatgcccctttatcaaaccagaaataaaacccggcaccccagcccaagaagccgaattcctcaaacgcaacaaagtatacttcatgcaaagacaagacgtgctcgacaaaaaccacgtagccgacatcgacaaactcatcgactacgccgcctccggcgaccccacatctccggacaacatagaaagccccaacgccccgtgggtcttcgcctgtgcccccgaccgctgcccccccacctgcatatacgtcgctggcatggccgaactcggcgccttctccatcctccaagacatgcgaaacaccatcatggcctccaaaacagtaggaacagcggaagaaaaactaaaaaaaaaatcatccttctaccaaagctatctacgtcgaacccaatcaatgggcatccaactcgaccaaagaatcatcctcctatacatgctcgaatggggaaaagaaatggtcgaccacttccacctcggagacgacatggaccccgaactacgcggactcgcccaagcactcatcgaccaaaaagtcaaagagatctcaaaccaagagcccctcaaaatctaa

SEQ ID NO: 7866 - RNA, 1302 nt, synthetic construct
  misc_feature 1..1302: note = derived and/or modified CDS sequence (opt11) from PUUV(Bavaria CG 34/04)__AY954723.2__N
  source 1..1302: mol_type = other RNA
atgtcggacctaaccgacatacaagaagacataacccgccacgaacaacaattggtggtcgcccgccaaaaactcaaagacgccggaaaagctgtagaaatggacccagacgacgtcaacaaaaacactctccaagcccgacaacaaaccgtatcggcactcgaagacaaactagccgactacaaaagacgcatggcagacgcagtctcccgaaagaaaatggacaccaaaccgaccgaccccaccggcatagaacccgacgaccacctcaaagaacgctcctccctccgctacggaaacgtcctcgacgtcaacgcaatcgacatcgaagaaccatccggccaaaccgccgactggtacaccatcggagtctacgtcatcggattcacactcccaatcatactcaaagctctatacatgctcagcacccgcggaagacaaacagtcaaagaaaacaagggcaccagaatacgattcaaagacgacacaagtttcgaagacatcaacggcatccggcgcccaaaacacctctacgtatcaatgccaaccgcccaaagcaccatgaaggcagaagaactgacccccggccgcttccgcaccatcgtctgcggactattcccaacccaaatccaagtacgcaacatcatgtccccagtgatgggcgtcataggattctccttcttcgtcaaagactgggccgaacgcatccgcgagttcatggaaaaagaatgccctttcatcaaaccagaaatgaagccaggcacccccgcacaagaagccgagttcctaaaacgcaacaaagtctacttcatgcaacgccaagacgtcctagacaaaaaccacgtcgcagacatcgacaaactaatcgactatgccgccagcggagacccaaccagccccgacaacatcgaatcccccaacgcgccatgggtcttcgcctgcgcacccgaccgatgcccaccaacctgcatctatgtagcaggcatggcagaactcggcgccttcttcagcatacttcaagacatgcgcaacacaataatggcctccaaaaccgtcggaacagcagaagaaaaactcaaaaagaaatcctcgttctaccaatcatacctccgaagaacacaaagcatgggtattcaactcgaccaacgcatcatactcctatacatgctcgaatggggcaaagaaatggtcgaccacttccacctcggcgacgacatggacccagaactccgcggcctcgcccaagccctcatagaccagaaagtaaaagaaatctccaaccaagaaccactaaaaatctag

SEQ ID NO: 7867 - RNA, 1302 nt, synthetic construct
  misc_feature 1..1302: note = derived and/or modified CDS sequence (opt11) from PUUV(Bavaria CG 41/04)__DQ016432.2__N
  source 1..1302: mol_type = other RNA
atgtccgacctcaccgacatacaagaagacataacccgacacgaacaacaactcgtagtcgcccgccaaaaactcaaagacgccgaaaaagccgtcgaaatggaccctgacgacgtcaacaaaaacacactccaagcccgccaacagacagtctcagccctcgaggacaacctagccgactacaaacgccgcatggccgacgccgtaagccgcaaaaaaatggacaccaaacccaccgaccccaccggcatcgaacccgacgaccacctcaaagaacggtcctccctccgctacggcaacgttctagacgtaaacgccatcgacatcgaagaacccagcggccaaaccgccgattggtacaccatcggcgtttacgtcatcggcttcacactcccaatcatcctcaaagccctttacatgctctcaacccgaggcagacaaaccgtcaaagaaaacaaaggcacccgaatccgcttcaaagacgacacctccttcgaagacataaacgggatccgtcgccccaaacacctctacgtctcaatgccaaccgcacagtcaaccatgaaagccgaagaactcacacccggccgattccgaacaattgtatgcggcctattccccactcaaatacaagtccgaaacatcatgagcccagtaatgggcgtcatcggattctccttcttcgtcaaagactgggccgaacgaatccgcgaattcatggaaaaagaatgccccttcatcaaacctgaaatgaaacccggcacccccgcccaagaagcagaattcctcaaaagaaacaaagtctacttcatgcagcgccaagacgtcctcgacaaaaaccacgtcgccgacatcgacaaactgatcgactacgcagcctccggcgaccccacctcccccgacaatatcgagtcccccaacgccccctgggtcttcgcctgcgcccccgaccgctgcccccccacatgcatctacgtcgccggcatggccgaactgggtgcattcttctccatcctccaggacatgcgcaacactatcatggcctcaaaaaccgtcggcacagcagaagaaaaactcaaaaaaaaatcatccttctaccaatcctacctccgccgcacccaaagcatgggaatccaactcgaccaacgaataatcctcctatacatgctcgaatggggcaaagaaatggtagaccacttccacctaggagacgacatggaccccgaactacgaggcctagcgcaagccctaatagaccaaaaagtcaaagaaatatccaaccaagagccactaaaaatataa

SEQ ID NO: 7868 - RNA, 1302 nt, synthetic construct
  misc_feature 1..1302: note = derived and/or modified CDS sequence (opt11) from PUUV(Bavaria CG 9/04)__AY954722.2__N
  source 1..1302: mol_type = other RNA
atgtccgacctaaccgacatccaagaagacatcacacgacacgaacagcaactcgtcgtcgcccgccaaaaactcaaggacgcagaaaaagcagtagaaatggacccagacgacgtgaacaaaaacactctccaagcacgacaacaaaccgtcagcgccctcgaagacaaactagccgactacaaaagacgcatggccgacgcagtgtcacgcaagaaaatggacacaaaacccaccgaccccacaggcatagaacccgacgaccaccttaaagaacgctcctccctgcgatacggcaacgtcctggacgtaaacgccatcgacatagaagaacccagcggccaaacagcagactggtacaccatcggcgtatacgtcataggcttcaccctacccattatcctaaaagccctctacatgctcagcacacgcggccgccaaaccgtcaaagaaaacaaaggcacacgaatcagattcaaagacgacacatccttcgaagacataaacggcatccgccgcccgaaacacctctacgtctccatgcccaccgcccaatcaaccatgaaagcagaagaactcacccccggccgcttccgaaccatcgtatgcggcctcttccccacccaaatacaagtccgcaatataatgagccccgtcatgggcgtcatcggcttctccttcttcgtcaaagactgggccgaacgcatcagagaattcatggaaaaggaatgccccttcatcaaacccgaaatgaagcccggcatccccgcacaagaagccgaattcctcaaacgcaacaaagtctacttcatgcaacgtcaagacgtcctagacaaaaaccacgtagccgacatagacaaactcatcgactacgccgcatcaggagaccccacatccccagacaacatcgaaagccccaacgccccctgggtcttcgcctgcgcaccggaccgctgcccccccacgtgcatctacgtcgccggcatggccgaactaggcgcgttcttctcaatcctacaagacatgcgaaacaccatcatggcaagcaaaaccgtcggcaccgcagaagaaaaactcaaaaaaaaatcctccttctaccaaagctacctccgccgcacccaaagcatgggcatccaactagaccaacgcataatcctcctatacatgctagaatggggcaaggaaatggtagaccacttccacctcggcgacgacatggacccagaactacgcggcctcgcacaagccctaatcgaccaaaaagtcaaagaaatcagcaaccaagaacccctcaaaatctaa

SEQ ID NO: 7869 - RNA, 1302 nt, synthetic construct
  misc_feature 1..1302: note = derived and/or modified CDS sequence (opt11) from PUUV(Bergsjobo/Mg25/05)__GQ339483.1__N
  source 1..1302: mol_type = other RNA
atgtcagacctcgccgacatccaagacgaaataacccgccacgaacaacagctcgtcgccgcacgccagaaactcaaagacgccgaacgtgcagtcgaagtcgacccagacgacgtcaacaaaaacaccctacaagcccgacaacaaaccgtctccgcactagaagacaaactcgccgacttcaaacgccgaatggcagacgccgtctccagaaaaaaaatggacacaaaacccacagaccccaccggcatcgaacccgacgaccacctcaaagagagaagctccttacggtacggcaacgtcctcgacgtaaacgccatcgacatagaagaaccctctggccaaaccgccgactggtacacaataggcgtctacgtaataggctttaccctgcccatcatcttaaaagccctatatatgctatccacccgcggccgacaaaccgtcaaagaaaacaaaggcacccgaatccgctttaaagacgacacatccttcgaagacatcaacggcatccgccgacccaaacacctctacgtcagcatgcccaccgcccaatccaccatgaaagcagaggagctaactcccggacgcttccgtacaatagtatgcggcctattccccacccaaatccaagtccgaaacatcatgtcacccgtaatgggggtaatcggtttctccttcttcgtcaaagactgggcagaacgaatccgcgaattcatggaaaaagagtgccccttcatcaaacccgaagtaaaaccaggcacccccgcccaagaagtcgaattcctcaaaaaaaacaaaatctatttcatgcaacgacaggacgtactcgacaaaaaccacgtagccgacatcgacaaactaatagactacgcagccagcggagatccaacatccccagacaacatcgaatcccccaacgccccatgggtcttcgcatgcgcacccgaccgatgcccacccacatgcatatacgtcgccggcatggcagaactcggcgcattcttctcaatcctccaagacatgcgaaacaccatcatggcctcaaaaaccgtgggaaccgccgaggaaaaactcaaaaaaaaatcatccttctaccaatcgtacctacgccgcacacaatccatgggcatccaactagaccaacgcatcatactactatacatgctagagtggggaaaagaaatggtagaccacttccacctcggcgacgatatggaccccgaactacgcggccttgcccaagccctaatcgaccaaaaagtcaaggaaatctccaaccaagaaccactcaaaatataa

SEQ ID NO: 7870 - RNA, 1302 nt, synthetic construct
  misc_feature 1..1302: note = derived and/or modified CDS sequence (opt11) from PUUV(CG14444)__AJ277075.1__N
  source 1..1302: mol_type = other RNA
atgtccgacctcaccgacatccaagaagacatcacacgacacgaacaacagctagtcgtagcacgccaaaaactcaaagacgccgaaaaagcagtagaaatggaccccgacgacgtcaacaaaaacaccctccaagcccgacaacaaaccgtctccgccctggaagacaaactcgcagacttcaaacggcaaatggcggacgccgtctccagaaagaaaatggacaccaaacccacagaccccacaggaatagaacccgacgaccacctcaaagaacgctcatcactccgctacggcaacgtcctggacgtcaacgccatcgacatcgaagaaccgtccggccaaactgcagactggtacaccatcggcgtctacgtaataggcttcaccctcccaatcatcctcaaagccctttacatgctctcaacccgcggccgccaaaccgtcaaagagaacaaaggaacccgcatcagattcaaagacgacaccagcttcgaagacatcaacggcatccgacgccccaaacacctctacgtatctatgcccaccgcacaaagcaccatgaaagccgaagaactcaccccaggcagattccgtacaatcgtctgcggcctcttcccaacccaaatccaagtacgcaacatcatgtccccggtcatgggcgtcatcggattcagcttcttcgtcaaagactgggccgaccgcatccgcgagttcatggaaaaagaatgcccattcatcaaaccagaagtaaaaccaggcacacccgcccaagaagcagagttcctcaaacgcaataaaatctacttcatgcaacgacaagaagttctagacaaaaaccacgtcgcagacatagacaaactgatcgactacgccgcatccggcgaccccacgtccccagataacatcgaagccccaaacgccccctgggtattcgcatgcgccccagacagatgcccaccaacctgcatctacgtcgccggcatggcagaactcggcgccttcttctcaatcctccaagacatgcgaaacaccatcatggcctccaagaccgtgggcaccgccgaagaaaaactcaaaaagaaatcctccttctaccagagctacctccggcgaacccagagcatgggaatccaactagaccaacgaataatcctactctacatgctcgaatggggcaaagaaatggtcgaccacttccacctaggcgacgacatggaccccgaactacgcggcctagcacaagccctcatcgaccaaaaagtaaaagaaatcagcaaccaggaacccctgaaaatctaa

SEQ ID NO: 7871 - RNA, 1302 nt, synthetic construct
  misc_feature 1..1302: note = derived and/or modified CDS sequence (opt11) from PUUV(CG14445)__AJ277076.1__N
  source 1..1302: mol_type = other RNA
atgtcggaccttaccgacatacaggaagacataacccgccatgaacaacagctagtcgtcgcccgccaaaaactcaaagacgccgaaaaagccgtcgagatggaccccgacgacgtcaacaagaacacactccaagcccgccaacaaaccgtctccgctctcgaagacaaactagccgacttcaaacgccaaatggccgacgccgtttcacgaaagaaaatggacacaaaacccacagaccccaccggcatcgaaccagacgaccacctcaaagaacgatcctccctgcgctacggtaacgtactagacgtaaacgcaatagacatcgaagaaccatccggccaaacagcggactggtacaccatcggcgtatacgtcataggcttcaccctccccatcatacttaaagccctctacatgctcagcacccgcggtcgccaaacagtcaaagaaaacaaagggacacgaatccgattcaaagacgacacctcattcgaggacatcaacggcatccgacgtcccaaacacctctacgtctccatgcccaccgcccaaagcaccatgaaagccgaagaactcacacccggccgcttccgcaccatagtatgcggactcttccccacccaaatccaggtacgcaacatcatgtcccccgtaatgggagtaatcggattctccttcttcgtcaaagactgggccgaccgtatcagagagttcatggaaaaagaatgcccattcatcaagcccgaagtcaaaccaggcacacccgcacaagaagcagagttcctcaaacgaaacataatctacttcatgcaacgccaagaagtcctcgacaaaaaccacgtcgccgacatcgacaaactcatagactacgcagcatccggcgaccccaccagcccagacaatatagaagcccccaacgccccctgggtattcgcatgcgccccagaccgttgcccaccaacctgcatctacgtcgccggcatggcagagctaggcgccttcttctccatactccaagacatgcgcaacaccataatggcctccaaaactgtcggaactgcagaagagaaactcaaaaagaaatccagcttctaccaatcctacctccgccgaacccaatccatgggcatccaactcgaccaaagaatcatcctactctacatgttagaatggggcaaagaaatggtcgaccacttccacctcggagacgacatggaccccgagctccgaggactagcccaagcactcatagaccaaaaagtaaaagaaatctccaaccaagaacccctaaaaatctaa

SEQ ID NO: 7872 - RNA, 1302 nt, synthetic construct
  misc_feature 1..1302: note = derived and/or modified CDS sequence (opt11) from PUUV(CG1820/POR)__KT885052.1__N
  source 1..1302: mol_type = other RNA
atgtcagaccttaccgacatccaagaagaaatcacccgccatgaacagcagctagtagtagcacgacaaaaactcaaagatgccgaacgagccgtcgaagtcgaccccgacgacgtcaacaaatcaacacttcaagcacgccaacaaaccgtctcagcactagaagacaaactcgccgactacaaacgacgcatggccgacgccgtctcccgcaagaaaatggacaccaaacccaccgaccccaccggaatcgaacccgacgaccacctcaaagaaagaagctccctccgatacggcaacgtcctcgacgtcaacgccatagacatcgaagaaccgtccggccaaaccgccgactggtacaccataggcgtctacgtcataggattcacaatccccatcatactgaaagccctatacatgctcagcacccgcggacgccaaacagtcaaagaaaacaaaggcacccgaatccgattcaaagacgacacctcctttgaagacatcaacggcatccgaagacccaaacacctctacgtctcaatgccaaccgcacaatcaaccatgaaagctgaagaactcacccccggccgatttcgaacaatcgtctgcggactcttccccacccaaatccaagtacggaacataatgagccccgtcatgggcgtcataggattctccttcttcgtcaaagactggcccgaaaagatccgagagttcatggaaaaggaatgccccttcataaaacccgaagtcaaaccaggaactccagcacaagaagtcgagttcctcaaacgtaaccgcgtctacttcatgacccgacaagacgtactcgacaaaaatcacgtcgccgacatcgacaaactcatcgactacgccgccagcggcgaccccacaagcccagacgacatcgaatcccccaacgccccatgggtcttcgcctgcgcccccgaccgctgcccacccacatgcatctacgtcgcaggcatggcagaattaggagccttcttctccatactacaagacatgcgcaacacaatcatggcaagcaagaccgtaggcacagccgaagaaaaactaaagaagaaaagcagcttctatcaatcatatctccgacgaacacaatccatgggcatccaattagaccaacgcataatcctcctctacatgctagaatggggcaaagaaatggtcgaccactttcacctcggcgacgacatggaccccgaactccgcggcctagctcaatccctcatagaccaaaaagtcaaagaaatctccaaccaagaaccccttaaaatctaa

SEQ ID NO: 7873 - RNA, 1302 nt, synthetic construct
  misc_feature 1..1302: note = derived and/or modified CDS sequence (opt11) from PUUV(Couvin/59Cg/97)__AJ277034.1__N
  source 1..1302: mol_type = other RNA
atgtcagacctcacagacatacaagaagatatcacccgccacgaacaacagctagtcgtcgcccgccaaaaactcaaagacgccgaaaaagccgtcgaaatggaccccgacgacgtaaacaaaaacaccctccaagcccgccagcagaccgtatcagccctcgaagacaaactcgcagacttcaaaagacaaatggcagacgcggtctcccgcaagaaaatggacaccaaacccaccgaccccactggcatcgaacccgacgaccacctaaaagagcgctcctccctacgatatggcaacgtcctagacgtcaacgcaatagacatcgaagaaccctccggacaaaccgccgactggtacaccatcggcgtctacgtcatcggtttcacactccccataatactaaaagccctatacatgctatccactcgcggccgccaaacagtaaaagaaaacaaaggcaccagaatacgattcaaagacgacaccagcttcgaagacatcaacggcatccgccgacccaaacacctctacgtctccatgcccaccgcccaaagcactatgaaagctgaagaactaacccccgggcgattccgcaccatcgtatgcggcctcttccccacccaaatccaagtccgcaacataatgtcccccgtcatgggagtgatcggcttctctttcttcgtaaaagactgggccgaccgaatccgcgagttcatggaaaaagaatgccccttcatcaaacccgaagtcaaaccaggaacccccgcacaagaagcagagttcctcaaacgtaacaaaatatacttcatgcaacgccaagacgtccttgacaaaaaccacgtggccgacatagacaaactcatagactacgctgcctcaggagacccaacctcccccgacaacatcgaagccccaaacgcaccctgggtattcgcctgcgcacccgaccgctgcccaccaacctgcatctacgtcgccggaatggccgagctaggagccttcttctccatactccaagacatgcgcaacaccatcatggcatcaaaaacagtcggtaccgccgaagaaaaactcaaaaagaaaagctcattctaccagagctacctacgccgcacccaatccatgggtattcaactagaccaacgcatcatcctactctatatgctagaatggggaaaagaaatggtcgaccacttccacctcggcgacgacatggaccccgaactcagaggactcgcccaagcactaatcgaccaaaaagtcaaagaaatctccaaccaagaacccctcaaaatatag

SEQ ID NO: 7874 - RNA, 1302 nt, synthetic construct
  misc_feature 1..1302: note = derived and/or modified CDS sequence (opt11) from PUUV(Evo/12Cg/93)__Z30702.1__N
  source 1..1302: mol_type = other RNA
atgtcggacctaaccgacatccaagaagacatcacacgacacgaacaacaactggtagtcgctcgccaaaaactcaaagacgcagaacgcgccgtagaagtcgaccccgacgacgtaaacaagaacaccctccaagcccgccaacagaccgtatcggcactcgaagacaaactggccgactacaaacgccgaatggccgacgcagtctcccgaaagaaaatggacacgaaaccaaccgaccccaccggcatcgaaccagacgaccacctgaaagagagaagctccctccgctacggcaatgtcctcgacgtcaacgcaatagacatcgaagaaccctccggacaaacagccgactggtacaccatcggcgtttacgtcatcggcttcaccatccccatcatcctcaaagccctatacatgctctcaacgcgcggcagacaaaccgtaaaagaaaacaaaggcacacgcatacgattcaaagacgacacctcattcgaagacatcaacggcatcagacgccctaaacacctctacgtctcaatgccaacagcccaatcaactatgaaagcagaagaactcaccccaggccgcttccgcaccatcgtatgcggactcttccccacgcaaatccaagtacgcaatatcatgtcccccgtcatgggtgtaataggcttctccttcttcgtaaaagactggcccgagcgcatccgcgagttcatggaaaaagaatgccccttcatcaaaccagaaatcaaacccggcaccccagcccaagaaatggaaatgctaaaacgcaacaaaatctacttcatgcaacgccaggacgtcctcgacaaaaaccacgtcgccgacatagacaaactaatagactacgcagcctcaggagacccaacaagcccagacaacatagactccccaaacgccccatgggtcttcgcctgcgccccagaccgctgcccacccacatgcatttacgtcgccggcatggccgaactcggcgcgttcttctccatcctacaagacatgcgcaacaccatcatggcttcaaagacggttggcacagcagaagaaaaactacgcaagaaatcctccttctaccaatcctacctccgccgcacccaatccatgggcatacaactcgaccaacgcattatactcctattcatgctagaatggggcaaagaaatggtcgaccacttccacctaggcgacgacatggacccagaactccgagggctagcccaagccctaatcgaccaaaaagtcaaagagatctcaaaccaagagcccctaaaaatataa

SEQ ID NO: 7875 - RNA, 1302 nt, synthetic construct
  misc_feature 1..1302: note = derived and/or modified CDS sequence (opt11) from PUUV(Evo/14Cg/93)__Z30704.1__N
  source 1..1302: mol_type = other RNA
atgagcgacctaacagacatccaagaagacatcactcgacacgaacaacaactggtcgtcgcaagacaaaagctaaaagacgccgaacgcgcagtcgaagtcgacccagacgacgtcaacaaaaacaccctccaagcacgacagcaaacagtcagcgccctcgaagacaaactcgccaactacaagcgcagaatggccgacgcagtctcccgaaagaaaatggacaccaaacccaccgacccaacaggaatcgaacccgacgaccacctcaaagaacgcagcagcctccgatatggcaacgtactagacgtcaacgccatagacatcgaagaaccatccggacaaaccgccgactggtacacaatcggcgtctacgtaatcggcttcacaatcccaatcatcctcaaagccctttacatgctgtcaacacgcggacgacaaaccgtcaaagaaaacaaaggaacccgcatccgattcaaagacgacaccagctttgaagacatcaacggaatcagacgccccaaacacctatacgtatccatgccgacagcccaaagcaccatgaaagccgaagaactcacacccggacgcttccgcaccatcgtctgcggactcttccccacgcagatccaagtccgcaacataatgtcccctgtcatgggagtaatcggattctctttcttcgtcaaagactggcccgaacgcatccgagagttcatggaaaaagaatgccccttcatcaaaccagaaatcaaaccaggcaccccggcacaagaaatggaaatgctaaagcgaaacaaaatatacttcatgcaacgccaagacgtactagacaaaaaccacgtcgcagacatcgacaaactaatcgattacgcagcatccggcggccccaccagccccgacaacatcgactccccaaacgccccctgggtattcgcatgcgcacccgaccgctgcccgcctacatgcatctacgtagccggcatggccgaattaggcgcattcttctccatcctacaagacatgcgcaacaccataatggcaagcaaaaccgtcggcaccgccgaagaaaaactgaaaaagaaatcatcattctaccaatcctacctccgccggacccaaagcatgggcatacaacttgaccagcgaatcatcctcttattcatgctcgaatggggcaaagaaatggtcgaccacttccacctcggcgacgacatggaccccgaactccgaggcctcgcacaagccctcatagaccaaaaagtcaaagagatatcaaaccaagaacccctaaaaatctaa

SEQ ID NO: 7876 - RNA, 1302 nt, synthetic construct
  misc_feature 1..1302: note = derived and/or modified CDS sequence (opt11) from PUUV(Evo/15Cg/93)__Z30705.1__N
  source 1..1302: mol_type = other RNA
atgagcgacctaacagacatacaagaagacatcacccgccacgaacaacaactcgtcgtcgctcgacagggcctcaaagacgcagaacgggccgtcgaagtagacccagacgacgtcaataaaaacgccctacaagcacgacaacaaactgtatccgccctggaagacaaactagccgactacaaacgccgaatggcagacgcagtaagccgcaagaaaatggacacaaaaccaacagaccccaccggtatcgaacccgacgaccacctgaaagagcgaagctccctccgctacggcaacgtattcgacgtcaacgccatcgacatcgaagaaccctcaggccaaaccgccgactggtacaccatcggcgtctacgtaatcggcttcaccatacccatcatcctgaaagccctatacatgctctcaacccgcggacgccaaaccgtcaaagaaaacaaaggcacccgcataagattcaaagacgacaccagcttcgaagacataaacggcatccgcagacccaaacacctatatgtctccatgccaacagcccaatcaacaatgaaagccgaagaactcacaccaggtagattccggaccatcgtctgcggcctcttccccacccaaatccaagtccgaaacatcatgtcccccgtcatgggcgtaatcggattctcattcttcgtaaaagactggcccgaacgcataagagagttcatggaaaaagaatgccccttcatcaaacccgaaatcaaaccagggaccccagcacaagaaatggaaatgctaaaacgcaacaaaatctacttcatgcaacggcaagacgtcctagacaaaaaccacgtcgcagatatcgataaactcatagactacgccgcatccggcgaccccacatcccccgacaacatcgactcccctaacgccccctgggtcttcgcatgcgcccccgaccgatgcccacccacgtgcatttacgtagccggaatggccgaacttggagcattcttcagcatcctacaagacatgcgcaacaccatcatggcctcaaaaacagtcggcaccgccgaagaaaaactcaaaaagaaaagctccttctaccaatcatacctacgccggacccaaagcatgggcatccaactcgaccaacgcataatcctcctcttcatgctagaatggggcaaagaaatggtcgaccacttccacctaggagacgacatggaccccgaactccgcggcctcgcccaagcactcatcgaccaaaaagtaaaagaaatctcaaaccaagaacccctcaaaatataa

SEQ ID NO: 7877 - RNA, 1302 nt, synthetic construct
  misc_feature 1..1302: note = derived and/or modified CDS sequence (opt11) from PUUV(Faboviken/Mg26/05)__GQ339484.1__N
  source 1..1302: mol_type = other RNA
atgtcagacctggccgacatccaagacgaaatcacccgacacgaacaacagctagtcgccgcacgacaaaaactcaaagacgccgaacgcgccgtggaaatggaccccgacgacgtgaacaaaaacaccctacaagcacgacaacaaaccgtcagcgccctagaagacaaactcgccgacttcaaacgacgcatggccgacgccgtatcaaggaagaaaatggacacaaaaccaaccgacccaaccggcatagaaccagacgaccacctcaaagaaatctcctccctccgatacggcaacgtcctcgacgtcaacgcaatagacatagaagaaccctccggacaaaccgccgactggtatacaatcggcgtctacgtcatcggcttcacattacccatcatactcaaagccctctacatgctctccacacgcggccgacaaaccgtcaaagaaaacaaagggacccgtatccgattcaaagacgacaccagcttcgaagacatcaacggcatacgaagaccaaaacacctttacgtctccatgcccaccgcacaaagcacaatgaaagccgaagaactaacaccaggacgattccgaaccatcgtctgcggactcttcccgacccaaatccaagtccgaaacatcatgtccccagtcatgggcgtcatcggcttctccttcttcgtcaaagactgggccgaacgcatccgcgagttcatggaaaaagaatgtcccttcatcaaacccgaagtgaaaccaggcacccccgcacaagaagtcgagttcctcaagaaaaacaaaatctacttcatgcaaagacaagacgtactggacaaaaaccacgtagccgacatcgacaaactcatcgactacgccgcctcaggcgaccccacctcccccgacaacatcgaaagccccaacgccccctgggtattcgcctgcgccccagaccgctgcccaccaacctgcatctacgtcgccggaatggccgaactgggcgcattcttctcaatactccaagatatgagaaacaccatcatggcctcaaaaaccgtaggaacagccgaagaaaaactgaaaaagaaaagttccttctaccaatcctatctacgccgaacacaatccatgggcatccaactagaccaacgcataatcctactctacatgctagaatggggcaaagaaatggtcgaccacttccacctcggcgacgacatggacccagaactccgaggactagcacaagccctaatcgaccaaaaagtaaaagaaatctccaaccaagaacccctcaaaatataa

SEQ ID NO: 7878 - RNA, 1302 nt, synthetic construct
  misc_feature 1..1302: note = derived and/or modified CDS sequence (opt11) from PUUV(Fyn)__AJ238791.1__N
  source 1..1302: mol_type = other RNA
atgagcgacctcaccgacatacaagaagacatcacccgccacgaacaacaactcgtagtcgcacgacaaaaactaaaagacgcagaaaaggccgtggaaatggacccagacgacgtcaacaaaaacaccctacaggcccgccaacaaaccgtttcagcacttgaagacaaacttgccgacttcaaacggcgcatggcagacgcagtctcacgcaaaaaaatggacaccaaaccaaccgacccaaccggcatcgaacccgacgaccacctcaaagaacgatcatccctccgatacggcaacgtcctcgacgtgaacgcgatcgacatcgaagaaccctccggacaaaccgcagactggtacaccatcggtgtgtacgtgatcggcttcacactcccaatcatactcaaagccctctacatgctcagcacccgcggcagacaaaccgtaaaagaaaataaaggcacccgcatccggttcaaagacgacacatccttcgaggacatcaacggcatcagacgcccaaaacacctctacgtctcaatgcccacagcccaatccaccatgaaagcggaagaactaacgccaggccgcttccgaacgatcgtctgcggcctcttccccacccaaatacaagtccgcaacataatgtccccagtcatgggagtcatcgggttctcattcttcgtaaaagactgggccgaacgcatccgcgaattcatggagaaagaatgcccattcatcaaacccgaacttaaaccaggaaccaacgcccaagaagccgaattcctaaaaaaaaaccgcgtgtacttcctcaaccgccaagacgtcctagacaaaaaccacgtcgccgacatcgacaaactcatcgattacgccgcatcaggcgaccccacctccccagacaacatcgaagccccgaacgccccctgggtcttctcctgcgcccccgaccgatgcccccccacatgcatctacgtcgccggaatggccgaactcggcgccttcttcagcatactacaggacatgcgcaacaccatcatggcatccaaaacagtcggaacggccgaagaaaaactaaaaaaaaaaagctcattctaccagtcctacctccgtcgaacacaatccatgggcatccaactcgaccagcgaataatcctactgtacatgctcgaatggggcaaagaaatggtcgaccacttccacctaggagacgacatggacccagaactccgcggcttagcccaagccctcatcgaccaaaaagtgaaagagatctcaaaccaagaacccctcaaaatctaa

SEQ ID NO: 7879 - RNA, 1302 nt, synthetic construct
  misc_feature 1..1302: note = derived and/or modified CDS sequence (opt11) from PUUV(Fyn131)__AJ278093.1__N
  source 1..1302: mol_type = other RNA
atgtccgacctgacagacatccaagaagacataacccgccacgaacaacaactcgtagtagcccgccaaaaactcaaagacgccgaaaaagccgtcgaaatggaccccgacgacgtcaacaaaaacacactggaagcacgccaacaaacagtatccgccctagaagacaaactcgccgacttcaaacgcagaatgaccgacgcagtcagccgcaaaaaaatggacaccaagccgacagatccaaccggcatcgaaccagacgaccacctcaaagaacgctcctccctaagatacggcaacgtcctagacgtcaacgccatcgacatcgaggaaccatcaggacaaaccgccgactggtacaccatcggagtctatgtaatcggcttcaccctaccaatcatcctcaaagccttatacatgctctccacccgcggcagacaaacagtcaaagaaaacaaaggaacccgcatcagattcaaagacgacacctccttcgaagacatcaacggaataagacgaccaaaacacctatacgtctccatgcccaccgccccttcaacaatgaaagccgaagaactcacccccggccgcttccgcaccatcgtctgcgggctattccccacacaaatccaagtccgaaacatcatgagcccagtaatgggcgtcatcggatcatccttcttcgtcaaggactgggccgaccgaatacgagaattcatggaaaaagaatgccccttcgtaaaacccgaactcaaacccggcaccaatgcccaagaagcagaattcctgaaaaaaaaccgtgtctacttcatgaaccgccaagacgtactcgacaaaaaccacgtagcagacatcgacaaactaatcgactacgccgcatcaggcgacccaacctgcccagacaacatagaagcccccaatgccccctggggcttcgcctgcgccccccaccggtgcccgcccacctgcatatacgtagcaggcatggccgagctaggcgcattcttcagcatccttcaagacatgcgcaacaccatcatggccagcaaaacagtcggcaccgccgaagaaaaactcaaaaaaaaatcctctttctaccaatcatatctgcgccgcacccaaagcatgggcatccaactcgaccaacgcataatcctactctacatgctcgaatggggaagagagatggtagaccacttccaccttggagacgacatggacccagaactgcgaggcctcgcacaagcactcataaaccaaaaagtcaaagagatatcaaaccaagagcccctaaaaatataa

SEQ ID NO: 7880 - RNA, 1302 nt, synthetic construct
  misc_feature 1..1302: note = derived and/or modified CDS sequence (opt11) from PUUV(Fyn47)__AJ278092.1__N
  source 1..1302: mol_type = other RNA
atgtccgacctcaccgacatccaggaagacatcacccgccacgaacaacaactcgtcgtagcccgccaaaaactcaaagacgccgaaaaagcagtagaaatggaccccgacgacgtcaacaaaaacaccctccaggcccgccaacaaacagtctccgctctcgaagataaactcgcagacttcaaacgacgcatggccgacgcagtctcacgcaagaaaatggacaccaaacccaccgaccccacaggaatcgaaccagatgaccatctcaaagaacgctccagcctccgatacggcaatgtcctcgacgtgaacgccatcgacatagaagaaccctccggccaaaccgcagactggtacacgatcggcgtatacgtaatcggcttcaccctccccataatccttaaagccctatacatgctatccacacgcggccgccaaaccgtcaaagaaaacaaaggcaccagaatccgcttcaaagacgacaccagcttcgaagacataaacggcatccgccgccccaaacacctatacgtctccatgccaaccgccccctccacaatgaaagccgaagaactaactcccggccgcttccgaacaatcgtctgcggactcttcccaacacagatccaagtcagaaaaataatgtcaccagtcatgggcgtcatcggattctccttcttcgtaaaagactgggtcgaaagaatcagagagttcatggaaaaagaatgtccattcgtcaaaccggaactaaaacccggcacaaacgcccaagaagccgagttcctaaagaaaaacagagtctacttcatgaaccgacaagacgtcctagacaaaaaccacgtcgcagacatcgacaaactaatcgactacgccgcctccggagacccaacctcccccgacaacatcgaagccccaaacgccccctgggtcttcgcttgcgcaccccaccgctgcccaccgacctgcatctacgtagccggaatggccgaactcggcgccttcttctcaatcctccaagacatgcgcaacgccatcatggcctccaaaaccgtcggcaccgccgaagaaaaactcaaaaagaaatcatcattctaccaatcctatctgcgacgcacacaatcagtcggcatccaactggaccaacgaataatcctactatacatgctcgaatggggccgagaaatggtcgaccacttccacctcggagacgacatggacccagaactccgaggtctcgcccaagccctaatcgaccaaaaagtcaaagaaatctccaaccaagaaccgctcaaaatctaa

SEQ ID NO: 7881 - RNA, 1302 nt, synthetic construct
  misc_feature 1..1302: note = derived and/or modified CDS sequence (opt11) from PUUV(Gomselga)__AJ238790.1__N
  source 1..1302: mol_type = other RNA
atgtcggacctcaccgacatccaagaagacatcacaagacacgagcaacagctagtcgtcgcacgacaaaaactcaaagacgcagaaagagcagtcgaagtcgaccccgacgacgtaaacaaaaacaccctacaagcccgccaacaaacagtaagcgccctagaagacaaactcgccgactacaaacgcaaaatggcagacgcagtctcccgcaagaaaatggacaccaaaccaaccgaccccacaggcatcgaacccgacgaccacctcaaagaacgatcctccctccgctacggaaacgtactagacgtaaatgccatcgacatcgaagacccatccggacaaacagcagactggtacaccattggagtctacgtcataggcttcacactccccatcattctcaaagccctctacatgctctcaacccgaggccgccaaaccgtcaaagaaaacaaaggaacacgcatccgcttcaaagacgacacctcattcgaagaaataaacggcatccgacgccccaaacacctatacgtcagcatgcccacagcgcaaagcacaatgaaagccgaggagctgacacctggacgcttccgaaccatcgtgtgcggcctcttcccaacacaaatacaagtcagaaacatcgtatcacccgtcatgggagtcatcggcttctccttcttcgtcaaagactggtcccaacgcatcaccgagttcatggaaaaagaatgccccttcatcaaaccagaagtaaaacccggaacccccgcccaagaaatagaaatgttcaaacgaaacaagatctacttcatgcaacgccaagacgtcctcgacaaaaaccacgtcgccgacatagacaagagcatcgactacgccgcctccgaagaccccacctcacccgacaacatcgactcacccaacgccccctgggtcttcgcatgcgcccccgaccgctgcccaccaacatgcatatacgtcgcaggaatggccgaactaggagccttcttctccatcctccaagacatgagaaacaccatcatggcctccaagaccgtaggcaccgccgaagaaaaactcaagaagaaatcatcattctaccaatcatacctccgccgcacccaatccatgggaatccagctagaccaacgcatcatcctcctctttatgctagaatggggtaaagaaatggtcgaccacttccacctaggcgacgacatggacccagaactccgcggcctcgcccaagcactaatcgaccaaaaagtaaaagaaatctcaaaccaagaaccccttaaaatctaa

SEQ ID NO: 7882 - RNA, 1302 nt, synthetic construct
  misc_feature 1..1302: note = derived and/or modified CDS sequence (opt11) from PUUV(Gyttjea/Mg19/05)__GQ339480.1__N
  source 1..1302: mol_type = other RNA
atgtccgacctcacagatatccaagaagacatcacccgccacgaacaacagctagtcgtggcacgccaaaaactcaaagatgccgaaaaagccgtcgaaatggaccccgacgacgtaaacaagaacaccctgcaagcccgccaacaaaccgtctcagcactagaagacaaactcgccgacttcaaacgacaaatggccgacgccgtcagccgcaagaaaatggacaccaaacccaccgaccccacaggcatcgaacccgacgaccacctaaaagaacgctcatcgctccgatacggcaacgtactcgacgtcaacgccatcgacatcgaagaaccctcaggccaaacagccgactggtacaccataggcgtatacgtcatcggattcacactcccaatcattctaaaagccctctacatgctatccacacgaggccgacagacagtcaaagaaaacaaaggcacccgaatccgcttcaaagacgacacatccttcgaagacatcaacggaatccggcgccccaaacacctctacgtctcaatgccaaccgcccaatcaaccatgaaagccgaagaactcacaccaggccgcttccgaacaatcgtgtgcggcctcttccccacccaaatccaagtccgcaacatcatgagcccagtcatgggcgtcataggcttcgcattcttcgtaaaaggctgggccgaccgcatacgcgaatttatggaaaaagaatgtccattcatcaaaccagaagtcaaaccaggaacccccacccaagaaatagaatttctcaagaaaaacaaagtatacttcctagaccgccaaaccgtacttgacaaaaaccacgtcgccgacatagacaaactcatcgactacgccgcctccggcgaccccacgtcccccgacaacatcgaatccccaaacgccccatgggtcttcgcctgcgccccagaccgatgcccaccaacctgcatatacgtcgccggcatggcagaactcggagccttcttctcaatcctccaagatatgcgcaacacaatcatggcctccaaaaccgtaggaacggccgaagaaaaactaaagaagaaaagctcattctaccaatcctacctccgccgaacacaatccatgggaatccaactcgaccaacgcatcatcctactcttcatgctcgaatggggcaaagaaatggtagaccactttcacctaggcgacgacatggaccccgaactcagaggcctagcccaagccctcatcgaccaaaaagtcaaagaaatctccaaccaagaacccctcaaaatctaa

SEQ ID NO: 7883 - RNA, 1302 nt, synthetic construct
  misc_feature 1..1302: note = derived and/or modified CDS sequence (opt11) from PUUV(Karhumaki)__AJ238788.1__N
  source 1..1302: mol_type = other RNA
atgtcagacctcaccgacatccaagaagacatcacccgccacgaacaacagctagtagtcgcccgacaaaaactcaaagacgccgaacgcgccgtagaagtagaccccgacgacgtaaacaaaaacacacttcaagcccgccaacaaaccgtctccgccctggaagacaaacttgcagactacaaacgcaagatggccgacgcagtctcccgcaagaaaatggacacaaaaccgacagaccccacaggcatgaaaccagacgtccacctaaaagaaagatcaagcctcgaatacggcaacgtactcgacgtcaacgccatcgacatcgaagaacccagcggccaaacagcagactggtacactatcggcgtctacgtcataggattcacccttcccatcatcctcaaagccctatacatgctctccacccgaggccgccaaaccgtcaaagaaaacaaaggaaccagaatacgcttcaaagacgacacttccttcgaagacatcaacggtatacgacgccccaaacacctatacgtctccatgcccaccgcccaatccacaatgaaagcagaagaattaacccccggacgcttccgaaccatcgtctgcggcctcttccccacacaaatacaagtgcgcaacatcatgagccccgtcatgggcgtaatcggattttcattcttcgtgaaagactggtccgaacgcatacgcgagttcatggaaaaagaatgccccttcataaaaccagaagtaaagcccggaacccccgcccaggaaatcgaaatgctccgaagaaacaaaatctacttcatgcaacgtcaagacgtcctcgacaaaaaccacgtcgcagacatcgacaaactcatcgacctagccgcctccggggaccccacatcccccgacaacatagacagccccaacgccccctgggtcttcgcttgcgcaccagtcagatgcccaccgacctgcatctacgtagccggcatggccgaactcggggccttcttctctatcctccaagacatgcgcaacaccatcatggccagcaagaccgtcggcaccgccgaagagaaactcaaaaagaaatcctcattctaccaaagctacctacgccgcacccaaagcatgggaatccaactagaccaacgcataatccttctcttcatgcttgaatggggcaaagaaatggtcgaccactttcacctcggagacgacatggaccccgaactcagaggccttgcacaagcactcatcgaccaaaaagtcaaagaaatctcaaaccaagaacccctcaaaatctaa

SEQ ID NO: 7884 - RNA, 1302 nt, synthetic construct
  misc_feature 1..1302: note = derived and/or modified CDS sequence (opt11) from PUUV(Kolodozero)__AJ238789.1__N
  source 1..1302: mol_type = other RNA
atgtcagacctcacggacatccaagaagacatcacccgccacgaacaacaactcgtagtcgcccgacaaaaactcaaagacgcagaacgcgccgtcgaagtagaccccgacgacgttaacaaaaacactctccaggcccgccaacaaactgtctcagcacttgaagacaaactcgccgattacaaacgccgaatggccgacgccgtctcccgaaagaaaatggacaccaaacccaccgaccccaccggcattgaacccgacgaccacctcaaagaaagatcctccctccgctacggcaacgtcctagacgtcaacgccatcgacatcgaagaaccctccggacaaaccgctgactggtacaccatcggagtatacgtaataggcttcacccttcccataatcctaaaagccctatacatgctctcaacccgcggcagacaaaccgtgaaagaaaacaaaggcaccagaatccgcttcaaagacgacacatccttcgaggacatcaacggcattcgccgtcccaaacacctctacgtatccatgcccaccgcccaatcaactatgaaagccgaggaactcacccccggacgcttccgcacaatcgtatgcggactaatccccacccaaatacaagtccgcaacatcatgtcccccgtcatgggcgtcataggattcagcttcttcgtcaaagactggtcagaacgcatccgcgagttcatggaaaaagaatgccccttcatcaaaccagaagtaaaacccggcacatccgcacaagaaatcgaaatgctcaaacgcaacaaaatctacttcatgcaacgccaagacgtcctcgacaaaaaccacgtagccgacatagacaaactaattgactacgccgcctccggcgacccaacctcccccgacaacatcgacagccccaacgcaccatgggtattcgcctgcgcacccgaccgatgcccaccaacctgcatctacgtagcgggcatggccgaattaggagccttcttctcgatcctccaagatatgcgcaacaccataatggcctccaaaaccgtcggcaccgccgaagaaaaactaaagaagaaaagctcattctaccaatcctacctccgccgaacccaatccatgggcatacccctcgaccaacgaatcatcctcctattcatgctagaatgggggcaagaaatggtggaccacttccacctcggcgacgacatggaccccgaactccgcggactagcccaagcactaatcgaccaaaaagtcaaagaaatatccaaccaagaacccctcaaaatatag

SEQ ID NO: 7885 - RNA, 1302 nt, synthetic construct
  misc_feature 1..1302: note = derived and/or modified CDS sequence (opt11) from PUUV(Kuhmo/X11)__GU808825.1__N
  source 1..1302: mol_type = other RNA
atgtcagacctaacagacattcaagaagacatcacccgccacgaacaacaactcgtcgtcgcccgacaaaaactcaaagatgcagaacgcgcagtaggcgtggaccccgacgacgtcaacaaaaacacactccaagcccgtcaacaaaccgtctccgccctcgaagacaaacttgccgactacaaacgccgcatggcagacgccgtatcccgcaagaaaatggacacaaaacccactgaccccaccggcatcgagcccgacgaccacctgaaagaaagatccagcctccgctacggcaacgtactagacgtcaacgccatcgacatcgaagaaccctcaggccagaccgccgactggtacacaataggcgtctacgtgatcggcttcacccttcccatcatccttaaagccctatacatgctctcaacccgtggtcgacaaacagtaaaagaaaacaaaggcacacgcattagattcaaagacgacacctccttcgaggacatcaacggcatccgccgccccaaacacctatacgtctccatgccaaccgcccagtccaccatgaaagcagaggagctcacccccggacgcttccgaaccatcgtctgcggcctattcccaacccaaatccaagtacgcaacatcatgtcccccgtcatgggcgtaatcggcttctccttcttcgtcaaagactggtcagaaagaatacgcgaatttatggaaaaagaatgccccttcatcaaacccgaagtcaaacccggcacccccgctcaagaaatcgaaatgctcaaacgaaaccgaatctacttcatgcaacgtcaagacgtcctagacaaaaaccacgtcgcagacatcgacaaactcatcgactacgcggcctcaggcgaccccacatcacccgacaacatagactcccccaacgctccctgggttttcgcctgcgccccagaccgctgcccaccaacctgcatctacgtcgccggcatggcagaactaggagcattcttctcaatcctccaggacatgcgaaacacaatcatggcatccaaaaccgtcggcacatccgaagaaaaacttaaaaagaaatcctcattctaccaatcctacctccgccgaacccaatccatgggaatccaactcgaccagcgcataatcttactcttcatgctcgaatggggaaaagaaatggtagaccacttccacctcggcgacgacatggaccccgaactacggggcctcgcccaagccctaatagaccaaaaagtaaaagaaatctccaaccaagaacccctaaagatatag

SEQ ID NO: 7886 - RNA, 1302 nt, synthetic construct
  misc_feature 1..1302: note = derived and/or modified CDS sequence (opt11) from PUUV(Kuhmo/X5)__GU808824.1__N
  source 1..1302: mol_type = other RNA
atgagcgacctgacagacatccaggaagacatcacgcgccacgaacaacaactcgtcgtagcacgccaaaaactcaaagacgccgaacgcgccgtcgaagtcgaccccgacgacgtcaacaaaaacacactccaagccagacaacaaaccgtcagcgcactggaagacaaactcgcagactacaagcgtcgcatggccgacgccgtatcccgtaagaaaatggacacaaaacccacagaccctaccggcatcgaaccagacgaccacctaaaagagcgctcaagcctccgctacggaaacgtactcgacgtcaacgccatcgacatcgaagaaccctccggacaaacagccgactggtacacaatcggcgtatacgtaatcggcttcacactccccatcatcctcaaagccctctacatgctatccacccgcggccgacaaacagtcaaagaaaacaaaggaacacgcatccgattcaaagacgacaccagcttcgaagacatcaacggcatccgccgccccaaacacctttacgtctccatgccaaccgcacaatccactatgaaagccgaagaactcacccccggccgattccgaaccatagtctgcggcctcttcccaacacaaatacaagtccgaaacatcatgtccccagtcatgggcgtcatcggcttctctttcttcgtaaaagactggtccgaacgcatcagagagttcatggaaaaagaatgccccttcatcaaaccagaagtcaaaccaggcacccccgcacaagaaatcgaaatgctcaaacgcaaccgcatctacttcatgcaacgccaagacgtactcgacaaaaaccacgtcgcagacatcgacaaactaatcgactacgccgcatcaggcgaccccaccagccccgacaacatcgactcccccaacgccccatgggtcttcgcctgcgcacccgacagatgcccacccacatgcatctacgtagccggaatggcagaactaggagccttcttctccatactacaagacatgcgcaacaccataatggcaagcaaaaccgtcggcacagccgaagaaaagctaaagaagaaatcatccttctaccaatcatacctccgccgaacccaatccatgggcatccaactcgaccaacgaatcatcctcctgttcatgctagaatggggcaaagaaatggtagaccacttccacctaggcgacgacatggacccagaactcagagggctagcccaagccctcatcgaccaaaaagtaaaagaaatatccaaccaagaacccctcaaaatctaa

SEQ ID NO: 7887 - RNA, 1302 nt, synthetic construct
  misc_feature 1..1302: note = derived and/or modified CDS sequence (opt11) from PUUV(Ljustrask/Mg20/05)__GQ339481.1__N
  source 1..1302: mol_type = other RNA
atgagcgacctcacagacatacaagaagacatcacacgccacgaacaacaactcgtcgtcgcccgccaaaagctcaaagacgcagaaaaagcagtagaaatggacccagacgacgtaaacaaaaacaccctacaagcacggcaacaaacagtatccgccctcgaagacaaactcgccgacttcaaacgacagatggcagacgccgtttcacgcaaaaagatggacaccaaaccaaccgaccccaccggcatcgaacccgacgaccacctcaaagaaagatccagcctaagatacggcaacgtcctcgacgtcaacgccatagacatcgaagaacccagcggacaaacagccgactggtacaccatcggcgtatacgtcatcggctttacactccccatcatactcaaagccctctacatgctctcaacccgcggacgccaaacggtcaaagaaaacaaaggcacacgcatccgcttcaaagacgacacctcattcgaagacataaacggcatcagacgccccaaacacctctacgtctccatgccaacagcccaatcaaccatgaaagccgaagaactcacaccaggccgcttccgcacgatagtgtgcggcctcttccccacacaaatccaagtcagaaacatcatgagcccagtcatgggcgtcatcggattcgcattcttcgtaaaaggctgggccgaccgaatccgcgaatttatggaaaaagaatgccccttcatcaaaccagaagtcaaaccaggcaccccaacccaagaaatagagttcctaaagaaaaacaaagtatacttcctcgaccgccaaaacgtcctcgacaaaaaccacgtagccgatatcgacaaactcatagactacgccgcctccggcgaccccacgtccccagacaacatcgaatcccccaacgccccctgggtcttcgcctgcgccccggaccgatgcccacccacgtgcatctacgtggcaggcatggccgaactaggcgccttcttctcaatcctccaagacatgagaaacaccatcatggcatccaaaaccgtcggaaccgccgaagaaaaactcaaaaagaaatcatccttctaccaaagctacctccgccgaacccaaagcatgggcatacaacttgaccagcgcatcatcctcctgttcatgttagaatggggcaaagaaatggtcgaccacttccacctaggagacgacatggaccccgaactccgcggcctcgcccaagctctcatcgaccaaaaagtcaaagaaatcagcaaccaagaacccctcaaaatctaa

SEQ ID NO: 7888 - RNA, 1302 nt, synthetic construct
  misc_feature 1..1302: note = derived and/or modified CDS sequence (opt11) from PUUV(Mangelbo/Mg1/05)__GQ339485.1__N
  source 1..1302: mol_type = other RNA
atgtccgacctcaccgacatccaagacgaaatcacccgccacgagcaacaactcgtcgccgcccgccaaaaactaaaagacgccgaacgggccgtcgaaatggaccccgacgacgtaaacaaaaacacactccaagcacgccaacaaacggtctccgcactcgaagacaaactcgccgacttcaaacgccgcatggccgacgcagtatcccgcaagaaaatggacaccaaaccaaccgaccccaccggaatcgaacccgacgaccacctaaaagaacgctcctccctccgctacggcgacgtactcgacgtaaacgccatcgacatcgaagaaccaagcggccaaaccgccgactggtacaccataggcgtctacgtcatcggcttcaccctacccatcatccttaaagcactttacatgctcagcacccgcggcaggcaaaccgtcaaagaaaacaaaggcacccgcatccgattcaaagacgacacatccttcgaagacatcaacggcatacgccgccccaaacacctctacgtctcaatgcccacagcccaatctaccatgaaagcagaagaactaacacccggacgtttccgcaccatcgtgtgcggactattccccacgcaaatccaagtccgcaacatcatgtccccagtcatgggcgtcataggcttctccttcttcgtcaaggactgggccgaacgcatcagagagttcatggacaaagaatgccccttcatcaagccagaagtcaaaccaggcacccccgcacaagagatagagttcctaaagaaaaacaaaatatacttcatgcaacgccaagacgtcctagacaaaaaccacgtcgccgacatcgacaaactgatcgattacgcagcctccggcgacccaacatcccccgacaacatcgaatcccccaacgccccctgggtcttcgcttgcgcacccgatcgctgcccacccacatgcatatacgtagccggcatggcagaactaggcgcattcttctccatacttcaagacatgcgcaacaccatcatggcatccaaaaccgtaggcaccgccgaagaaaaactcaaaaagaaatcgagcttctaccagtcatacctccgccgaacacaaagcatgggcatccaactagatcaacgcataatcctactatacatgctcgaatggggcaaagaaatggtcgaccacttccacctaggagacgacatggaccccgaactacgaggactaacccaagcactcatcgaccaaaaagtcaaagaaatctcaaacccagaaccgctcaaaatatag

SEQ ID NO: 7889 - RNA, 1302 nt, synthetic construct
  misc_feature 1..1302: note = derived and/or modified CDS sequence (opt11) from PUUV(Momignies/55Cg/96)__AJ277033.1__N
  source 1..1302: mol_type = other RNA
atgtccgacctcaccgacatccaagaagacatcacacgacatgaacaacaactcgtcgtcgcccggcaaaaactcaaagacgccgaaaaagccgtcgaaatggacccagacgacgtcaacaaaaacaccctccaagcccgccaacaaactgtatccgccctagaagacaaactggccgacttcaaacgccaaatggccgacgcagtttcacgaaagaaaatggacacaaaacccaccgaccctaccggcatagaacccgacgaccacctcaaagaacgctcctccctccgctacggcaacgtcctagacgtcaacgccatagacatcgaagaacccagcgggcaaacagcagactggtacaccatcggagtctacgtaatcggcttcacactccccataatactcaaagcactctacatgctctcaacccgaggccggcaaacagtcaaagaaaacaaaggaaccagaatccgcttcaaagacgacacctcattcgaagacataaacggcatacgccggtccaaacacctctacgtttccatgcccaccgcacaatccaccatgaaagccgaagaactcacccccggccgattcagaaccatcgtctgcggcctcttccccacccaaatccaagtccgcaacataatgtccccagtcatgggcgtaatcggcttctccttcttcgtcaaagactgggcagaccgtatccgcgagttcatggaaaaagaatgccccttcatcaaacccgaagtaaaacccggcacacccgcccaagaagcagagttcctaaaacgaaacaaaatctacttcatgcaacgccaagacgtcctcgacaaaaaccacgtcgccgacatcgacaaactaatcgactacgccgcatccggagaccccacatcccccgacaacatcgaagccccgaacgccccatgggtcttcgcatgcgccccagaccgatgccctccaacctgcatctacgtagccgggatggctgaactgggagcattcttctccatcctccaagacatgagaaacaccatcatggcatccaaaaccgtaggaacagccgaagaaaaactcaaaaagaaatcctccttctatcaatcctacctccgacgcacccaaagcatgggcatacaacttgaccagcgaataattctactatacatgctggaatggggcaaagaaatggtagaccacttccacctctccgacgacatggaccccgaactccgcggcctcgcacaagccctcatcgaccaaaaagtaaaagaaatctccaaccaagaacccctaaaaatataa

SEQ ID NO: 7890 - RNA, 1302 nt, synthetic construct
  misc_feature 1..1302: note = derived and/or modified CDS sequence (opt11) from PUUV(Montbliart/23Cg/96)__AJ277031.1__N
  source 1..1302: mol_type = other RNA
atgtcagacctgacagacatccaggaagacatcacccgtcacgaacaacaactcgtagttgccaggcaaaaactcaaagatgccgaaaaagccgtcgaaatggaccccgacgacgtcaacaaaaacacactccaagcacgacaacaaaccgtctcagccctggaagacaaactcgcagacttcaaacgccaaatggcagacgccgtctcacgcaagaaaatggacaccaaacccacagaccccaccggaatcgaacccgacgaccatctaaaagaaagaagctccctacgttacggcaacgtccttgacgtcaacgccattgacatcgaagaaccaagcgggcaaacagccgactggtacaccatcggcgtatacgtaatcggcttcacccttcccataatactaaaagccctctacatgctatccacccgcggccgccaaacagtcaaagaaaacaaaggaacccgaatacgattcaaagacgatacctccttcgaagacatcaacggtatccgacgacccaaacacctctatgtcagcatgccaacagcccagtcaacaatgaaagccgaagaactcacccccggccgcttccgaacaatagtatgtggactcttcccaacccaaatccaagtccgcaacatcatgtcccccgtcatgggagtgatagggttctccttcttcgtaaaagactgggccgaccgcatccgcgaatttatggaaaaagaatgcccatttataaaacccgaagtaaaacccggcacccccgcacaagaagccgagttcctccgccgcaacaaaatctacttcatgcaacgccaagaagttctagacaaaaaccacgtcgccgacatcgacaaactaatcgactacgcagcatccggagaccccaccagcccagacaacatcgaagcccccaacgcaccctgggtcttcgcctgcgcccccgaccgctgcccaccaacctgcatctacatcgctggcatggccgaactaggcgccttcttctccatcctccaagacatgcgaaacaccataatggcatccaaaaccgtcggcaccgccgaagaaaaactcaaaaagaaaagctcattctaccaatcatacctacgccgcacccaatcaatgggcatccagctagaccaacgcatcatactcctctacatgctagaatggggaaaagaaatggttgaccacttccacctcggagacgacatggaccccgaactccgcggactcgcccaagcactcatcgaccaaaaagtcaaagaaatctccaaccaagaacccctcaaaatataa

SEQ ID NO: 7891 - RNA, 1302 nt, synthetic construct
  misc_feature 1..1302: note = derived and/or modified CDS sequence (opt11) from PUUV(MuEb10Karlstadt/10)__JN696373.1__N
  source 1..1302: mol_type = other RNA
atgtcagacctaaccgacatacaagaagacatcacgcgccacgaacaacagctcgtcgtcgcccgccaaaaactcaaagacgcagaaaaggccgtagaaatggaccccgacgacgtcaacaaaaacaccctacaagcacgccaacagacagtctcagcactagaagacaaactggcagactacaaaaggcgcatggccgacgccgtaagccgcaagaaaatggacaccaaaccaacagaccccacaggcatcgaacccgacgaccacctaaaagagcgcagctcattacggtacggcaacgtcctcgacgtcaacgccatcgacatcgaggaaccatccggacaaaccgccgactggtacaccatcggcgtctacgtaatcggcttcaccctacccatcatactcaaagccctttacatgctctccacccgaggcagacaaaccgtaaaagaaaacaaaggaacccgcatccgcttcaaagacgacacctccttcgaggacatcaacggaatccgccgacccaaacacctatacgtctcaatgcccaccgcacaatccaccatgaaagcagaagaactcacccccggccgcttccgaacaatcgtatgcggcctcttccccacccaaatccaagtacgcaacatcatgagcccagtaatgggcgtgatcggcttctccttcttcgtcaaagactgggccgaacgcattcgagagttcatggaaaaagaatgcccattcatcaagcccgaaatcaaaccaggcaccccagtacaagaagcagagttcctaaaacgcaacaaagtctacttcatgcaacgccaggaagtactagacaaaaaccacgtcgccgacatcgacaaactaatcgactacgcagcctccggagaccccacctcccccgacaacatcgaaagccccaacgcaccatgggtattcgcctgcgccccagaccgctgccctcccacatgcatctacgtcgccgggatggcagaactaggcgccttcttcagcatcctccaggacatgcgcaatacaatcatggcatccaaaaccgtaggcacagccgaagaaaaactcaaaaagaaatcctcattctaccaatcctacctcagaagaactcaaagcatgggcatccaactcgaccaacgaataatactcctctacatgctagaatggggaaaagaaatggtcgaccacttccacctaggcgacgacatggaccccgaactccgcggactcgcccaagccctaatagaccaaaaagtgaaagaaatctcgaaccaagaacccctcaaaatatag

SEQ ID NO: 7892 - RNA, 1302 nt, synthetic construct
  misc_feature 1..1302: note = derived and/or modified CDS sequence (opt11) from PUUV(MuEb12Lackenberg/10)__JN696374.1__N
  source 1..1302: mol_type = other RNA
atgtccgacctaaccgacatacaagaagacatcacacgacacgaacaacagctcgtcgtcgccagacaaaaactcaaagacgccgaaaaagcggtcgaaatggaccccgacgacgtaaacaaaaacaccctccaagcccgccaacagaccgtatcagcactcgaagacaaactggccgactacaaacgccgaatggcagacgcagtctctcgcaagaaaatggacaccaaacccactgaccccacaggcatcgaacccgacgaccacctaaaagaacgttcctccctgaggtacggaaacgtcctcgacgtcaacgccatcgacatcgaagaaccatccgggcaaaccgccgactggtacacaatcggagtatacgtaataggcttcacactgccaatcatcctcaaagcactatacatgctctccacacgcggccgccaaaccgtcaaagaaaacaaaggaacccgcatcagattcaaagacgacacatccttcgaagacatcaacggcatccgacgacccaaacatctctacgtctccatgcccaccgcccaaagcactatgaaagcggaagaactcacacccggacgcttccgcaccatagtctgcggactattccccacccaaatacaagtccgcaacatcatgagccccgtcatgggagtcatcggcttctccttcttcgtcaaagactgggcagaacgaatccgcgagttcatggaaaaggaatgcccctttattaaacccgaaatgaaacccggcacaccagcacaagaagccgagttcctcaaacgcaacaaagtatacttcatgcaacgacaggacgtcctcgacaaaaaccacgtcgccgacatcgacaaactcatcgactacgccgcatcaggagaccccacaagcccagacaacatcgaatcccccaacgccccatgggtcttcgcatgcgcacccgacagatgcccaccaacctgcatctacgtagcaggcatggcagaactcggagcattcttctcaatactccaagacatgcgcaacaccataatggcaagcaagaccgtcggaaccgccgaagaaaaactcaaaaagaaatcctcattctaccaatcatacctacgccgcacccaaagcatgggcatccagctagaccagcgcatcatcctcctctacatgctcgaatggggcaaagaaatggttgaccacttccacctaggcgacgacatggaccccgaactccgcggactagcccaagcactcatcgaccagaaagtcaaagaaatctcaaaccaagaacccctcaaaatataa

SEQ ID NO: 7893 - RNA, 1302 nt, synthetic construct
  misc_feature 1..1302: note = derived and/or modified CDS sequence (opt11) from PUUV(Munga/Mg16/05)__GQ339487.1__N
  source 1..1302: mol_type = other RNA
atgtcggacctcacagacatccaagacgaaatcacccgacacgaacaacaactcgtagccgccagacagaaattaaaagacgcagaacgagccgtagaaatggaccccgacgacgtcaacaaaaacacactccaggcccgacaacaaacagtctctgcgctcgaagacaaactcgccgacttcaagcggcgcatggcagacgccgtcagccgcaaaaaaatggacaccaaacctaccgaccccaccggcatcgaacccgacgaccacctcaaagaacgatcctccctccgatacggcaacgtcctagacgtcaacgccatagacatcgaagaaccctccggccaaaccgcagactggtacacaataggagtctacgtcattggattcaccctaccaatcatactcaaagcactctacatgctctccacccgcggtcgacaaaccgtaaaagaaaacaaaggcacacgcatacgcttcaaagacgacacatccttcgaggacatcaacggcatccgccgccccaaacacctatacgtctccatgcccaccgcccagtccacaatgaaagccgaagaactcaccccaggaagattccgaacaatagtatgtggcctcttccccacccaaatccaagtccgcaacataatgtcccccgtcatgggcgtgataggcttcagcttcttcgtcaaagactgggccgaacgcatccgcgaattcatggaaaaagaatgccccttcataaaaccagaagtaaaacccggcactcccgcccaagaaatcgaattcctaaaaaaaaacaagatatacttcatgcaacgccaagacgtcctagacaaaaatcacgttgcagacatagacaagttaatagactacgccgcctccggcgaccccacctccccagacaacatcgaatcgcccaacgccccctgggtattcgcctgcgcccccgaccgctgcccacccacctgcatctacgtcgcaggcatggctgaactaggcgcattcttcagcatcctccaagacatgcgcaacaccatcatggcctccaagaccgtcggcaccgccgaagaaaaactcaaaaaaaaaagctccttctaccaaagctacctccgcagaacccaatccatgggcatccaactagaccaacgcataatactgctgtacatgctcgaatggggcaaagaaatggtcgaccacttccacctcggcgacgacatggacccagaactaagaggcctcgcacaggcactcatagaccaaaaagtcaaagaaatatccaaccaggaacccctcaaaatctaa

SEQ ID NO: 7894 - RNA, 1302 nt, synthetic construct
  misc_feature 1..1302: note = derived and/or modified CDS sequence (opt11) from PUUV(Munga/Mg2/05)__GQ339486.1__N
  source 1..1302: mol_type = other RNA
atgtcggacctaaccgacattcaagacgaaatcacacgccacgaacaacagctagtcgcagcacgccaaaaactaaaagacgccgaaagggccgtcgaaatggaccccgacgacgtcaacaagaacaccctccaagcccgccaacaaaccgtcagcgcactcgaagacaaactcgcagacttcaaacgcagaatggccgacgccgtctcacgcaagaaaatggacactaaacccacagaccccacaggcatagaaccagacgaccacctcaaagaacgctcctcactcagatacggaaacgtcctggacatgaatgcgatcgacatcgaagaacccagcggacaaacggccgactggtacaccatcggagtctacgtaataggcttcactctacccatcatactcaaagccctctacatgctatccacacgcggccgccaaaccgtaaaagaaaacaaaggcacccgcatccgattcaaagacgacacttcctttgaagacatcaacggcatccgtagacccaaacacctatacgtatccatgcccaccgcccaaagcaccatgaaagccgaagaactcacccccggacgcttcaggaccatagtatgcggcctattccccacccaaatccaagtacgcaacatcatgtccccagtcatgggagtaatcgggttcagcttcttcgtcaaagactgggccgaacgcatccgcgagttcatggaaaaagaatgcccattcatcaaacccgaagtaaaaccagggacccccgcccaagaaatagagttcctaaagaaaaacaaaatctacttcatgcaacgacaagacgtactcgataaaaaccacgtcgccgacatcgacaaactcatcgactacgcggcaagcggagaccccacatccccagacaacatagaatctcccaacgcaccatgggtcttcgcatgcgcaccggacagatgcccacccacatgcatctacgtagccggaatggccgaactaggcgccttcttcagcatcctacaagacatgcgcaacaccataatggcatccaaaaccgtcggcaccgcagaagaaaaactcaaaaagaaatcatccttctaccagtcctacctccgaagaacccaaagcatgggcatccaactcgaccaaagaatcatcctactctacatgctcgaatggggcaaagaaatggtagaccacttccacctaggagacgacatggaccccgaactccgcggactcgcacaagccctgattgaccaaaaagtaaaagaaatctcaaaccaagaacccctcaaaatctga

SEQ ID NO: 7895 - RNA, 1302 nt, synthetic construct
  misc_feature 1..1302: note = derived and/or modified CDS sequence (opt11) from PUUV(PUU/Cg-Erft)__AJ238779.1__N
  source 1..1302: mol_type = other RNA
atgtcagacctcacagacatccaagaagacataacccgacacgaacaacagctagtcgtcgcacgccaaaaacttaaagacgccgaaaaagccgtcgaaatggaccccgacgacgtaaacaaaaacaccctccaagcccgacaacaaaccgtctccgcactcgaagacaaactagccgacttcaaacgccaaatggccgacgccgtctcacgcaagaaaatggacactaaacccacagaccccaccggaatcgaacccgacgaccacctcaaagaacgatcatccctccgctacggcaacgtcctcgacgtaaacgccatcgacatcgaagaaccatccggccaaaccgccgactggtacaccatcggcgtatacgtcataggcttcacactacccatcatcctcaaagccctctacatgctatccacccgcggccggcaaaccgtcaaagaaaacaaaggaacccgaatacgcttcaaagacgatacatccttcgaagacataaacgggatccgacgcccaaaacacctatacgtctccatgccaacagcacaatcaactatgaaagccgaagaactcactcccggccgcttccgaacgatcgtctgcggcctattccccacacaaatacaagtacgcaacatcatgtccccagtcatgggagtaatcggcttctccttcttcgtcaaagattgggccgaccgcataaagaaattcatggaaaaagaatgccccttcatcaaacccgaagtcaaacccggcacaccgtcccaagaagcagagttcctaaaaatgaaccgcatctacttcatgcaacgccaagaagtcctcgacaaaaaccacgtcgcagacatcgacaaactcatagactacgccgcaagcggagaccccacctcccccgacaacatcgaagcccccaacgcaccatgggtcttcgcctgcgcaccagaccgctgtccacccacatgcatctacgtagccggcatggccgaattgggcgccttcttcagcatcctacaagacatgcgcaacaccatcatggcctccaaaaccgtcggaaccgcagaagaaaagctaaagaagaaaagctccttctaccagtcctacctcagaagaacccaatccatgggcatccaactagaccaacgcatcatactcctatacatgctcgaatggggaaaagaaatggtcgatcacttccatctcggtgacgacatggaccccgaactaagaggactcgcacaagccctaattgaccagaaagtcaaagaaatctccaaccaagaacccctcaaaatctaa

SEQ ID NO: 7896 - RNA, 1302 nt, synthetic construct
  misc_feature 1..1302: note = derived and/or modified CDS sequence (opt11) from PUUV(Puu/Kazan)__Z84204.1__N
  source 1..1302: mol_type = other RNA
atgtccgacctcacagacatccaagaagaaatcacacgccacgaacaacagctagtcgttgcccgccaaaaactcaaagacgccgaacgagccgtggaagtcgatcccgacgatgtcaacaaaaacacactccaagcacgccaacaaaccgtctctgccctagaagacaaattagccgactacaaacgccgcatggcggacgcggtatcccgcaagaaaatggacaccaaacccaccgatcctaccggcatcgaacccgacgaccacctcaaagagcgaagctccctacgctacggcaacgtacttgacgtaaacgcaatagacatcgaagaacccagcggccaaaccgcagactggtacacaatcggagtgtatgtgatcggctttaccatcccaatcatactcaaagccctctatatgctatccacccgcggccgacaaaccgtaaaggaaaacaaaggcacacgcatacgattcaaggacgacacctccttcgaggacatcaacggaataagacgcccaaaacacctctacgtctcaatgccaacagcgcaaagcaccatgaaagcagaagaactcactcccggccgcttccgcaccatcgtctgcggcttattccccacccaaatacaagtccgaaacatcatgtcccccgtcatgggcgtcatcggcttctccttcttcgtcaaggactggcccgaacgcatccgcgacttcatggaaaaagaatctccattcatcaaacccgaagtaaaaccaggcacccccgcccaagaaatcgagttcctaaaacgaaaccgcgtatacttcatgactcgccaagacgtcctagacaaaaaccacgtagcagacatcgacaaactaatcgactacgcagcctccggagaccccaccagccccgacgacatagaatcccccaacgccccatgggtcttcgcatgcgccccagaccgatgcccaccaacctgcatctacgtcgccggcatggccgaactcggcgccttcttctccatcctacaggacatgcgaaacaccatcatggcgagcaaaaccgtcggcacagcagaagaaaaacttaagaagaaaagctcattctaccagtcatacctccgccgcacacaatcaatgggcatccaactcgaccaacgcatcatcctactctacatgttagaatggggcaaagagatggtagaccacttccacctcggcgacgacatggaccccgaactccgtggcctcgcacaatccctaatcgaccaaaaagtcaaagaaatctcaaaccaagaacccctcaaaatctga

SEQ ID NO: 7897 - RNA, 1302 nt, synthetic construct
  misc_feature 1..1302: note = derived and/or modified CDS sequence (opt11) from PUUV(PUU/Mignovillard/CgY02/2005)__AM695638.1__N
  source 1..1302: mol_type = other RNA
atgggcgacctcaccgacatccaagaagacataacccgccacgaacaacaactggtcgtcgcccgccagaaactcaaagacgccgaaaaagccgtcgaaatggaccccgacgacgtcaacaaaaacaccctccaagcaagacaacaaacagtcagcgccctcgaagataaacttgccgacttcaaacgtcgcatggccgacgccgtcagcagaaagaaaatggacaccaaaccaaccgacccaacaggcatcgaacccgacgaccacctcaaagaacgctcaagcctacgctacggcaacgtcctagacgtaaacgcgatagacatcgaagaacccagcggacaaacagcagactggtacaccatcggagtctatgtcataggcttcaccctcccaatcatactcaaagccctctacatgctctcgacacgaggccgacaaaccgtcaaagaaaacaaaggaacccgcatacgattcaaagacgacaccagcttcgaagacatcaacggaatacgccgtcccaaacacctatacgtctcaatgcccaccgctcaaagcacaatgaaagcagaagaactcacacccggacgattccgcaccatcgtctgcggcctcttccccacccaaatccaagtgcgcaacataatgagccccgtaatgggcgtcatcggattcagcttcttcgtcaaagactggacagatcgcatacgagaatttatggaaaaagaatgccccttcattaaaccagaaatgaaacccggcacccccgcacaagaagcagagttcctcaaacgaaacaaaatctacttcatgcaacgccaagatgtcctagacaaaaaccacgtagccgacatcgacaaactaatcgactatgccgcctcgggagatcccaccagccccgacaacatcgaatccccaaacgccccatgggtcttcgcatgcgcacccgaccggtgcccacccacatgcatctacgtcgcaggcatggccgaactcggagcattcttcagcatcctacaagacatgagaaacaccatcatggccagcaaaaccgtaggcacagccgaagaaaaactaaagaagaaaagcagcttctaccaatcatacttacgccgaacccaatccatgggcatacaactcgaccaacgcatcatactcctctacatgctggaatggggcaaagaaatggtcgaccacttccacctcggagacgacatggaccctgaactccgaggcctggcccaagcacttatagaccaaaaagtcaaagaaatctcaaaccaagaaccactaaaaatctaa

SEQ ID NO: 7898 - RNA, 1302 nt, synthetic construct
  misc_feature 1..1302: note = derived and/or modified CDS sequence (opt11) from PUUV(PUUV/Croatia_Gerovo/Mg938/2008)__KC676609.1__N
  source 1..1302: mol_type = other RNA
atgtccgacctcaccgacattcaagaagacatcacccgccacgaacaacaactcgtagtcgcacgccaaaaactaaaagacgccgaaaaagccgtagaaatggacccggacgacgtcaacaaaaataccctccaagcccgacagcaaacagtatccgccctggaagacaaactcgccgacttcaaacgccgaatggccgacgccgtctcacgtaagaaaatggacaccaaacccaccgaccccaccggcatcgaacctgacgaccacctcaaagagcgctctagccttcgatacggcaacgtcctcgacgtgaacgccatcgacatcgaagaacccagcggacaaaccgcagactggtacaccataggcgtctacgtaatgggcttcaccctccctatcatactcaaagccctctacatgctctccacccgaggccgccaaaccgtaaaagaaaacaaaggcacccgcataagatttaaagacgacacctcattcgaggacatcaacggtatccgacgcccaaaacacctctacgtctccatgccaaccgcccaatccaccatgaaagcggaagaactaacccccggccgcttccgcaccatcgtgtgcggcctcttccccactcaaatacaagtccgaaacatcatgagccccgtaatgggagtaataggcttctcattcttcgtcaaagactggagcgaacgcgtccgcgacttcatggaaaaagaatgccccttcataaaacccgaaatcaaacccggaacaccccaacaagaagcagagttcctcaaacgcaacaaagtctacttcatgcaacgccaagacgttctcgacaaaaaccacgtggctgacatagacaaactaatcgactacgcagcatccggcgatcccacctccccagacaacatcgaaagccccaacgccccctgggtcttcgcatgcgccccagaccgctgccctccaacctgcatctacgtagcaggtatggccgaattaggcgcattcttcagcatcctccaggacatgcgcaacaccatcatggcctccaagacagtcggcaccgccgaggaaaaactcaagaaaaagtcatcgttctatcaatcctacctgcgccgcacccaatccatgggaatccaactagaccaacgcatcatcctcctctacatgctcgaatggggcaaagaaatggtagaccacttccacctcggcgacgacatggaccccgagctacgcggcctcgcccaagcactaatcgaccaaaaagtcaaagaaatatccaaccaagaacccctaaagatctaa

SEQ ID NO: 7899 - RNA, 1302 nt, synthetic construct
  misc_feature 1..1302: note = derived and/or modified CDS sequence (opt11) from PUUV(PUUV/Croatia_Gerovo/Mg979/2008)__KC676613.1__N
  source 1..1302: mol_type = other RNA
atgtcagacctcacagacatccaagaagacataacccgccacgaacaacaactcgtcgtcgcccgccaaaaactcaaagacgccgagaaagccgtcgaaatggaccccgacgacgtcaacaaaaacaccctacaagcccgccaacaaaccgtctcagccctcgaagacaaactcgccgacttcaaacgccgcatggccgacgccgtctcacgcaagaaaatggacacaaaacccaccgaccccaccggcatagaaccagacgaccacctaaaagaaagatcctccctacgctacggcaacgtcctagacgtaaacgcgatagacatcgaggaaccatcagggcaaacggcagactggtacaccataggcgtctacgtcatcgggttcacactaccaatcatcctcaaagccctctacatgctctccacccgcggccggcaaacggtcaaagaaaacaaaggcacccgaatccgattcaaagacgacacatccttcgaagacatcaacggcatccgacgccccaaacacctctacgtctcgatgccaaccgcccaatccaccatgaaagcagaagaactcacccctgggcgctttcgcaccatcgtctgcggcctattcccgacccaaatacaagtacgcaacatcatgagcccagtgatgggagtaatcggcttctccttcttcgtcaaagactggagcgaaagagtccgagacttcatggaaaaagaatgccccttcataaaaccagaaatcaagccaggaaccccgcctcaagaagccgagttcctcaaacgcaacaaagtatacttcatgcagcgtcaagacgtcctggacaaaaaccacgtagcagacatcgacaaactaatcgactacgccgcaagcggcgaccccaccagccccgacaacatcgaatctccaaacgcgccctgggtcttcgcctgcgcacccgatcgctgcccacccacatgcatctacgtagcaggcatggcagaactcggagcgttcttttccatcctccaagacatgcgaaacacaataatggccagcaaaaccgtcggcactgccgaagaaaaactcaaaaagaaaagctcattctaccaatcctacctccgcagaacccaaagcatgggaatacaactcgaccaacgcatcatcctcctatacatgctggaatggggcaaagagatggtagaccacttccacctcggcgacgacatggaccccgaactacgcggcctagcccaagcactcatcgaccaaaaagtcaaagaaatcagcaaccaagaaccactcaaaatataa

SEQ ID NO: 7900 - RNA, 1302 nt, synthetic construct
  misc_feature 1..1302: note = derived and/or modified CDS sequence (opt11) from PUUV(PUUV/Konnevesi/Mg_M114B/2005)__JQ319171.1__N
  source 1..1302: mol_type = other RNA
atgtccgacctaaccgacatccaagaagacataacacgccacgaacaacagctagtcgtagcaagacaaaagctaaaagacgctgaacgagccgtagaggtcgaccccgacgacgtaaacaaaaacacgctccaagcccgccaacaaacagtgtccgccctagaagacaaactagccgactacaaacgccgcatggcggacgcagtctcccgaaagaaaatggacaccaaacccaccgaccccaccggcatcgaacccgacgaccacctcaaagaacgctcctccctcaggtacggaaacgtcctagacgtaaacgccattgacatcgaggaaccctccggacaaaccgccgactggtacaccataggcgtctacgtaataggattcaccctacccatcatactcaaagccctatatatgctctcaacccgcggccgacaaacagtcaaagaaaacaaagggacccgcatccgcttcaaagacgacacctcattcgaagacatcaacggcatccgccgccccaaacacctatacgtctcaatgcccaccgcgcaaagcaccatgaaagccgaggaactaacccccggccgcttccgaacaatagtatgcggactcttcccaactcaaatacaagtccgcaacattatgagccccgtcatgggcgtcatcggcttctccttcttcgtaaaagactggcccgaacgaatacgcgagttcatggaaaaagaatgccccttcatcaaacccgaagtcaaaccaggcaccccggcacaagaaatagaaatgctcaaacgcaacaaaatctacttcatgcaacgacaagacgtattggacaaaaaccacgtcgcagacatcgacaaactcatcgactacgcagcctccggagacccaacatcacccgacaacatcgacagccccaacgccccctgggtcttcgcctgcgcacccgaccgctgcccaccaacctgcatctacgttgccggaatggccgaactcggagccttcttcagcatcctccaagatatgcgaaacaccatcatggcctccaaaaccgtcggcaccgccgaagaaaaactcaagaaaaagagctcattctaccaatcctacctaagacgaacccaatccatgggcatccaactcgaccaacgcataatcctcctattcatgctggaatggggcaaggaaatggtcgaccacttccacttcggagacgacatggaccccgaacttcgaggactcgcccaagcactcatcgaccaaaaagtgaaagaaatctcaaaccaggaacccctcaaaatctga

SEQ ID NO: 7901 - RNA, 1302 nt, synthetic construct
  misc_feature 1..1302: note = derived and/or modified CDS sequence (opt11) from PUUV(PUUV/Konnevesi/Mg_M94A/2005)__JQ319163.2__N
  source 1..1302: mol_type = other RNA
atgtccgacctgactgacatacaagaagacatcacacgacatgaacaacaactcgtagtcgcccgccaaaaactcaaagacgcagaacgagccgtcgaagtcgatccggacgacgtcaacaaaaacaccctccaagctcgccaacaaaccgtatcagccctcgaagataaactcgccgactacaaaagaagaatggccgacgcagtaagccgcaagaaaatggacacaaaaccaaccgaccccaccggcatcgaacccgacgaccacctaaaagaacgatcgtccctccggtacggcaacgtcctcgacgtaaacgccatagacatcgaagaaccatccggacaaaccgccgactggtacaccataggcgtctacgtcatcggcttcacactacccatcatacttaaagccctctacatgctttccacccgcggccgacaaacagtcaaagaaaacaaaggaacacgcatccgcttcaaagacgacacctccttcgaagacatcaacggaatccgacgccccaaacacctctacgtctcaatgcccaccgcgcaatcaaccatgaaagccgaagaactcacacccggccgcttccgaaccatcgtctgcggactcttccccacccaaatccaagtacgcaacatcatgagcccagtaatgggcgtaatcggcttctccttcttcgtaaaagattggcccgaacgaataaaagagttcatggaaaaagaatgccccttcatcaaacccgaagttaaaccaggcaccccagcccaagaaatcgaaatgctaaaacgaaacaaaatctatttcatgcaacgacaagacgtactcgacaaaaaccacgtcgccgacatcgacaaacttatcgactacgcggccagcggcgaccccaccagccccgacaacatcgactccccaaacgccccctgggtcttcgcctgcgctcctgaccgctgcccaccaacctgcatatacgtcgccggcatggcagaactcggcgccttcttcagcatactccaagacatgcgaaacaccatcatggcctccaaaacagtaggcaccgccgaggaagaagtcaaaaagaaaagttccttctaccaaagctacctccgccggacccagtcaatgggcatacaactggaccaacgaatcatcctcctcttcatgctagaatggggcaaagaaatggtcgaccacttccacctaggcgacgacatggaccccgaactgcgcggactcgcccaagccatgatcgaccaaaaagtaaaagagatatccaaccaagaacccctaaaaatataa

SEQ ID NO: 7902 - RNA, 1302 nt, synthetic construct
  misc_feature 1..1302: note = derived and/or modified CDS sequence (opt11) from PUUV(PUUV/Konnevesi/Mg_O14B/2005)__JQ319166.1__N
  source 1..1302: mol_type = other RNA
atgagcgacctcaccgacatccaagaagacatcacccgccacgaacaacagctagtcgtcgcccgacaaaaactaaaagacgccgagagggccgtagaagtcgaccccgacgacgtcaacaaaaacacactacaagcccgccaacaaacagtctccgccctcgaagacaaactcgccgactacaaacgacgcatggcagacgccgtctcccgcaagaaaatggacacaaaaccaaccgaccccaccggcatcgaacccgacgaccacctcaaagaaagatccagcctacgctacggcaacgtcctcgacgtaaacgccatagacatcgaagaaccatccggccaaaccgcagactggtacacaataggagtctacgtaataggcttcaccctacccatcatcctcaaagcactatacatgctctccacccgcggccgccaaaccgtcaaagaaaacaaaggcacccgcatccgcttcaaagacgacaccagcttcgaagacatcaacggcatccgccgccccaaacatctctacgtctccatgccaaccgcccaatcaaccatgaaagcagaagaactcacccccggccggttccgcacaatcgtctgcggcctattccccacacaaatccaagtacgaaacataatgtcacccgtcatgggcgtaataggattctcattcttcgtcaaggactggccagaacgcatacgcgagttcatggaaaaagaatgccccttcatcaaacccgaagtaaaaccaggaacgcccgcacaagaaatcgaaatgctaaaacgcaacaagatatacttcatgcaacgacaagacgtcctagacaaaaaccacgtcgcagacatcgacaaactaatagactacgccgcctccggagaccccacctcccccgacaacatcgactcaccaaacgccccctgggtcttcgcatgcgccccggaccgctgcccacccacatgcatatacgtagccggcatggccgaactgggagccttcttctccatccttcaagacatgcgcaacactataatggcaagcaaaaccgtgggaaccgccgaagaaaaactaaagaagaaaagctccttctaccagtcctacctccgccgcacacaatccatgggaatacaactcgaccagagaatcatcctactattcatgctcgagtggggaaaagaaatggtagaccactttcacctcggagacgacatggaccccgaactccgaggactagcacaagccctcatcgaccaaaaagtaaaagagataagcaaccaagaacccctcaaaatataa

SEQ ID NO: 7903 - RNA, 1302 nt, synthetic construct
  misc_feature 1..1302: note = derived and/or modified CDS sequence (opt11) from PUUV(PUUV/Konnevesi/Mg_O22B/2005)__JQ319168.2__N
  source 1..1302: mol_type = other RNA
atgtccgacctcacagacatacaagaagacatcaccagacacgaacaacagctagtcgtagcccgacaaaaactcaaagacgcagaacgcgccgtagaagtagatcccgacgacgtcaacaaaaacacgctacaagcccgacaacaaaccgtctcagccctagaagacaaacttgcagactacaaacgacgcatggccgacgccgtcagccgcaagaaaatggacacaaaaccaacagaccccaccggcatagaacccgacgaccacctcaaagaaagatccagcctcaggtacggcaacgtactcgacgtcaacgcaatcgacatagaagaaccatccggacaaacagccgattggtacaccatcggcgtctacgtcataggcttcaccctccccataatcctaaaagccctatacatgctgtcaacccgaggccgacaaaccgtcaaagaaaacaagggcacccgaatccgcttcaaggacgacacatccttcgaggacataaacggcatacgacgccccaaacacctctacgtctctatgcccaccgcccaaagcaccatgaaagccgaagaactaacccccggccgattccgcaccatcgtctgcggactattcccaacacaaatccaagtacgcaacatcatgtcacccgtcatgggcgtaatcggcttcagcttcttcgtcaaggactggccagaacgcatccgagagttcatggaaaaagaatgccccttcatcaaacccgaagtcaaacccggcacccctgcccaagaaatcgaaatgctcaaacgaaacaaaatctacttcatgcaaagacaagacgtcctggacaaaaaccacgtagcagacatcgacaaactcatcgactacgcagcttcaggcgaccccaccagccccgaaaacatcgacagccccaacgccccctgggtgttcgcctgcgcccccgaccgctgcccacccacatgcatatacgtagccggcatggcagaactcggcgcattcttctcaatcctacaagacatgcgaaacacaatcatggcctccaaaaccgtcggcaccgcggaagaaaaactcaagaaaaagagcagcttctaccaaagctacctgcgcagaacacaaagcatgggtatacaactcgaccaacgcatcatcctactattcatgctcgaatggggaaaagaaatggtagaccacttccacctcggcgacgacatggaccccgaactacgaggccacgcacaagcactcatcgaccaaaaagtgaaagaaatatcaaaccaagaacccctcaaaatctaa

SEQ ID NO: 7904 - RNA, 1302 nt, synthetic construct
  misc_feature 1..1302: note = derived and/or modified CDS sequence (opt11) from PUUV(PUUV/Konnevesi/Mg_O57A/2005)__JQ319161.2__N
  source 1..1302: mol_type = other RNA
atgtccgacctaaccgacatccaagaagacatcacccgccacgaacaacaactcgtcgtcgcccgacaaaaactcaaagacgccgaacgagcagtagaagtcgacccagacgacgtcaacaaaaacaccctacaagcacgacaacaaacagtctccgccctagaagacaaactggcagactacaaaagacgcatggccgacgccgtctcgcgcaagaaaatggacacgaaacccaccgatcccacaggcatcgagccagacgaccacctaaaagaacgatccagcctacgctacggaaacgtcctagacgtcaacgccatcgacatcgaagaacccagcggccaaaccgccgactggtacaccatcggcgtatacgtcatcgggttcaccctcccgatcatcctcaaagcactatacatgctaagcacacgaggccgccaaacagtcaaagaaaacaaaggaacacgcatacgcttcaaagatgacacctcgttcgaagacataaacggcatccgccgccccaaacacctatacgtatcaatgcccaccgcccaatcaaccatgaaagccgaagaattaacaccaggcagattccgcaccatcgtatgcggcctcttcccaacccgcatccaagtgagaaacatcatgtcccccgtaatgggagtgatcgggttctccttcttcgtcaaagactggcccgaacgcatcaaagagttcatggaaaaagaatgctcattcatcaaacccgaagtaaaaccaggcacaccagcccaagaaatcgaaatgctcaaacgcaacaaaatctatttcatgcagcgccaggacgtcctcgacaaaaaccacgtagcagacatcgacaaactcatcgactacgcagccagcggcgaccccacctcccccgacaacatcgactccccgaacgccccctgggttttcgcctgcgcccccgaccgctgcccacccacatgcatctacgtcgccggcatggccgaactcggcgcgttcttcagcatcctccaagatatgcgaaacacaatcatggcatcaaaaacagtcggcaccgccgaagaagaagtcaaaaagaaaagctccttctaccaatcctacctccgccgcacccagagcatgggcatccaactggaccaacgcatcatcctcctcttcatgctcgaatggggcaaagaaatggtagaccacttccacctcggcgatgacatggacccagaactacgcggactcgcacaagcactaatcgaccaaaacgtcaaagaaatctccaaccaagaacccctaaaaatataa

SEQ ID NO: 7905 - RNA, 1302 nt, synthetic construct
  misc_feature 1..1302: note = derived and/or modified CDS sequence (opt11) from PUUV(PUUV/Konnevesi/Mg_O6B/2005)__JQ319164.1__N
  source 1..1302: mol_type = other RNA
atgtccgacctaaccgacatccaagaagacatcacccgccacgaacaacaactcgtcgtcgcaagacaaaaactaaaagacgccgaacgcgccgtcgaagtcgaccccgacgacgtcaacaaaaacacactacaggcacgccaacaaactgtctccgcccttgaagacaaactcgcagactacaaacgcaggatggcagacgccgtctcccgaaagaaaatggacaccaaaccaacagaccccaccggcattgaacccgacgaccacctcaaagaacgctcatcattacgctacggcaacgtcctagacgtcaacgcaatagacatcgaagaacccagcggccaaacggcagactggtacaccatcggcgtctacgtaatcggattcaccctccccatcatcctcaaagcactctacatgctctcaacccgaggcaggcaaaccgtcaaagaaaacaaagggacccgcatccgcttcaaagacgacacatcattcgaagacatcaacggcataagacgccccaaacacctctacgtctcaatgcctacagcacaatcaaccatgaaagccgaggaactcacccccggccgcttcagagccatcgtatgcggactcttccccacccaaatacaagtccgcaacatcatgagccccgtcatgggcgtaataggcttctcgttcttcgtcaaagactggcccgaacgaatccgcgagttcatgggaaaagaatgccccttcataaagcctgaagtcaaacccggcacccccgcacaagaaatagaaatgctaaaacgcaacaaaatatacttcatgcagcgacaagacgtcctggacaaaaaccacgtcgctgacatagacaaactaatcgactacgccgcctccggcgatcccaccagcccagacaacatagacagtccgaacgcaccctgggtcttcgcctgcgcccccgaccgatgcccgccgacctgcatctatgtagccggaatggccgaactcggcgcattcttctccattctccaagacatgagaaataccatcatggccagcaaaacagtaggcaccgccgaagaaaaactcaaaaagaaaagctcgttctaccaatcctacctacgcagaacccaatcaatgggcatccaactcgaccaacgcatcatcctcctatttatgctcgagtggggcaaagaaatggtcgaccacttccacctaggcgacgacatggaccccgaactacgaggcctcgcccaagccctcatcgaccaaaaagttaaagaaataagcaaccaagaacccctaaaaatctaa

SEQ ID NO: 7906 - RNA, 1302 nt, synthetic construct
  misc_feature 1..1302: note = derived and/or modified CDS sequence (opt11) from PUUV(PUUV/Konnevesi/Mg_O74B/2005)__JQ319170.1__N
  source 1..1302: mol_type = other RNA
atgagcgacctcaccgacatccaagaagacatcaccagacacgaacaacagctagtcgtcgcccggcaaaaactcaaagacgccgaacgcgccgtagaagtcgaccccgacgacgtcaacaaaaacacactccaagcccgccaacaaaccgtatccgcactagaagacaaactagccgactacaaacgccgtatggccgacgccgtctcccgtaagaaaatggacacaaaaccaaccgaccccacaggcatcgaaccggacgaccacctcaaagaacgttcctcactacgctacggcaacgtcctcgacgtaaacgcaatcgacattgaggaaccctccggccaaacagccgactggtacacaatcggcgtctacgtcatcggcttcaccctcccaataatactaaaagcactatacatgctgagcacccgcggtcgccaaacagtcaaagaaaacaaaggcacccgcatccgattcaaagacgacacctccttcgaagacatcaacggcatccgtcgccccaaacacctgtacgtctccatgcccacagcccaatccacaatgaaagccgaagaacttacaccaggccgcttccgcacaatcgtctgcggcctattccccacccaaatacaagtaagaaacataatgtcccccgttatgggcgtaataggcttctccttcttcgtcaaagactggcccgagcgcatccgcgagttcatggaaaaggaatgccccttcatcaagcccgaagtaaaacccggaacccccgcccaagaaatcgagatgctaaaaagaaacaaaatctacttcatgcaacgacaagacgtgctagacaaaaaccacgtagccgacatcgacaaactaatcgactacgcagcatcaggcgaccccaccagcccagacaacatagactcgcccaacgccccctgggtattcgcctgcgcacccgaccgctgcccacccacatgcatctacgtcgcaggcatggccgaactcggcgccttcttctcaatcctccaagacatgcgcaacacaataatggcgtccaaaaccgtcggcacagtagaagaaaagctaaagaagaaatccagcttctaccaaagctacctccgccggacccaatccatgggcatacaactagaccaacgcattatcctactattcatgctcgagtggggcaaagaaatggtcgaccacttccacctcggggacgacatggacccagaactccgcggcctcgcccaagccctaatcgaccaaaaagtcaaagaaatctcaaaccaagaacccctaaaaatataa

SEQ ID NO: 7907 - RNA, 1302 nt, synthetic construct
  misc_feature 1..1302: note = derived and/or modified CDS sequence (opt11) from PUUV(PUUV/Konnevesi/Mg_O78A/2005)__JQ319162.2__N
  source 1..1302: mol_type = other RNA
atgtccgaccttaccgacatacaagaagacattacccgccacgaacaacaactggtcgtcgccagacaaaaactgaaagacgccgaaaaagccgtcgaagtagaccccgacgacgtaaacaagaacaccctccaagcccgccaacaaaccgtctcagccctcgaagacaaactcgctgactacaaacgccgaatggccgacgccgtatcacgaaagaaaatggacacaaaacccaccgaccccacaggcatcgaacccgacgaccacctcaaagaacgcagctccttacgctacggcaacgtcctggacgtcaacgcaatcgacatcgaggagccctccggccaaaccgccgactggtacacaataggcgtatacgtaataggattcaccctcccgatcatcctcaaagccctctacatgctcagcacacgcggccgccaaacagtcaaagaaaacaaaggaacacgaatccgcttcaaagacgacaccagcttcgaagacatcaacggaatccgccgccccaaacacctctacgtttccatgcccactgcccaatccacaatgaaagccgaagaactaacccccggacgcttccgcaccatcgtctgcggcctcttcccaacacaaatccaagtccgaaacatcatgagcccagtcatgggcgtcataggcttctccttcttcgtcaaagactggccagaaagaatacgagagttcatggaaaaagaatgccccttcatcaaacccgaagtcaaaccaggcacaccagcacaagaaatcgaaatgcttaaacgaaacaaaatctacttcatgcaacgccaagacgtactcgacaaaaaccacgtagcggacatcgacaaacttatcgattacgcagcctccggcgaccccacctcccccgacaacatcgactccccaaacgctccctgggtccttgcatgcggacccgaacgctgcccaccaacctgcatctacgtcgctggcatggccgaacttggcgccttcttctcaatactccaggacatgcgaaacaccatcatggccagcaaaacagtaggaagcgacgaggtcaaactcaaaaagaaatccttcttctaccagtactacctacgacgaacccactccatgggcatccaactcgaccaacgcatcatcttactctgcatgctagaatggggcatcgaaatggtcgaccacttccacctaggcgacgacatggaccccgaactccgcggcctagcacaagcaatgatcgaccagaaagtcaaagaaatatccaaccaagaacccctaatcatataa

SEQ ID NO: 7908 - RNA, 1302 nt, synthetic construct
  misc_feature 1..1302: note = derived and/or modified CDS sequence (opt11) from PUUV(PUUV/Mg23/HungaryTR17/00)__FN377822.1__N
  source 1..1302: mol_type = other RNA
atgtcagacctcacagacatccaagaagacatcacacgacacgaacaacagctagtcgtcgcacgacaaaaactaaaagacgcagaaaaggccgtagaaatggacccagacgacgtcaacaagaacacattacaagcacgccaacaaacagtctccgcgctcgaagacaaactcgccgacttcaaacgaagaatggcagacgccgtcagccgcaagaaaatggacacgaaaccaacagaccccaccggcatcgaaccagacgaccacctaaaagaacgctccagcctccgctacggcaacgtactcgacgtcaacgccatagacatcgaagaacccagcgggcaaaccgccgattggtacaccataggcgtctacgtcatcggattcaccctccccattattctcaaagcactgtacatgctctcaacccgcggcagacaaaccgtcaaagaaaacaaaggcacccgcatacgattcaaagacgacacatccttcgaagacatcaacggcatccgccgacccaaacacctctacgtctccatgccgaccgcgcaatccacaatgaaagccgaagaactaaccccaggccgattccgcaccatcgtctgcggactcttccccacacaaatacaagtacgaaacataatgagccccgtaatgggcgtcatagggttctcattcttcgtcaaagactggtccgaacgcgtacgagagttcatggaaaaagaatgcccattcataaagccagaaataaaaccaggcaccccaccccaagaagccgagttcctaaagcgcaacaaagtatacttcatgcagcgacaagacgtactcgacaaaaaccacgtcgcagacatagacaaactcatcgactacgccgcatcaggcgaccccacatccccagacaatatcgaaagccccaacgccccctgggtattcgcctgcgctcccgacagatgcccgccaacctgcatctacgtagccggaatggccgaactcggagcattcttcagcatcctacaagacatgcgaaacaccatcatggccagcaaaaccgtcgggaccgcggaagaaaagctcaaaaagaaatccagcttctaccaaagctacctccgcagaacacaaagcatgggcatccaactggaccaacgaattatcctcctctatatgctagaatggggcaaggaaatggtcgaccacttccacctcggagacgacatggaccccgaactccgcggcctggcccaagcactcatagaccaaaaagtcaaagaaatctccaaccaagaacccctaaaaatctaa

SEQ ID NO: 7909 - RNA, 1302 nt, synthetic construct
  misc_feature 1..1302: note = derived and/or modified CDS sequence (opt11) from PUUV(PUUV/Mg9/HungaryTR17/00)__FN377821.1__N
  source 1..1302: mol_type = other RNA
atgtccgacctcgccgacatccaagaagacatcacccgacacgaacaacaactcgtcgtcgcaaggcaaaagctaaaagacgcggaaaaagccgtagaaatggacccagacgacgtcaacaaaaacacactacaagcccgccaacaaactgtctcagcactcgaagacaagctcgccgacttcaaaagacgcatggcagacgcagtctcaagaaagaaaatggacaccaaaccaaccgaccccacaggaatcgaacccgacgaccacctcaaagaacgctccagcctcagatacggcaacgtcctcgacgtcaacgccatcgatatcgaagaaccgagcggccaaacagccgactggtacaccatcggcgtctacgtcatcggcttcaccctcccgataatcctaaaagccctgtacatgctatcaaccaggggcagacaaactgtcaaagaaaacaaaggcacacgcatccgattcaaagacgacacctcgttcgaagacatcaacggaatccgccgccccaaacacctatacgtctcaatgccaaccgcacaatcaaccatgaaagcagaagaactcacacccgggcgcttccgaaccatcgtctgcggcctattccccacacaaatccaagtgcgaaacatcatgagcccagtcatgggcgtcataggattcagcttcttcgtcaaagactggtcagaacgagtgcgcgagttcatggaaaaagaatgccccttcatcaaacccgaaatcaaacccggaaccccaccccaagaagccgagttcctgaagcgcaacaaagtatacttcatgcaacgccaagacgtgctcgacaaaaaccacgtagccgacatagacaaactcatagactacgcagcctctggcgaccccaccagccccgacaacatcgaaagcccgaacgcaccctgggtcttcgcctgcgcccccgaccgatgcccacccacatgcatctacgtcgccggcatggccgaactcggcgcattcttctccatactccaagacatgcgcaacacaataatggcatccaagaccgtcggcaccgccgaagaaaagctgaaaaagaaatcctcgttctaccaatcatacctgcgcagaacccagagcatgggcatccaactagaccagcgaataatcctactatacatgctcgaatggggcaaagaaatggtcgaccacttccacttgggcgacgacatggaccccgaactccgtggcctcgcacaagcactcatagaccaaaaagtgaaagaaatctcaaaccaagaaccactaaaaatctaa

SEQ ID NO: 7910 - RNA, 1302 nt, synthetic construct
  misc_feature 1..1302: note = derived and/or modified CDS sequence (opt11) from PUUV(PUUV/NL/Mg1012/2010)__KU314900.1__N
  source 1..1302: mol_type = other RNA
atgtccgacctcaccgacatacaggaagacataacccgccacgaacaacagctagtagtagcaagacaaaaactcaaagacgccgaaaaggccgtcgaaatggacccagacgacgtcaacaaaaataccctacaagcccgccaacaaacagtctcagctctagaagacaaactcgccgactacaaacgacgcatggcggacgccgtctcgcgcaagaaaatggacacaaaacccaccgacccaaccggcatagaaccagacgaccacctcaaagaacgctcaagcctccgctacgggaacgtcctcgacgtcaacgccatcgacatagaggaacccagcggccaaaccgccgactggtacacaatcggcgtctacgtcatcggattcaccctccccatcatcctcaaagcactatacatgctctccactcgaggacggcaaacagtcaaagaaaacaaaggtactcgtatccgtttcaaagacgacacctccttcgaagacataaacggaatccgaagaccgaaacacctatacgtctccatgcccaccgcccaatccacaatgaaagccgaagaactaacccccggccgattccgcacaatcgtatgcgggctattccccacccaaatccaagtgcgcaacatcatgtcccctgtaatgggcgtaatcggcttctccttcttcgtcaaagactggccagaccgaatccgagagttcatggaaaaagaatgccccttcatcaaaccagaagtcaaacccggcacccccgcccaagaagccgagttcctaaaacgcaacaaagtctacttcatgcaacggcaagacgtcctcgacaaaaaccacgtagcagacatcgacaagctaatcgactacgccgcctccggcgaccccacctccccagacaacatcgaatcacccaacgcaccctgggtcttcgcctgcgcgccagaccgttgcccacccacatgcatctacgtggccggcatggccgaactcggcgcattcttctccatactacaagacatgcgcaacactattatggccagcaaaaccgtcggcgccgccgaagaaaaactcaaaaagaaatcctcattttaccaatcctacctccgccgaacccaaagcatgggcatccaactggaccaacgcatcatcctactatacatgctagaatggggcaaagaaatggtcgaccacttccacctaggcgacgacatggaccccgaactccgcggcctcgcccaagccctcatcgaccaaaaagtcaaagaaatctccaaccaagaacccctaaaaatctaa

SEQ ID NO: 7911 - RNA, 1302 nt, synthetic construct
  misc_feature 1..1302: note = derived and/or modified CDS sequence (opt11) from PUUV(PUUV/NL/Mg1439/2011)__KU314901.1__N
  source 1..1302: mol_type = other RNA
atgagtgacctaaccgacatccaggaagacatcacccgacacgaacaacaactcgtagtcgcccgccaaaaactaaaagacgccgaaaaagcagtcgaaatggaccccgacgacgtcaacaaaaacacactccaggcccgccaacagacagtatcggccctcgaagacaaactagccgactacaagcgccgaatggccgacgccgtatcaagaaagaaaatggacacgaaaccaactgacccaaccggcatagaaccagacgaccacctaaaagaacgctcatccctgcgatacggcaacgtcctagacgtcaacgccatcgacatcgaagaaccatccggccaaaccgcagactggtacacaatcggcgtatacgtcataggattcacactccccataatcctcaaagccctctacatgctctccacacgcggccgacaaaccgtcaaagaaaacaagggagcacggatccgcttcaaagacgacacctcgttcgaggacatcaatggaatccgcagaccaaaacacttatacgtctccatgcctacagcgcagtcaaccatgaaagcagaagaactcacccccggacgcttccgaaccattgtctgcggcctgttccccacacagatccaagtccgcaacataatgagccccgtcatgggcgtcataggctttagcttcttcgtcaaagactggccagaccgcatacgcgagttcatggaacgcgaatgccccttcataaaacccgaagtcaaacccggcacgcccgcacaagaagcagagttcctgaaacgcaacaaagtctacttcatgcaacgccaagacgtcctcgacaaaaaccacgtcgccgacatcgacgaactaatcgactacgccgcaagcggagacccgacaagcccagacaacatcgaatcaccaaacgccccctgggtcttcgcctgcgcccccgaccgctgcccaccaacctgcatatacgtcgcaggcatggccgaactaggagcattcttctccatcctccaggacatgaggaacaccataatggccagcaaaaccgtcggcacagccgaagaaaagctcaaaaagaaatcctcgttctaccagtcatatctacgacgcacacaaagcatgggcatccaactagaccagcgcataatcctcctatacatgctcgaatggggaaaagaaatggtagaccacttccacctaggcgacgacatggaccccgaactccgcggcctcgcccaagccctcatagaccaaaaagtcaaagaaatctccaaccaagaacccctcaaaatctag

SEQ ID NO: 7912 - RNA, 1302 nt, synthetic construct
  misc_feature 1..1302: note = derived and/or modified CDS sequence (opt11) from PUUV(PUUV/NL/Mg2/2008)__KU314902.1__N
  source 1..1302: mol_type = other RNA
atgagcgacctcaccgacatccaggaagacatcacacgccacgaacaacagctagtagtcgccagacaaaaactcaaagacgccgaaaaagcagtagaaatggaccccgatgacgtcaacaaaaccaccctccaagcacgacaacaaaccgtcagcgccctcgaagacaaactcgccgacttcaaacgccaaatggccgacgccgtctcccgcaagaaaatggacacaaaacccgccgaccccaccggaatcgaacccgacgaccacctcaaagaacgaagctccctaagatacggaaacgtcctcgacgtcaacgcgatcgacatcgaagaaccgagcggccaaaccgccgactggtacacaataggagtctatgtcatcggcttcacactccccatcatcctaaaagccctctacatgctctcaacccgaggccgacaaaccgtgaaagaaaacaaaggaacccggatcagattcaaagacgacacatccttcgaagatatcaacggcataagacgacccaaacacctctacgtctcgatgcccaccgcccaaagcacaatgaaagctgaggaactcacacccggccgcttccgcaccatcgtctgcggtctattccccacccaaatccaagtccgcaacataatgagccccgtaatgggcgtaatcggcttctcattcttcgtcaaagactgggccgaccgcatccgcgagttcatggaaaaagaatgcccattcataaaaccagacgtaaaacccggaacccccgcccaagaagcagagttcctcaaacgcaacaagatctacttcatgcagcgacaagaagttctagacaaaaatcacgtagccgacatcgacaaacttatagactacgcagcctcaggcgaccccacctcacccgacaacatcgaaagccccaacagcccatgggtgttcgcctgcgcccccgaccgctgcccgccaacctgcatttacgtcgcaggcatggcagaattaggcgccttcttctcaatcctccaggacatgcgcaacacgataatggccagcaaaacagtaggtacagccgaagaaaaactcaagaagaaatcatccttctaccaatcctacctgcgacgcacccaaagcatgggcatccaactcgaccaacgcatcatcctcctctacatgctagaatggggaaaagaaatggtcgaccacttccacctcggagacgacatggatcccgaactccgtggactcgcccaagccctaatcgaccaaaaagtcgaagaaatcagcaaccaagaacccttaaaaatctaa

SEQ ID NO: 7913 - RNA, 1302 nt, synthetic construct
  misc_feature 1..1302: note = derived and/or modified CDS sequence (opt11) from PUUV(PUUV/NL/Mg25/2007)__KU314897.1__N
  source 1..1302: mol_type = other RNA
atgtccgacctaacagacatacaagaagacataacccgacacgaacaacagctagtcgtagcacgccaaaaactcaaagacgcagagaaagcagtcgagatggaccccgacgacgtcaacaaaaacaccctgcaagcacgacaacaaaccgtcagcgccctagaagacaaactagccgactacaaacgccgcatggccgacgccgtatcacgcaagaaaatggacaccaaacccaccgaccccaccggcatcgaaccagacgaccacctcaaagaacgctcatccctccgatacggcaacgtcctcgacgtaaacgcaatagacatcgaagaaccatccggacaaaccgccgactggtacaccatcggagtctacgtcatcggcttcacactaccaatcatactcaaagctctctacatgctcagcacccgaggtcgccaaaccgtaaaagaaaacaaaggcacccgcatccgcttcaaagacgacaccagcttcgaagacataaacggcatcagacgccccaaacatctatacgtatcaatgccaacagcccaatccacaatgaaagccgaagaactcacccccggccggttccgcaccatcgtctgcggactattccccacacaaatccaagtaagaaacatcatgtctcccgtcatgggagtcatcggcttctcattcttcgtcaaagactggcccgaccgaatacgcgaatttatggaaaaagaatgccctttcatcaaacccgaggtcaaacccggcacgccagcacaagaagccgagttcctcaaacgaaacaaagtctacttcatgcaacgccaagacgtactcgacaaaaaccacgtagccgacatagacaaactaatcgactacgccgcatcgggtgaccccaccagccccgacaacattgaatccccaaacgccccctgggtcttcgcctgcgcaccagaccggtgtcccccaacctgcatttacgtcgccggcatggcagaactgggagccttcttctccatcctccaagacatgagaaacaccatcatggcctccaaaacagtcggcaccgcagaagaaaaactcaaaaagaaatcatccttctaccaaagctacctccgacggacacaaagcatgggaatccaactcgaccaacgaataatcctactctacatgctcgaatggggcaaagaaatggtcgatcacttccacctaggcgacgacatggaccctgaactccgtggcctcgcccaagccctcatcgaccaaaaagtcaaagaaatcagcaaccaagaacccctcaaaatctga

SEQ ID NO: 7914 - RNA, 1302 nt, synthetic construct
  misc_feature 1..1302: note = derived and/or modified CDS sequence (opt11) from PUUV(PUUV/NL/Mg31/2007)__KU314896.1__N
  source 1..1302: mol_type = other RNA
atgtccgacctaaccgacatccaagaagacatcacccgccacgaacaacaactagtagtcgccagacaaaaactcaaagacgccgaaaaagccgtcgaaatggaccccgacgacgtcaacaaaaacaccctacaagcccgacaacaaaccgtctccgcccttgaagacaaactcgccgactacaaacgccgcatggccgacgccgtctctcgtaaaaaaatggacaccaaacccaccgacccaaccggcatcgaaccagacgaccacctcaaagaacgctcaagcctccgctacggcaacgtcctagacgtcaacgccatagacatagaagaacccagcgggcaaaccgccgactggtacaccatcggcgtatacgtaatcggcttcaccctcccgatcatcctcaaagccctctacatgctctcaacccggggcagacaaaccgtgaaagaaaacaaaggcacgcgcatcaggttcaaagacgacaccagctttgaagacatcaacggaatccgccgcccaaaacacctctacgtcagcatgccaaccgctcaatccaccatgaaagcagaggaactcacacccggccgcttccgaacaatcgtctgcggcctattccccacccagatccaagtccggaacatcatgtcccccgtaatgggtgtaatcggcttctccttcttcgtcaaagactggcccgaccgcatcagagaattcatggaaaaagaatgcccctttataaaacccgaagtcaaacccggaaccccggctcaagaagccgaattcctaaaacgcaacaaagtctacttcatgcaacgtcaagacgtacccgacaagaaccacgtcgcagacatcgacaaactcatcgactacgccgcgtccggcgaccccacatccccagacaacatagaatcccccaacgccccctgggtcttcgcatgcgccccagacagatgcccaccgacctgcatctacgtcgcgggaatggccgaactaggcgcattcttctccatactccaagacatgcgaaacaccatcatggcctccaaaaccgtcggaacagccgaggaaaaactaaaaaaaaaatcatcattctaccaaagctatctccgacgcacacagtcgatgggcatccaactagaccaacgcattatcctattatacatgctagaatggggcaaagaaatggtcgaccacttccacctcggagacgacatggacccagaactccgcggcctcgcccaagcactaatcgaccaaaaagtcaaagaaatctccaaccaagaacccctaaaaatctaa

SEQ ID NO: 7915 - RNA, 1302 nt, synthetic construct
  misc_feature 1..1302: note = derived and/or modified CDS sequence (opt11) from PUUV(PUUV/NL/Mg502/2008)__KU314904.1__N
  source 1..1302: mol_type = other RNA
atgtccgacctcaccgacatccaagaagacataacacgacacgaacaacaactagtcgtcgcccgccagaaactaaaagacgcagaaaaagccgtcgaaatggaccccgacgacgtcaacaaaaacaccctccaagcccgacaacaaaccgtcagcgccctcgaagacaaactcgccgacttcaaacgccaaatggcagacgccgtctcccgcaaaaaaatggacaccaaacccgccgacccaaccggcatcgaacccgacgaccacctaaaagaacgcagcagcctccgatacggtaacgtcctagacgtcaacgccatcgatatcgaagaaccctccggacaaacagctgactggtacacaatcggcgtctacgtcatcggcttcaccctccccatcatcctaaaagcactctacatgctgtcaacacgaggaagacaaaccgtaaaagaaaacaaaggtacacgaatccgcttcaaagacgacacaagcttcgaagatatcaacggcataagacggcccaagcacctgtacgtctccatgcccaccgcccaatccaccatgaaagccgaagagctcaccccaggacgctttcgcacaatcgtctgcggcctattccccacccaaatccaagtccgaaacataatgagccccgtaatgggcgtaatcggcttcagcttcttcgtaaaagactgggccgaccgcatacgagagttcatggaaaaagaatgtcccttcatcaaaccggatgtaaaaccaggaaccccagcccaagaagcagaattcttaaaacgcaacaaaatctacttcatgcaacgccaagaggtcctcgacaaaaatcatgtagccgacatcgacaaactaatcgactacgccgcaagcggagaccccacatcccccgacaacatcgagtcccccgacagcccctgggtcttcgcctgcgcccccgaccgctgccccccaacatgcatatacgtcgccggcatggcagaactcggcgccttcttctccattctccaagacatgcgaaacaccatcatggccagcaaaaccgtaggaacagccgaagaaaaactcaaaaaaaaaagctccttttaccaatcatacctccgccgaacccaatcaatgggaatacaactagaccaacgcataatcctactctacatgctagagtggggcaaagaaatggtagaccacttccacctcggagacgacatggaccccgaactaagaggcctagcccaagccctcatcgaccaaaaagtcaaagagatcagcaaccaagaacccctaaaaatataa

SEQ ID NO: 7916 - RNA, 1302 nt, synthetic construct
  misc_feature 1..1302: note = derived and/or modified CDS sequence (opt11) from PUUV(PUUV/NL/Mg591/2008)__KU314905.1__N
  source 1..1302: mol_type = other RNA
atgtccgacctaaccgacatccaagaagacatcacacgccacgagcagcagctagtcgtcgcccgccaaaagctcaaagacgcagaaaaagccgtcgaaatggaccccgacgacgtcaacaaaaacaccctacaagccagacaacaaaccgtcagcgccctcgaagacaaactcgccgacttcaaacgacaaatggcagacgccgtctcacgtaagaaaatggacaccaaacccaccgaccccaccggcatcgaacccgacgaccacctaaaagaacggtccagcctccgctacggaaacgtcctagacgtcaacgccatcgacatcgaagaaccctcaggccaaaccgcagactggtacaccataggcgtctacgtgatcggattcaccctccccatcatcctcaaagccctatacatgctcagcacccgcgggcgacaaaccgtcaaagaaaacaaaggcacacgcatccgcttcaaagacgacacctccttcgaggacataaatggcatacgccgacctaaacacctctacgtaagcatgcccaccgcccaatccaccatgaaagcagaagaactaacacccggccgattccgaaccatcgtatgcggtctattccccacccaaatacaagtacgcaatatcatgagccccgtcatgggcgtaatcggcttctcattcttcgtcaaagactgggccgaccgcatacgagagttcatggaaaaagaatgcccattcatcaaacccgacgtcaaaccaggcacccccgcccaagaagccgagttcctcaaacgaaacaaaatctacttcatgcaacgtcaagaagtgctggacaaaaaccacgtcgccgatatcgacaaactcatcgactacgccgcaagcggagacccaacctccccagacaacatcgaatccccaaactcaccctgggtcttcgcctgcgccccagaccgctgcccaccaacctgcatctacgtcgcaggcatggcagaacttggagccttcttctcgatcctacaagacatgcgcaacacaatcatggcgtccaaaaccgtcggaacagccgaagaaaaactcaaaaagaaatcctcattctaccaaagctaccttcgccgaacccaatccatgggcatccaactcgaccaacgaatcatactcctctacatgctagaatggggcaaagaaatggtcgaccacttccacttaggcgacgacatggaccccgaactacgcagcctagcacaagctctaatcgatcaaaaagtcaaagaaatctccaaccaagaacccctgaaaatctga

SEQ ID NO: 7917 - RNA, 1302 nt, synthetic construct
  misc_feature 1..1302: note = derived and/or modified CDS sequence (opt11) from PUUV(Samara_49/CG/2005)__AB433843.2__N
  source 1..1302: mol_type = other RNA
atgtctgacctaacagacatacaagaagaaatcactcgtcacgaacaacaactagtcgtcgccaggcaaaaactcaaagacgccgaacgggccgtagaagtagaccccgacgacgtcaacaaaaacaccctgcaagcacgacaacaaacagtcagcgccctagaagacaaactcgccgactacaaacgccgcatggcagacgcggtctcccgcaaaaaaatggacactaaaccaaccgaccccaccggaatcgaacccgacgaccacctcaaagaacgatcctccctacgctacggcaacgtcctagacgtcaacgcaatcgacatcgaagaacccagcggccaaacagcagactggtacacaatcggagtatacgttatcggcttcaccataccaattatcctaaaagccctctatatgctatcaacccgaggccgccaaacagtcaaagaaaacaaaggcacccgcatccgatttaaagacgacacatcattcgaagacataaacggcatacgccgacccaaacacctctacgtttcaatgcccaccgcccaatccacaatgaaagccgaagaacttacccccgggagattccgcacaatagtatgcggcctcttcccaacccaaatccaggttcgcaacatcatgagccccgtcatgggagtcatcggcttcagcttcttcgtcaaagactggcccgaaaggatccgcgaattcatggagcgagaatgccccttcatcaaaccagaagtaaaacccggaacccccgcccaagaagtagaattcctaaaacgcaaccgtgtgtacttcatgacccgacaagacgtcctcgacaaaaaccacgtagccgacatcgataaactcatcgactacgccgcatccggcgaccccacctcaccagacgacatcgaatccccaaacgccccatgggtcttcgcatgcgctcccgaccgatgcccacccacatgcatctacgtcgctggcatggctgaactcggcgccttcttctccatcctccaggatatgcgcaacacaataatggcctccaaaaccgtcggaacagccgaagaaaaactcaaaaaaaaatcctccttctaccaatcctacctgagacgcacacaaagcatgggcatacaactggaccaacgcatcatcctcctatacatgctagaatggggaaaagaaatggtcgaccacttccacctgggcgacgacatggatccagaactccgaggcctcgcccaatcactcatcgaccagaaagtcaaagaaatctcgaaccaagaacccctcaaaatctaa

SEQ ID NO: 7918 - RNA, 1302 nt, synthetic construct
  misc_feature 1..1302: note = derived and/or modified CDS sequence (opt11) from PUUV(Thuin/33Cg/96)__AJ277030.1__N
  source 1..1302: mol_type = other RNA
atgtccgacctcacagacatccaagaagacatcacccgacacgaacaacaactcgtcgtcgccagacaaaaactaaaagatgccgaaaaagcagtcgaaatggaccccgacgacgtaaacaaaaacaccctccaagcacgccaacaaacggtctcagccctagaagacaaactcgcggacttcaaaagacaaatggccgacgccgtctcccgcaagaaaatggacacaaaaccaaccgaccccacaggcatcgaacccgacgaccacctcaaagaacgctcatcactacgatatggaaacgtcctagacgtcaacgccatagacatcgaagaaccaagcggccaaacggccgactggtacaccatcggcgtatacgtaatcggcttcaccctcccaatcatcctcaaagccctctacatgctctcaacccgcggccgccaaaccgtcaaagaaaacaaaggaacacgaatccgattcaaagacgacacctccttcgaagacatcaacggtatacgccgcccaaaacacctatacgtctcaatgcccacagcgcaatccacaatgaaagccgaagaactcacaccaggccgattccgaaccatcgtctgcggcctattccccacccaaatccaagtccgcaacataatgtctccagtaatgggcgtcatcggcttctcattcttcgtcaaagactgggccgaccgaatccgagaatttatggaaaaagaatgccctttcatcaagcctgaagtaaaacccggaacacccgtgcaagaagccgagttcctcaagcgcaacaaaatctacttcatgcaacgccaggaagtactcgacaaaaaccacgtcgcagacatagacaaactaatcgactacgcagccagcggcgaccccacctcccccgacaacatagaagcacccaacgcgccctgggtgtttgcatgcgccccagaccgctgcccgccaacctgcatctacgtagccgggatggccgaacttggcgccttcttcagcatcctccaagacatgcggaacaccatcatggcctccaagaccgtcggcaccgcagaagaaaaactcaaaaagaaaagctcattctaccaatcctacttacgaagaacccaaagcatgggcatacaactcgaccaacgcattatcctcctctatatgctagaatggggcaaagaaatggtagaccacttccacctaggcgacgacatggaccccgaactacgcggcctcgcccaagcactaatcgatcaaaaagtcaaagaaatcagcaaccaagaacccctaaaaatctaa

SEQ ID NO: 7919 - RNA, 1302 nt, synthetic construct
  misc_feature 1..1302: note = derived and/or modified CDS sequence (opt11) from PUUV(Udmurtia/338Cg/92)__Z30708.1__N
  source 1..1302: mol_type = other RNA
atgtcagacctcaccgacatccaagaagaaataacacgccacgaacaacagctagtcgtagcacgccaaaagctaaaagacgccgaacgagccgtcgaagtcgaccccgacgacgtcaacaaaaacaccctccaagcacgacaacaaacggtaagcgccctagaagacaaactggccgactacaagcgccgtatggcagactccgtttcacgcaagaaaatggacaccaaacccacagacccaacagggatcgaacccgacgaccacctcaaagaacgctcaagcccccgatacggcaacgtactcgacgtaaacgccatcgacatcgaagaaccctcaggccaaaccgcagactggtacaccatcggcgtctatgtaatcggcttcacaatccccataatactaaaagcactctacatgctctcaacccgcggccgacaaaccatcaaagaaaataaaggcacccgcatccgattcaaagacgatacctctttcgaagacatcaacggcatccgccgccccaaacacctctacgtctcaatgccaacagcacaatcaacaatgaaagccgaagaactaaccccaggacgtttccgtacaatagtctgcggcctattcccaacccaaatccaagtccgcaacatcatgtcccccgtcatgggagtaatcggattctcattcttcgtaaaagactggcccgaacgcatccgcgacttcatggaaaaagaatgccctttcatcaaacccgaggtcaaacccggcacaccagcccaagaaatcgagttcctcaaacgcaaccgagtatacttcatgacccgccaagacgtacttgacaaaaaccacgtagccgacatcgacaaactcatagactacgccgcctccggagaccccacctctcccgatgacatagagtcccccaacgccccctgggtcttcgcatgcgcccccgaccgatgccctccaacctgcatctacgtcgccggcatggccgaactaggagccttcttctctatactccaagacatgcgcaacaccatcatggccagcaaaaccgtcggaactgcagaagaaaaactcaagaagaaatcgtccttctaccaatcatacctccgtcgcacacaatccatgggaatccaacttgaccagagaatcatcctactctacatgctcgaatggggaaaagaaatggtcgaccacttccacctcggcgacgacatggaccccgaactccgcggcctcgcccaaagcctaatcgaccaaaaagtaaaagaaatctcaaaccaagaacccctaaaaatataa

SEQ ID NO: 7920 - RNA, 1302 nt, synthetic construct
  misc_feature 1..1302: note = derived and/or modified CDS sequence (opt11) from PUUV(Udmurtia/444Cg/88)__Z30706.1__N
  source 1..1302: mol_type = other RNA
atgagcgacctcaccgacatccaagaagaaatcactcgccacgaacaacaactcgtcgtcgcacgacaaaaactcaaagacgcagaaagagccgtagaagtcgaccccgacgacgtcaacaaaaacaccctccaagcgcgccaacaaaccgtatcagcattagaggacaaactagccgactacaaacgccgcatggccgacgccgtctcccgcaagaaaatggacacaaaacccaccgaccccacaggcatcgaacccgacgaccacttaaaagaacgatcctccctccgctacggcaacgtcctagacgtaaacgccatagacatcgaagaaccctccggccaaaccgcagactggtacaccatcggcgtctacgtcatcggattcaccatccccatcatcctaaaagccctatacatgctctccacccgaggccgacaaacagtcaaagaaaacaaaggcacacgcatccggttcaaagacgacacctcattcgaagacataaacggcatcagaaggccaaaacacctctacgtatccatgccaaccgcgcaaagcaccatgaaagccgaggaactcacgccaggcagattccgcaccatcgtctgcggactattccccacccaaatccaagtccgtaacataatgtcaccagtcatgggggtaatcggcttctcattcttcgtaaaagactggcccgaacgcatacgagacttcatggaaaaagaatgtcccttcatcaaacccgaagtaaaacccggaacccccgcccaagaaatcgagttcctcaaacgcaaccgagtctacttcatgacacgccaagacgtcctagacaaaaaccacgtggccgacatcgacaaactcatcgactacgcagcttccggcgaccccacgtcccccgacgacatcgaatccccaaacgccccctgggtcttcgcctgcgcccccgaccgctgcccgccaacctgcatctacgtcgcagggatggcagaactaggcgccttcttcagcatcctacaagacatgcgaaacaccatcatggcatcaaaaaccgtgggcaccgccgaagaaaaactaaagaagaaatccagcttctaccaatcatatctccgacgtacccaaagcatgggcatacaactcgaccaacgaatcatcctactctacatgctagaatggggcaaagaaatggtcgaccacttccacctaggcgacgacatggaccccgaactgcgcggcctagcacaatccctcatcgaccaaaaagtcaaagaaattagcaaccaggaacccctcaaaatctaa

SEQ ID NO: 7921 - RNA, 1302 nt, synthetic construct
  misc_feature 1..1302: note = derived and/or modified CDS sequence (opt11) from PUUV(Udmurtia/894Cg/91)__Z21497.1__N
  source 1..1302: mol_type = other RNA
atgagcgacctcacagacatccaagaagaaatcacccgccacgaacaacagctcgtcgtagcccgccaaaagctaaaagacgcagaaagagccgtcgaagtagaccccgacgacgtcaacaaaaacaccctgcaagcccgtcaacaaacagtctccgccctcgaagacaaactcgccgactacaaacgccgcatggcagacgccgtatcacgcaagaaaatggacaccaaacccaccgacccaacaggcatagaaccggacgaccacctcaaagaacgatcaagcctacgctacggcaacgtcctcgacgtcaacgccatcgacatcgaagaaccctcaggccaaaccgccgactggtacacaatcggagtctacgtaataggcttcaccatccccataatcctcaaagcactatacatgctctccacacgaggaaggcaaaccgtaaaagaaaacaaaggtacccgaatccgcttcaaagacgacacctccttcgaagacataaacggcatccgccgcccaaaacatctatacgtcagcatgccaaccgcccaatcaacaatgaaagccgaagaactaacacccgggcgcttcagaaccatagtgtgcggtctcttcccaacacaaatccaagtacgcaacatcatgagccccgtcatgggcgtaatcggcttctcattcttcgtcaaagactggcccgaacgaatccgagacttcatggaaaaagaatgcccatttatcaaaccagaagtaaaaccaggcacccccgcccaagaaatcgagttcctcaaacgcaaccgcgtctacttcatgacacgacaagacgtcctcgacaaaaaccacgtcgccgacatcgacaagctcatcgactatgcagcctccggcgacccgacatccccagacgatatcgaatccccaaacgcaccctgggtattcgcatgcgcccccgaccgctgcccacccacatgcatctacgtcgtcggcatggcggaactgggcgccttcttcagcatccttcaagacatgcgcaacaccatcatggccagcaaaaccgtaggaaccgccgaagaaaaactcaaaaagaaaagctcattctaccaatcctacctccgacgcacacaatcgatgggaatccaactcgaccaaagaatcatactcctatacatgctagaatggggcaaagagatggtcgaccacttccacctaggcgatgacatggaccccgaactccgaggcctcgcccaatccctcatagatcaaaaagtcaaagaaataagcaaccaggaaccactaaaaatatga

SEQ ID NO: 7922 - RNA, 1302 nt, synthetic construct
  misc_feature 1..1302: note = derived and/or modified CDS sequence (opt11) from PUUV(Fusong-Cr-247)__EF442087.1__N
  source 1..1302: mol_type = other RNA
atgtccgacctcaaagacatacaagaagacatcgcccgccacgaacaacagctagtagtcgcacgacaaaaactacgtgacgccgaaaaagcagtcgaaatggacccagacgacgtcaacaacaacactctccaggcccgacaacaaacagtaagcgccctcgaagacaaaatcgcagacttcaaacgacgaatggctgacatcgtaagccgcaagaaaatggacaccaaacccgctgacccaaccggtatcgaaccagacgaccacctcaaagaacgctccagcctacgatacggaaacgtactagacgtcaacgccatcgacatagaagaaccctcaggccaaacagccgattggtacaccatcggcgtttacataatcggcttcacactacccatcatcctcaaagcactctacatgctatccacccgcggccgccaaaccgtgaaagaaaacaaaggcacccgaatcagattcaaagacgacacatccttcgaagacgtcaacggaatccgtcgccccaaacacctctacgtaagcatgccaacagcccaatcaacaatgaaggccgaagaactcaccccaggccgcttccgaaccatagtctgcggactcttccccacccaaatccaagtcaggaacacaatgtcaccagtaatgggcgtcatcggcttctccttcttcgccaaagactggccagaccgaataaaagagttcatggaaaaagaatgcccattcataaaacccgaagtcaaaccaggcacacccgccaaagaagtagaaatcctcaaacgcaacaaaatatacttcatgcaacgacaagacgtcctcgacaaaaaccacgtacccgatatcgacaaactaatagactacgccgcctccggcgacccaacaagcccagaaaacatcgactcccccaacgccccctgggtcttcgcctgcgcccccgaccgctgcccacccacatgcatctacgtcgccggcatggccgaactaggagccttcttctcaatcctgcaagacatgcgcaacaccataatggcatcaaaaacagtcggcacagccgaagagaaactaaagaagaaaagcagcttctaccaaagctacctaagaagaacccaatccatgggaatccaactcgaccaacgcatcatcctcctatacatgctcgaatggggcaaagaaatggtcgaccacttccacctaggcgacgacatggaccccgaactcagaagcctcgcccaagccttaatcgatcaaaaagttaaagaaatctccaaccaagaacccctaaaaatctaa

SEQ ID NO: 7923 - RNA, 1302 nt, synthetic construct
  misc_feature 1..1302: note = derived and/or modified CDS sequence (opt11) from MUV(11-4)__JX046484.1__N
  source 1..1302: mol_type = other RNA
atgagcgacctcaaagaaatccaagaagacatcgcccgccacgaacagcaactcgtagtcgctcgccaaaaactccgagacgccgaaaaagccgtcgaagtcgaccccgatgacgtaaacaaaaacaccctacaagcccgtcaacaaaccgtctcagccctggaagacaaactcgcagacttcaaacgacaaatggccgacttcgtcagccgcaagaaaatggacacaaaacccaccgaccccacaggcatcgaacccgacgaccacctcaaagaacgctccagcctccgctacggcaacgtcctagacgtcaacgccatcgacatcgaagaaccctccggccaaacagccgactggtacaccataggcgtctacataatcggcttcacactccccatcgtactcaaagccctctacatgctatccacacgcggccgccaaaccgtcaaagaaaacaaaggcacgcgaatccgattcaaagacgacacatccttcgaagacataaacggcattcgacgccccaaacacctctacgtctccatgcccaccgcccaatcaaccatgaaagcagaagaactcacccctgggcgctttcgtaccatcgtatgcggcctattccccacccaaatacaagtccgcaacatcatgtcccccgtcatgggagtcatcggattctccttcttcgtcaaagactgggccgaccgcatcaaagaatttatggaaaaggaatgtcccttcatcaaacctgaacccaaacccggcacccccgccagcgaagtcgagttcctcaaacgaaacaaaatctacttcatgtcccgccaagacgtcctcgacaaaaaccacgtccccgacatcgacaagctaatagactacgccgcctccggcgaccccacctccccagacaacatcgaagaccccaacgccccctgggtattctcctgcgcaccagaccgctgccctccaacctgcctctacgtcgcaggcatggccgaactcggcgccttcttcagcatactacaagacatgcggaacaccataatggcgtcaaaaaccgtaggcaccgccgaagaaaaactcaagaaaaagagctccttttaccaatcctacctacgacgcacccaaagcatgggaatccagctcgaccaacgcatcatactgctatacatgctcgaatggggcaaagaaatggtcgaccacttccatctaggcgacgacatggaccccgaactccgcactctcgcacaagccctcatcgaccagaaagtcaaagaaatatccaaccaggaacccctaaaaatctaa

SEQ ID NO: 7924 - RNA, 1302 nt, synthetic construct
  misc_feature 1..1302: note = derived and/or modified CDS sequence (opt11) from MUV(00-18)__DQ138128.1__N
  source 1..1302: mol_type = other RNA
atgtccgacctcaaagagatccaggaggacatcgcccgccacgaacaacaactcgtcgtcgcccgccaaaaactccgcgatgccgaaaaagcagtcgaagtcgaccccgacgacgtcaacaaaaacacactacaagcccgccaacaaacagtctcggccctcgaagacaaacttgccgatttcaaacgacaaatggcagacttcgtctcaagaaagaaaatggacacgaaacccacagaccccacaggcatagaacccgacgaccacctcaaagaacgttcaagcctccgctacggaaacgtactcgacgtcaacgccatcgatatcgaagaacccagcggacaaaccgccgactggtacaccatcggcgtatacgtcatcggcttcaccctccccatcgtactcaaagcactctacatgctctctacccgcggccgacaaaccgtcaaagaaaacaaaggaacccgcatacgcttcaaagacgacacctccttcgaagacataaacggcatacgacgaccaaaacacctctacgtctccatgcccacagcacaatccaccatgaaagccgaagaactaacccccggccgcttccgcacaatagtctgcggcctcttccccacccaaatacaagtccgcaatatcatgtccccagtcatgggcgtaatcggattcagcttcttcgtaaaagactgggtagaacgcatcaaagaatttatggaaaaagaatgtccattcatcaaaccagaacccaaacccgggaccccagcctcagaagtcgagttcctaaaacgcaacaaaatctacttcatgaaccgacaagacgtcctcgacaaaaaccacgtcccagacatcgacaaactgatcgactacgcggcatccggtgaccctacctcccccgacaacatagaagacccaaacgcaccctgggtattctcctgtgcccccgacagatgcccaccaacctgcctctacgtcgccggcatggccgaactaggagcattcttctccattctccaagacatgcgaaacaccattatggcatccaagacagtcggcaccgccgaagaaaaactcaagaaaaagtcctccttctaccaatcatacctacgccgcacccaatccatgggaatccaactagaccaacgcataatactcctatacatgctagaatggggaaaagaaatggtcgaccacttccacctcggcgatgacatggaccccgaactacgcaccctagcacaagcccttatcgaccaaaaagttaaagagatatccaaccaagagcccctcaaaatctga

SEQ ID NO: 7925 - RNA, 1302 nt, synthetic construct
  misc_feature 1..1302: note = derived and/or modified CDS sequence (opt11) from MUV(11-1)__JX028273.1__N
  source 1..1302: mol_type = other RNA
atgtcagacctgaaagaaatccaagaagacatcgccagacacgaacaacagctcgtcgtagcacgccaaaaactcagagacgccgaaaaagcagtcgaagtcgaccccgacgacgtcaacaaaaacaccctacaagcccgccagcaaacagtctcagccctagaagacaaactcgccgacttcaaacgacaaatggcagacttcgtatcgagaaagaaaatggacaccaaaccaaccgaccccaccggaatcgaaccagacgaccacctgaaagaacgttcatccctacgctacggcaacgtcctagacgtaaacgcaatcgacatagaagaaccctcaggccaaaccgccgactggtacacaataggcgtatacatcatcggcttcaccctcccaatcgtcctaaaagccctctacatgctatccaccaggggcagacaaaccgttaaagagaacaaaggcacaaggatccgcttcaaagacgacacctccttcgaagacatcaacggaatacgccgcccaaaacacctctacgtctccatgcccaccgcccagtccaccatgaaagcggaagaacttaccccaggccgattcagaaccatcgtctgcggcctcttccccacgcaaatccaagtccgcaacataatgtccccagtcatgggcgtcatcggattctccttcttcgtcaaagactgggcagaccgaatcaaagaatttatggaaaaagaatgccccttcataaaaccagagccaaagcccggcacaccggcatccgaaatcgagttcctcaaacgcaacaaaatatacttcatgtcacgacaagacgtcctcgacaaaaaccacgtccccgacatcgacaaactcatcgactacgcagcctccggcgaccccacctcacccgacaacatcgaagacccgaacgccccctgggtattctcctgcgcccccgaccgctgcccacctacctgcctctacgtcgccggcatggcggaactcggcgccttcttcagcatcctccaagacatgcgcaacaccataatggccagcaaaaccgtaggcacagcagaagaaaaactcaaaaagaaatcctccttctaccaatcctacctccgccgaacccaaagcatgggcatacaactcgaccaacgcatcatactactctacatgctagaatggggcaaagaaatggtcgaccatttccacctaggtgacgacatggaccccgaactacgaaccctcgcccaagccctcatcgaccaaaaagtaaaagaaatctccaaccaagaacccctaaaaatataa

SEQ ID NO: 7926 - RNA, 1302 nt, synthetic construct
  misc_feature 1..1302: note = derived and/or modified CDS sequence (opt11) from MUV(96-1)__DQ138133.1__N
  source 1..1302: mol_type = other RNA
atgtccgacctaaaagaaatccaagaagacatagcccgccacgaacaacaacttgtcgtagcccgccaaaagctccgcgacgccgaaaaagccgtcgaagtcgaccccgacgacgttaacaaaaacacattacaagcccgccaacaaaccgtatccgccctagaagacaaactagcagacttcaaaagacaaatggccgacttcgtctctcgcaagaaaatggacactaaaccaaccgacccaaccggcatcgaaccagacgaccacctcaaagaacgctcctccctccgctacggaaacgtcctcgacgtcaacgctatagacatcgaagaaccaagcggacaaacagccgactggtacacaatcggcgtctacgtcatcggcttcaccctcccaatcgtactcaaagccctatacatgctgtcaacacgcggccgacaaacggtcaaagaaaacaaagggacacgaatcaggttcaaagacgacacctccttcgaagacataaacggaatcaggcgacccaaacacctatacgtctcaatgcccaccgcccaatcaacaatgaaagcagaagaactcaccccaggccgcttcaggacaatcgtatgcggcctcttccccacccaaatccaagtccgcaacatcatgagcccagtcatgggcgtcatccgcttcagcttcctagtaaaagactggagcgaaaagatcaaagagttcatggaaaaagaatgcccattcatcaaaccagaacccaaaccaggcacccccgcctccgaaatagagttcctcaaacgaaacaaaatatacttcatgaaccgacaagacgtactagacaaaaaccacgtccccgacatagacaaactcatcgactacgccgcctccggcgacccaaccagccccgacaacatcgaagcccccaacgccccctgggtcttctcctgcgcccccgaccgctgtcccccaacctgcctgtacgtagcaggcatggccgaactcggcgctttctttagcatcctccaggacatgcgcaacaccataatggcctcaaaaaccgtaggaacagccgaagaaaaactcaaaaagaaatcctccttctaccagtcatacctccgccgaacccaatccatgggcatccaactcgaccaacgcatcatccttctatacatgctagaatggggcaaagaaatggtcgaccacttccacctaggcgacgacatggaccccgaactccgcacccttgcacaagctctcatcgaccaaaaagtcaaagaaatatccaaccaagaacccctcaaaatatag

SEQ ID NO: 7927 - RNA, 1302 nt, synthetic construct
  misc_feature 1..1302: note = derived and/or modified CDS sequence (opt11) from MUV(99-28)__DQ138142.1__N
  source 1..1302: mol_type = other RNA
atgtccgacctaaaagaaatccaagaagacatcgctcgccatgaacaacaactcgtcgtagccaggcaaaaactaagggacgcggaaaaagccgtagaagtcgaccccgacgatgtcaacaaaaacaccctccaagcccgacaacaaaccgtctccgccctcgaagacaaactggcagacttcaaacgccaaatggccgacttcgtctcacgcaagaaaatggacaccaaaccaaccgaccccacaggcattgaaccagacgaccacctaaaagaacgctccagcctgcgctacggcaacgtactggacgtcaacgccatagacatcgaggagccaagcggccaaacagccgactggtacaccataggcgtctacgtcataggcttcacactccccatcgtactcaaagccctatacatgctgagcacccgcggacgacagacagtcaaagaaaacaaaggtacccgcatcagattcaaagacgacacctccttcgaagacataaacggcatccgcagtcccaaacacctatacgtatcaatgcccacagcccaatcgactatgaaagcagaagaactcacaccaggccgattccgcaccatcgtctgcggcctctttcccacccaaatccaagtccgcaacataatgtcacccgtcatgggcgtcatcggcttctcattctttgtcaaagactgggtcgagcgcatcaaagagttcatggaaaaagaatgccctttcatcaaacccgaacccaaaccaggcacacccgcctcagaagtagagttcctcaaacgaaacaaaatctacttcatgaacagacaagacgtactagacaagaaccacgtccccgacatcgacaaactaatcgactacgccgcaagcggcgaccccaccagccccgacaacatcgaagaccccaacgccccctgggtattctcctgcgcccccgaccgctgcccaccaacctgcctctacgtcgccggaatggcagaactcggcgccttcttctcaatcctccaagacatgcgcaacaccataatggcgtccaaaaccgtcggcaccgccgaagaaaaactcaaaaagaaatcctccttctaccaatcatacctccgccgaacacaaagcatgggcatccaactcgaccagcgcatcatcctcctatacatgctggaatggggcaaagaaatggtcgaccacttccacctaggcgacgacatggaccccgaactccgcaccctcgcccaagccctcatcgaccaaaaagtcaaagaaatctccaaccaagaacccctcaaaatctag

SEQ ID NO: 7928 - RNA, 1290 nt, synthetic construct
  misc_feature 1..1290: note = derived and/or modified CDS sequence (opt11) from SANGV(SA14)__NC_034526.1__N
  source 1..1290: mol_type = other RNA
atggccacactcgaagaaatacaaaaagaaataaatatacacgaaggacaactcatcatcgccaaacaaaaggtcaaagacgcagaaaaacaatacgaaaaagacccagacgacctcaacaaacgcgcactatccgaccgcgaaggcatagcccactccatccaatccaaaatcgacgaactccgccgccaactagctgaccgagtagccgccggtagaaacctaggccaagaacgcgaccccaccggcgtagaacccggggaccacctccgagaaaaatccatgctatcctacggcaatgtaatcgacctcaaccacctagacatcgacgagcccacaggacagaccgcagattggctctccatcgtcatctacctcacctccttcgtcgtccccatactcctaaaagcgctatacatgctcaccacaagaggacgacaaactacaaaagacaacaaaggaatgcgtatccgcttcaaagacgacagctccttcgaagacgtcaacggcatccgcaaacccaagcacctcttcctatccatgcccaacgcccaatccagcatgaaagccgaggaaatcacccccggccgattccgaacagccgtctgcggcctctaccctgcccaaataaaagcccgcaacatggtctcacccgtcatgagcgtcataggcttcatcaccctcgcccgcgactggaccgaacgcatcgaaaactggctcgaccaaccttgcaaattcatgtccgaaccaagccaaacatccctacaaaaaggacccgccaccaaccgggactatctcaaccagcgacaagctagcctggcccaaatggaaacaaaagaagctcaagcggtcagacaacaggccgtcgatgccggctgcaatctagtagatcacatagacagcccctcctcaatatgggtcttcgccggcgcaccagacagatgcccacccacatgcctcttcatatcaggcatggccgaacttggagcattcttctcgatactacaagacatgcgcaacaccatcatggccagcaaaacagtcggcacctccgaagaaaaactcagaaagaaatcgtccttctaccaatcctacctcagacgcactcaatccatgggcatccagctcgaccaacgcatcatcataatgttcatggtagaatggggcaaagaggccgtcgacggcttccacctaggagacgacatggaccccgaactccgatccttcgcccaagccctgatcgaccaaaaagtcaaagaaatctccaaccaagaacccctaaaaatatag

SEQ ID NO: 7929 - RNA, 1290 nt, synthetic construct
  misc_feature 1..1290: note = derived and/or modified CDS sequence (opt11) from SANGV(SA22)__JQ082303.1__N
  source 1..1290: mol_type = other RNA
atggccaccctcgaagaaatccaaaaagaaataaacatccacgaaggacagctaatcatcgcaaaacaaaaagtcaaagacgcagaaaaacaatacgaaaaagaccccgacgacctcaacaaacgcgccctatccgatcgcgagggcatcgcccactcaatacaatcaaaaatcgacgaattacgcagacaactcgctgaccgcgtcgcagccggccgcaatctgggccaagaacgtgaccccaccggggtcgaacccggcgaccacctccgcgagaaaagcatgcttagctacggaaacgtaatcgacctaaatcatctcgacatagacgaacccaccggccaaaccgccgactggctcagcattgtaatatacctcacctcattcgtagtccccatactgctcaaagctctctacatgctaaccacccgtggccgacaaaccaccaaagacaacaaaggcatgcgcatccgcttcaaagacgactcctccttcgaagacgtcaacggcatcagaaaacccaagcacctcttcctctccatgccaaacgcccaatcctccatgaaagccgaagaaatcacccccggaagattccgaaccgccgtctgcggcctataccccgcccaaattaaagcacgcaacatggtaagccccgtcatgtccgtcatcggatttatcaccctcgcaagagactggaccgaacgaatcgaaaactggctcgaccaaccctgcaaattcatgtccgaaccctcccagacctccctccaaaaaggacccgccaccaaccgcgactacctcaaccaacgccaagcctccctcgcacagatggaaacaaaagaagcacaagccgtacgccaacaggccgtcgacgcaggttgcaacctcgtcgaccacatcgactcaccctcaagcatctgggtattcgccggagccccagaccgatgtcccccaacctgcctattcataagcggaatggccgaactaggcgcattcttcagcatcctccaagacatgcgaaacacaataatggccagcaaaacagtaggcacaagcgaagaaaaactccgaaagaaatcgagcttctaccaatcatacctccgccgcacccaatccatgggcatccaactcgaccaacgaataataatcatgttcatggtagaatggggaaaagaagtcgtagacggcttccaccttggcgacgacatggaccccgaactacggtccttcgcccaagccctcattgaccaaaaagtcaaagaaatcagcaaccaagaacccctcaaaatctaa

SEQ ID NO: 7930 - RNA, 1290 nt, synthetic construct
  misc_feature 1..1290: note = derived and/or modified CDS sequence (opt11) from SEOV(L99)__AF288299.1__N
  source 1..1290: mol_type = other RNA
atggccaccatggaagaaatccagagagaaatctccgcacacgaaggacaactcgtcatagcacgacaaaaagtcaaagacgcagagaaacaatacgaaaaagaccccgacgacctcaacaaacgaaccctccacgaccgtgaatccgtcgccgcatccatacaatcaaaaatcgacgagctaaaacgacaactcgccgacagaatagcagccggcaaaaacatcggccaagaccgcgaccccaccggggtcgaacccggcgaccacttaaaagaaagatcagccctcagctacggcaacaccctcgacctaaacagcctagacatcgacgaacccacaggccaaacagccgactggctcacaatcatagtataccttacctcgttcgtcgtccccataatcctaaaagccctatacatgctcaccacaagaggccgccaaacctccaaagacaacaaaggaatgcgcataagattcaaagacgacagctcatacgaggacgtaaacggaatccgaaaacccaaacacctatacgtcagcatgcccaacgcccaaagcagcatgaaagcggaagaaatcacacccggccgattccgcaccgcagtatgcggactctacccagcccaaatcaaagcacgcaacatggtctcccccgtcatgagcgtcgtaggattcctagccctagccaaagactggacctcacgaattgaagaatggctaggagcgccatgcaaattcatggccgaaagccccatagccggctcactcagcggtaaccccgtcaaccgcgactacatccgccaacgacagggagcgctcgcaggcatggaacccaaagagttccaggccctacgccaacacgccaaagacgccggctgcaccctagtcgaacacatagaaagcccctcctcaatctgggtcttcgccggggcacccgaccgctgcccgcccacatgcctattcgtaggaggcatggccgaactcggcgcattcttcagcatcctacaagacatgcgcaacaccatcatggcctccaagacagtcggcacagccgacgaaaaactccgaaagaaatcatccttctaccaaagctacctacgacgcacacaatcgatgggaatccaactggaccagcgaataatagtaatgttcatggtagcctggggcaaagaagccgtctacaacttccacctcggcgacgacatggaccccgaactccgctccctcgcacaaatcctaatcgaccagaaagtcaaagaaatctccaaccaagaacccatgaaactataa

SEQ ID NO: 7931 - RNA, 1290 nt, synthetic construct
  misc_feature 1..1290: note = derived and/or modified CDS sequence (opt11) from SEOV(SG42/2011)__KY807171.1__N
  source 1..1290: mol_type = other RNA
atggcaacaatggaagaaatacaacgagaaatctccgcccacgaaggacaactggtaatagcccgacagaaagtcaaagacgcagaaaaacaatacgaaaaagatcccgacgacctcaacaaacgagccctccacgaccgcgaatccgtagccgcatccatccaatcaaaaatcgacgagctcaaaagacaactcgcagaccgaatcgccgccggcaaaaacatcggacaagaccgcgaccccactggagtagaacccggcgaccacctaaaagagcgctccgccctaagctacggaaacaccctcgacctcaactccctcgacatcgacgaaccgaccggccaaacagcagactggtcgaccataatcgtatacctcacctcctttgtcgttccgatcatcctcaaagccctctacatgctcaccaccagaggccgacaaacaagcaaggacaacaaaggcatgcgaatccgcttcaaagacgacagctcctacgaagacgtcaacggcatccgaaaacccaaacacctatacgtctcaatgcccaacgcccaatccagcatgaaagccgaagaaataacacccgggcgcttccgcacagccgtgtgcggactataccccgcacagatcaaagcacgcaacatggtcagccccgtcatgtcagtcgtcggattcctcgccctcgccaaagactggagcagccgaatagaagaatggctcggcgccccctgtaaattcatggccgaatccccaatcgccggaagcctaagcggcaacccagtcaaccgcgactacatacgacaacgccaaggcgcactcgccggcatggaacccaaagagttccaagccctccgacaacactcaaaagacgccggatgcaccctggtcgaacacatcgaaagcccatccagcatatgggtcttcgcaggcgcaccagaccgctgcccacccacatgcctgtttgtaggcggaatggccgaactaggcgccttcttcagcatcctacaagacatgagaaacaccatcatggccagcaaaaccgtcggtaccgcagacgaaaaactacggaagaaatcctccttctaccaatcctacctgcgacgcacccagagcatgggaatccagctagaccagcgcatcatagtcatgttcatggtcgcttggggcaaagaagcagtcgacaacttccacctcggagatgacatggatcccgaactccgcagcctagcacaaatcctaatagaccaaaaagtaaaagaaatctcaaaccaagaaccaatgaaactataa

SEQ ID NO: 7932 - RNA, 1290 nt, synthetic construct
  misc_feature 1..1290: note = derived and/or modified CDS sequence (opt11) from SEOV(XJ2/2011)__KY807169.1__N
  source 1..1290: mol_type = other RNA
atggccaccatggaagaaatccaacgagaaatctccgcacacgagggccagctagtcatagcacgccaaaaagtcaaagacgccgaaaaacaatacgagaaagaccccgacgacctaaacaaacgcgccctacacgaccgcgagtccgtcgccgcctccatacaatccaaaatcgacgaactcaaacgacaactcgcagaccgaatcgccgcaggcaaaaacataggccaagacagggaccccaccggcgtcgaacccggcgaccacctcaaagaaagatccgccctaagctacgggaacaccctagacctaaactccctagacatcgacgaacccaccggccaaacagccgactggctcacaatcatcgtctacctaaccagcttcgtagtacccatcatcctcaaagccctatacatgctaacaacccgttcccgccaaacctccaaagacaacaaaggcatgcgcatacgattcaaggacgactcaagctacgaagacgtcaacggaatccgaaaacccaaacacctgtacgtctccatgccaaacgcccaatcgtcaatgcgcgcagaagaaatcacaccgggccgattccgcacagccgtctgcggcctttacccagcccaaatcaaagcccgaaacatggtcagccccgtaatgtctgtcgtcggcttcctcgcactcgcaaaagactggacctcccgcatagaggaatggctcggcgccccctgcaaattcatggccgaaagccccatcgccggctccctatctggcaacccagtcaaccgcgactacatccgccaaagacagggagcactcgccggatgggaaccaaaagagttccaggccctccgacaacactccaaagacgcaggctgcaccctagtcgaacacatcgaatcaccctccagcatatgggtcttcgccggtgcccccgacagatgcccacccacatgcctcttcgtaggaggcatggctgaactcggcgccttcttttctatactccaagacatgcgcaacaccataatggcctcaaaaactgtcgggacagccgacgaaaaactccgcaagaaatcctccttctaccaatcctacctccgccgaacacaaagcatgggcatccaactagaccaacgcataatagttatgttcatggtcgcctggggcaaagaagcagtcgacaacttccacctgggcgacgacatggacccagaactacgcagcctagcccaaatcctaatcgaccaaaaagtaaaagaaatctcgaatcaagaaccaatgaaactctaa

SEQ ID NO: 7933 - RNA, 1290 nt, synthetic construct
  misc_feature 1..1290: note = derived and/or modified CDS sequence (opt11) from SEOV(XJ5/2011)__KY807170.1__N
  source 1..1290: mol_type = other RNA
atggccacaatggaagaaatccaacgcgaaataagcgcccacgaaggccaactcgtcatagcacgacagaaagtaaaagacgcagaaaaacaatacgaaaaagaccccgacgacctaaacaagcgcgccctccacgacagagaatccgtcgcagctagcatccaaagcaaaatcgacgaactgaaacgccaactcgccgaccgcatcgccgccggcaaaaacataggccaggacagagacccaaccggcgtcgaaccaggcgaccacctaaaagaacgctcagccctctcctacgggaacacactcgacctcaacagcctcgacatcgacgaaccaacaggccaaaccgccgactggctaacaatcatcgtatacctaaccagcttcgtagtacccatcatactaaaagccctttacatgctaaccacccgcggccgacaaaccagcaaagacaacaaaggaatgcgcatccgattcaaagacgactccagctacgaagacgtcaacggcatccgaaagccaaaacacttatacgtaagcatgcccaacgcccaaagctccatgaaagccgaggaaatcacccccggccgattcagaacagcagtatgcggactctaccccgcccaaatcaaagcacgcaacatggtgtcccccgtcatgagcgtcgtcggatttctagccctcgcaaaagactggaccagccgcatagaagaatggctaggagccccctgcaaattcatggccgaaagccccatcgcaggctccctcagcggcaacccagtcaaccgcgactacatcagacaaagacaaggcgccctagcaggcatggaacccaaagagttccaagcactacgacaacacccaaaagacgccggatgcaccctcgtcgaacacatagaatcacccagcagcatctgggtcttcgcaggcgcccccgaccgatgcccaccaacctgcctattcgtcggcggaatggccgaactcggcgccttcttctccatcctacaagacatgcgcaacaccataatggcaagcaaaaccgtatccaccgccgacgaaaaactaagaaagaaatcatcattctaccagtcctacctcagacgtacacaaagcatgggaatccagctcgaccagagaataatcgtcatgttcatggtcgcctggggcaaagaagcggtcgacaacttccacctaggcgacgacatggatcccgaactccgatccctcgcccaaatactgatcgaccaaaaagtcaaagagataagcaaccaagagcccatgaaactctaa

SEQ ID NO: 7934 - RNA, 1290 nt, synthetic construct
  misc_feature 1..1290: note = derived and/or modified CDS sequence (opt11) from SEOV(10-134)__JF693882.2__N
  source 1..1290: mol_type = other RNA
atggccacaatggaagaaatccaacgagaaatatcagcccacgaaggacaactcgtcatcgcaaggcaaaaagtaaaagacgcagaaaaacaatacgaaaaagaccccgacgacctcaataaaagagccctacacgaccgcgaatccgtcgcagcctccatccaatccaaaatcgacgaactcaaacgccagctcgccgaccgcatcgccgccggcaaaaacatcggccaagaccgcgaccccaccggcgtcgaaccaggcgaccacctgaaagagcgctcagcactgagctacggaaacaccctcgacctaaactccctcgacatcgatgagcccaccggccaaacagcggactggctaaccatcatagtatacctcacctccttcgtcctcccaatcatcctcaaagccctatacatgctcacaacccgaggccgacaaaccagcaaagacaacaaaggaatgcgcatccggttcaaagacgactcctcatacgaagacgtcaacggcatacgcaaacccaaacacctatacgtcagcatgccaaacgcacaatccagcatgaaagccgaagaaatcacacccggaagattccgaaccgcagtttgcggactataccctgcccaaatcaaagctcgcaacatggtgagccccgtcatgagcgtagtcggattcctagcactggccaaagactggacctcaagaatagaagaatggctaggcgccccatgcaaattcatggcagaatcccccatcgccggcagcctatccggaaaccccgtcaaccgcgactacatccgccaacgacaaggcgccctggctggaatggaacccaaagagttccaagccctacgccagcactccaaagacgcaggctgcactctagttgaacacatcgaatcccccagctcaatctgggtcttcgcaggcgcgccggaccgatgcccacccacatgcctctttgtcggaggcatggccgaactgggcgccttctttagcatacttcaagacatgcgcaacacaatcatggcctccaagaccgtcggcactgccgacgaaaaactccgaaagaaatcctccttctaccaatcctacctccgcagaacccaaagcatgggcatacaattggaccaacgcataatcgtcatgttcatggtggcctggggcaaagaagccgtagacaacttccacctcggagacgacatggaccccgaactccgatccctcgcccaaatcctaatagaccaaaaagtaaaagaaatatccaaccaagaacccatgaaactataa

SEQ ID NO: 7935 - RNA, 1290 nt, synthetic construct
  misc_feature 1..1290: note = derived and/or modified CDS sequence (opt11) from SEOV(DPRK08)__JX853575.1__N
  source 1..1290: mol_type = other RNA
atggccacaatggaagaaatccaacgtgaaatctccgcccacgaaggccagctcgtcatcgccagacaaaaagtcaaagacgccgaaaaacaatacgaaaaagaccccgacgacttaaacaagcgcgccctccacgaccgagaaagcgtagccgccagcatacaatccaaaatagacgaactaaaacgccaactcgcagaccgaatcgctgccggcaaaaacatcggccaagaccgcgaccccaccggagtcgagccaggcgaccacctcaaagaacgctccgccttaagctacggaaacaccctagacctaaactccctagacatagacgaacccactgggcaaacagccgactggctaacaataatcgtatacctcacctcattcgtagtacccatcatcctcaaagccctatacatgctcacaacccgaggacgccaaacctccaaagacaacaagggaatgcgaatccgcttcaaagacgacagctcctacgaagacgtaaacggcatccgcaaacccaaacacctctacgtctcaatgccaaacgcccaaagctccatgaaagcagaagaaatcacacccggacgcttccgaaccgcagtatgcggcctctaccccgcccaaatcaaagcaagaaacatggtaagcccagtcatgagcgtagtcggattcctagccctcgccaaagactggacctcccgcatcgaagaatggctcggtgccccatgcaaattcatggccgaatcccccatagccggcagcctcagcggcaacccagtcaaccgagattacatcagacaacgccagggagccctcgccggcatggaaccaaaagagttccaggcactccgccaacacgcaaaagacgcaggctgcaccctggtcgaacacatcgaaagcccctcttcgatctgggtattcgcaggagcccccgaccgctgcccaccaacctgcctattcgtaggcggcatggcagaactaggagccttcttctccatactccaagacatgcgcaacacaataatggcaagcaaaaccgtcggtacggcagacgaaaaacttcgcaagaaaagctccttctaccaatcatacctccgaagaacccaatccatgggcatccaactggaccaacgaatcatagtcatgttcatggtcgcctggggaaaagaagcagtcgacaacttccacctcggagacgacatggatcccgaactacgctccctagcccaaatcctgatcgaccaaaaagtgaaagaaatatcaaaccaagaacccatgaaactctaa

SEQ ID NO: 7936 - RNA, 1290 nt, synthetic construct
  misc_feature 1..1290: note = derived and/or modified CDS sequence (opt11) from SEOV(Fj372/2013)__KP645198.1__N
  source 1..1290: mol_type = other RNA
atggccactatggaagaaatccaacgcgaaatcagcgcacacgaaggccaattagtcatcgcccgccaaaaagtgaaagacgccgaaaaacaatacgaaaaagaccccgacgacctaaacaagcgcgcactccacgaccgagaatccgtagcagcctcaatccaaagcaaaatcgacgagctaaaacgacaactcgccgacagaatagccgccggcaaaaacataggccaagacagagaccccaccggagtagaacccggagaccacctaaaagaacgcagcgccctatcctacggaaacacactcgacctcaactccctcgacatagacgaaccaaccggccagaccgccgactggctcaccataatcgtctacctaacctcattcgtcgtccccatcatactcaaagccctctacatgctcaccacacgcggacgacaaacatctaaggacaacaagggaatgcgcatccgattcaaagacgactcctcttacgaggacgtaaacggcatcagaaagccaaaacacctatacgtctccatgcccaacgcacaatcctccatgaaagccgaagaaatcacccccggccgattccgcacagcagtatgtggactctacccagcccaaatcaaagcccgcaacatggtcagccccgtaatgagcgtagtcggattcctcgccctcgccaaagactggaccagccgcatcgaagaatggctaggcgcaccatgcaaattcatggccgagtctccaatcgccggaagcctaagcggctcccccgtcaaccgagactacatccgacaacgccaaggagccctagcaggcatggaacccaaagagttccaagccctccgccaacacgcgaaagacgcaggctgcaccctcgtagaacacatcgaatctccatcctcaatctgggttttcgcaggcgcacccgaccgctgcccacccacatgcctgttcgtcggcggcatggccgaactcggagccttcttctccatcctccaagacatgcgcaacaccatcatggcctccaaaactgtcggcacagcagacgaaaaacttcgaaagaaatcatcattctaccaatcctacctccgacgcacccaaagcatgggaatccaactcgatcaacgaataatcgtaatgttcatggtagcttggggcaaagaagccgtcgacaacttccacctcggggacgacatggaccccgaactccggtccctagcacaaatcctcatcgaccaaaaagtcaaagaaatctcaaaccaagagcccatgaaactctaa

SEQ ID NO: 7937 - RNA, 1290 nt, synthetic construct
  misc_feature 1..1290: note = derived and/or modified CDS sequence (opt11) from SEOV(HeB38)__JN377553.1__N
  source 1..1290: mol_type = other RNA
atggcaaccatggaggaaatccaacgcgaaatcagcgcccacgaaggacaactcgtaatagcccgacaaaaggtcaaagacgcagaaaaacaatacgaaaaagaccccgacgacctcaacaaacgcgccctccacgaccgcgaatcagtcgcagcctccatccaatccaaaatcgacgaactaaaacgccaactcgcagaccgcatcgcagcgggcaaaaacatcggacaagaccgcgaccccaccggagtcgaacccggagaccacctcaaagaacgctcggccctcagctacggcaacaccctcgacctcaactcactcgacatcgacgaaccaaccggccaaaccgctgactggctcaccatcatcgtctacctaactagcttcgtggtccccatcatcctaaaagcactatacatgctaaccacccgcggcagacaaacctccaaagacaacaagggcatgaagatccgcttcaaagacgactcctcctatgaagacgtaaacggcatccgtaaaccaaaacacctctacgtctccatgcccaacgcgcaatcctccatgaaagccgaagaaataacaccaggccgtttccgaacagcagtatgcggactataccccgcccaaatcaaagcccgcaacatggtctcccccgtcatgagcgtcgtaggcttccttgccctggcaaaagactggacctcacgaatcgaagaatggctcggcgccccttgcaaattcatggccgaatcccccatcgcaggctccctgtcaggcaacccagtaaaccgcgactacattcgacaacgccaaggcgcactcgcaggcatggaacccaaagagttccaagcactacgccaacactcaaaagacgccggatgcacactcgtagaacacatcgaatccccctcctccatctgggtcttcgccggagcaccagacagatgcccaccaacctgcctcttcgtcggaggcatggccgaactaggcgcattcttctccatactacaggacatgcgaaacactataatggcctccaaaaccgtcggcacagccgacgaaaaactccgaaagaaatcccccttctaccaatcatacctacgacggacccaatcaatgggcatacaactggaccaaagaataatagtaatgttcatggtcgcctggggcaaagaagccgtagacaatttccacctcggcgacgacatggaccccgaactacgcggactagcacaaatcctcatcgaccaaaaggtcaaagaaatatccaaccaagaacccatgaaactctaa

SEQ ID NO: 7938 - RNA, 1290 nt, synthetic construct
  misc_feature 1..1290: note = derived and/or modified CDS sequence (opt11) from SEOV(JiangxiXinjianRn-07-2011)__KP859511.1__N
  source 1..1290: mol_type = other RNA
atggccaccatggaggaaatccaaagagaaatatccgcccacgaaggacaactggtaatcgcgcgccaaaaagtaaaagacgcagaaaaacagtacgaaaaagaccccgacgacctaaacaaacgggcactacacgaccgagaatccgtcgcagcaagcatccaatcaaaaatcgacgaactgaaacgacaactagccgaccgaatcgccgcaggcaaaaacatcggacaagaccgcgatccaaccggagtcgaaccaggcgaccacctaaaagagcgatccgccctctcttacggaaacacactcgacctcaactccctcgacatcgacgaaccaaccggacaaaccgccgactggctcaccataatcgtctacctcacatccttcgtcgtccccatcatcctcaaagccctctacatgctaacaacccgcggccgacagaccagcaaagacaacaaaggaatgcgcatacgcttcaaagacgacagcagctacgaagacgtaaacggcatcagaaaacccaaacacctatacgtctcaatgccaaacgcacaatcctcaatgaaagcagaagaaatcacccccggccgattcagaacagccgtctgcggcctctacccagcccaaatcaaagccagaaacatggtctccccagtcatgagcgtagtaggcttcctcgccctagccaaagactggaccagccgcatcgaagaatggctcggcgccccctgcaaattcatggcagaatccccaatcgccggatccctgagcggcaaccccgtcaacagagactacatccgccagagacaaggcgccctagccggcatggagcccaaagagttccaagcactccgtcaacactcgaaagacgccggctgcaccctagtcgaacacatcgaaagccccagctcaatatgggtatttgccggagcaccagacagatgcccacccacatgcttgttcgtcggcggaatggccgaactaggcgcgttcttctccatcctgcaagacatgagaaacacaatcatggccagcaaaacagtaggcacagccgacgagaaactccgaaagaaaagcagcttctaccaaagctacctccgccgtacacaatcaatgggcatacaactagaccaacggatcatcgtcatgttcatggtcgcatggggcaaagaggcagtcgacaacttccacctcggcgacgacatggaccccgaactccggtccctagcccaaatactcatcgaccaaaaagtgaaagaaatatccaaccaagaacccatgaaactctaa

SEQ ID NO: 7939 - RNA, 1290 nt, synthetic construct
  misc_feature 1..1290: note = derived and/or modified CDS sequence (opt11) from SEOV(JiangxiXinjianRn-09-2011)__KP859512.1__N
  source 1..1290: mol_type = other RNA
atggccaccatggaagaaatccaaagagaaatatcagcccatgaaggacaactcgtaatcgcacgccaaaaagtcaaagacgcagaaaaacaatacgaaaaagacccggacgacctcaacaaacgcgccctacacgaccgcgaatccgtcgccgcctccatccaatccaaaatagacgaactcaagcgacaactcgctgaccgcatagccgccggcaaaaacatcggccaagacagagaccccacaggcgtagaacccggcgaccacctcaaggaacgatcagccctaagctacggcaataccctcgacctaaactccctcgacatagacgaacccacaggacaaacagccgactggctaaccatcatcgtctacctgacctcattcgtcgtacccatcatcctaaaagccctctacatgctaaccacccgcggaagacaaacctccaaggacaacaaagggatgcgcatccggttcaaagacgactcatcctacgaagacgtgaacggcatcagaaaacccaagcacctatacgtcagcatgcccaacgcccaattctccatgaaagccgaagaaataacgcccggacgcttccgaaccgcagtctgcggcctctaccctgcacaaatcaaagctcgtaacatggtcagccccgtcatgtccgtagtcggcttcttagccctggccaaagactggacatcacgcatagaagaatggcttggcgcaccctgcaaattcatggccgaatcccccatcgccggcagcctcagcggcaaccccgtcaaccgcgactacatcagacagcgacaaggcgcactcgccggcatggaaccgaaagaattccaagccctacgccaacacagcaaagacgcaggctgcaccctcgtcgaacacatcgaaagtccctcctcaatatgggtcttcgccggcgcaccagaccgctgcccacccacgtgcctcttcgttggcgggatggccgaactcggcgccttcttctccatcctccaagacatgcgcaacacaataatggccagcaaaaccgtcggcaccgccgacgaaaaacttcgaaaaaaatcctcattctaccaatcctacctacgacgcacccagagcatgggcatccaactagaccaacgcataatcgtcatgttcatggtagcctggggaaaagaagcagtagacaacttccacctaggcgacgacatggaccccgaactgcgctccctcgcacaaatactcatcgaccaaaaagtcaaagaaatatccaaccaagaacccatgaaactctaa

SEQ ID NO: 7940 - RNA, 1290 nt, synthetic construct
  misc_feature 1..1290: note = derived and/or modified CDS sequence (opt11) from SEOV(Singapore/06(RN41))__GQ274944.1__N
  source 1..1290: mol_type = other RNA
atggcgactatggaagaaatccagcgcgaaatctccgcccacgaaggccaactcgtcatagcacgccaaaaagtcaaagacgccgaaaaacaatacgaaaaagacccagacgacctaaacaaaagagccctacacgaccgagaaagcgtcgcagcaagcatccaatcaaagatagacgaactaaaacgtcaactggccgaccgaatcgccgccgggaaaaacattggacaagaccgagaccccaccggagtcgaacccggcgaccacctcaaagaaagatccgcactatcctacggcaacacactagacctcaacagcctagacatagacgagccgactggccaaaccgcagactggctcaccataatagtctacctcacctcattcgtcgtccccatcatactaaaagccctctacatgctcacaacacgaggccgccaaacctcaaaggacaacaaaggaatgcgcatccgcttcaaagacgactcatcatacgaggacgtaaatggtatccgaaaacccaaacacctatacgtctcaatgccaaatgcccaatcctccatgaaagccgaagaaatcacccccggacgattccgcacagccgtctgcggcctctatccagcccaaatcaaagcccgcaacatggtcagccccgtcatgagcgtagtcggattcctagccctggccaaagactggacaagccgaatcgaagaatggctaggagccccctgcaaattcatggcagaatcccccatcgccggctccctctctggcaaccccgtcaacagagactacatacgccaacgccaaggcgccctcgcaggcatggaaccaaaagagttccaagccctccgacagcactccaaagacgccggctgcaccctcgtagaacacatcgaatcaccaagctcgatctgggtcttcgccggagcacctgaccgctgcccacccacatgcctattcgtcggcggaatggcagaactaggagcattcttcagtatactccaagacatgcgaaacacaatcatggccagcaaaaccgtcggcacggcggacgaaaaactccgcaaaaagtcctccttctaccaatcctacctacgacgcacacagtccatgggaatccaactcgaccaacgaatcatcgtcatgttcatggtagcctggggcaaagaagccgtagacaacttccatctcggcgacgacatggaccccgaactccgcggactcgcccaaatactaatcgaccaaaaagtcaaagaaatcagcaaccaggaacccatgaaactctaa

SEQ ID NO: 7941 - RNA, 1290 nt, synthetic construct
  misc_feature 1..1290: note = derived and/or modified CDS sequence (opt11) from SEOV(YaluRiver12)__HQ611980.1__N
  source 1..1290: mol_type = other RNA
atggcaaccatggaagaaatccaacgcgaaatcagcgcccacgaaggacaattagtaatagccagacaaaaagtcaaggacgccgaaaaacaatacgaaaaagacccaggcgacctgaacaaacgagcacttcacgaccgcgaaagcgtcgcagccagcatccaaagcaaaatagacgaacttaaacgccaactagcagaccgaatcgccgccggcaaaaacatcgggcaagaccgagaccccacgggcgtagaacccggcgaccacctcaaggaacgcagcgccctcagctacggcaacaccctcgacctaaactcactagacatcgacgaaccgaccggacaaacggcagactggctaaccataatcgtatacctaacatccttcgtcgtccccataatactcaaggccctctacatgctaacaacccgaggacggcagacaagcaaagattcaaaaggaatgagaatcagattcaaggacgacagctcctacgaagacgtaaacggcatcaggaaacccaaacacctctacgtatcaatgccaaacgcccaatcgtcaatgaaaacggaagaaataacaccaggacgattccgcacagcagtatgcggcctctaccccgcacaaataaaagcgcgcaacatggtgagccccgtcatgagcgtcgtcggattcctcgccctcgcaaaagactggacatcccgcatcgaagaatggctgggcgcaccatgcaaattcatggccgagtcacccatagccgggagcttatccgagaacccagtaaaccgagactacatacgccagcgccaaggagcactcgcaggaatggaacccaaagagttccaagccctccgccaacacgcaaaagacgctggatgcaccctcgtagaacacattgaatcgcccagctcaatatgggtcttcgccggcgccccggaccgctgcccgccaacctgtctcttcgtcggcggaatggcagaactgggcgccttcttcagcatactccaagacatgcgaaacaccataatggcaagcaaaaccgtcggcacggctgacgaaaagctccggaagaaaagctccttctaccaatcatacctacgcagaacccagagcatgggcatacaactcgaccaacgcataatcgtaatgttcatggtagcctggggcaaagaagcagtggacaacttccacctaggcgacgacatggatccggaactacgctcactagcgcaaatactcatagaccaaaaagtaaaagaaatatccaaccaagaaccaatgaaactctag

SEQ ID NO: 7942 - RNA, 1290 nt, synthetic construct
  misc_feature 1..1290: note = derived and/or modified CDS sequence (opt11) from SEOV(14D12)__AB618124.1__N
  source 1..1290: mol_type = other RNA
atggccaccatggaagaaatccaaaaagaaatctcagcacacgaaggacaactcgtcatcgcacgacagaaagtaaaagacgccgaaaaacaatacgaaaaagaccccgacgacctcaacaaaagagcactccacgacagagaatcagtagcagccagcatccaatcgaaaatcgacgaactcaaacgccagctcgccgaccgaatcgcggccggcaaaaatatcggacaagaccgcgaccccacaggcgtagaaccaggcgaccacctcaaagaacgcagcgcactaagctacggaaacaccctagacctcaactccctcgacatcgacgaacccacaggacaaacagcagactggctaaccatcatcgtatacctaacctctttcgtcgtccccatcatcctaaaagcactctacatgctcaccacccgaggccgacaaaccagcaaagacaacaaaggaatgcgcatccggttcaaagacgacagctcatacgaggatgtcaacggaatccggaaaccgaaacacctctacgtttccatgcccaacgcgcaatcaagcatgaaagccgaagaaatcacccccggccgattccgcacagccgtctgcggcctctaccccgcgcaaatcaaagcccgaaacatggtctcccccgtcatgagcgtcgtcggcttcctggccctcgctaaagactggacctcccgcatagaagaatggctaggtgccccctgcaaattcatggccgaatcacccatcgccggctccctaagcggaaaccccgtcaatcgcgactacatccgtcaacgacaaggtgccctagcaggaatggaaccaaaagagttccaagcactacgccaacacagcaaagacgccggctgcaccctcgtagaacacatcgaaagccccagttccatctgggtattcgccggcgcccccgacaggtgcccacccacgtgcctattcgtgggaggcatggccgaactcggcgccttcttcagcatcctgcaagacatgcggaacaccataatggcctcaaaaaccgtcggcaccgccgacgaaaaactccgaaagaaaagctccttctaccaaagctacctaagacggacccaaagcatgggcatccaacttgaccaacgaatcatcgtcatgttcatggtcgcctggggcaaagaagccgttgacaacttccacctaggcgacgacatggaccccgaactacgatcactcgcccaaatcctcatcgaccaaaaagtaaaagaaatcagcaaccaagaaccaatgaaactctag

SEQ ID NO: 7943 - RNA, 1281 nt, synthetic construct
  misc_feature 1..1281: note = derived and/or modified CDS sequence (opt11) from SEOV(19CSG)__AB618114.1__N
  source 1..1281: mol_type = other RNA
atggaagagatacaacgcgaaataagcgcccacgaaggccaactcgtcatcgcccgacaaaaagtcaaagacgcagaaaaacagtacgagaaagaccccgacgacctcaacaaacgcgccctccacgaccgcgaatccgtcgccgcctcaatacaaagcaaaatcgacgagctcaaaagacaactagcagaccgcatcgccgccggcaaaaacatcggacaagaccgcgaccccaccggagtcgaacccggagaccacctaaaagaacgcagcgcactcagctacggaaacaccctcgacctaaactccctcgacatagacgaacccacagggcaaacagccgactggctcaccataatcgtatacctcaccagcttcgtagtcccaatcatactcaaagcgctatacatgctaacaacccgaggccgccaaacatccaaagacaacaagggcatgaggatccgattcaaagacgacagcagttacgaagacgtcaacggcatcagaaaaccaaaacacctctacgtcagcatgcccaacgcccaaagcagcatgaaagccgaagaaatcacccccggccgattccgcaccgcagtctgcggactctaccccgcccaaatcaaagccagaaacatggtctccccggtcatgagcgtcgtcggcttcctcgccctggcaaaagactggacctcccgaatagaagaatggctcggagccccctgcaaattcatggccgagtcacccatcgccggcagcttaagcggcaacccagtcaaccgcgactacatcagacaacgccaaggagccctcgccggaatggaaccaaaagagttccaagccctccggcaacacagcaaagacgccggatgcaccctcgtagaacacatcgaatccccctccagcatatgggtattcgccggagccccagaccgctgcccgccaacctgcctattcgtcggcggcatggcagaactaggcgcattcttctcgatactccaggacatgagaaacaccataatggcttcaaagaccgtaggcaccgccgacgaaaaactccgcaaaaagagctccttctaccagtcatacctccgcagaacccaatcaatgggcatacaactagatcaacgcatcatcgtcatgttcatggtcgcatggggaaaagaagcagtggacaacttccacctcggagacgacatggacccagaactccgcagcctagcacaaatcctaatcgaccagaaagtcaaagaaatcagcaaccaagaacccatgaagctctaa

SEQ ID NO: 7944 - RNA, 1290 nt, synthetic construct
  misc_feature 1..1290: note = derived and/or modified CDS sequence (opt11) from SEOV(93HBX12)__EF192308.1__N
  source 1..1290: mol_type = other RNA
atggcaaccatggaagaaatacaacgcgaaatctccgcccacgaaggacagctagtcatagcccgccaaaaggtcaaagacgccgaaaaacaatacgaaaaagacccggacgacctcaacaaacgagccctccacgaccgagaaagcgtcgccgcctccatacaaagcaaaatcgacgaactcaaacgccaactagccgaccgcatagcagccggcaaaaacatcggacaagatcgagaccccaccggcgtcgaacccggcgaccacctaaaagaacgctcagcactatcatacggcaataccctcgacctaaactccctcgacatcgacgaacccaccggccaaaccgccgactggctcaccataatcgtatacctcacctcatttgtcgtacccatcatcctcaaagcgctctacatgctaaccacgcgcggccgccaaacatcaaaggacaacaaaggcatgcgcatccgattcaaagacgacagctcatacgaagacgtcaacggcataggcaaacccaaacacctctacgtctccatgccgaacgcacaatccagcatgaaagccgaagaaatcacccccggccgattccgaaccgcagtctgcggactctacccagcccaaatcaaagcccgcaacatggtaagccccgtcatgagcgtagtcggcttcctcgccctcgcaaaagactggacctcacgcatcgaagagtggctaggcgccccctgcaagttcatggccgaaagcccaatcgccggcagcctaagcggaaaccccgtcaaccgcgactatatacgacaacgacaaggcgcactcgccggcatggaaccaaaagagttccaggccctccgacagcacagcaaagacgccggatgcaccctagtagaacacatagaatccccatcctccatatgggtcttcgcaggagccccagatcgctgtcctcccacatgcctcttcgtgggcggcatggcagaactaggagccttcttctccatcctccaggacatgcgcaacaccatcatggcctccaaaacagtaggcaccgcagacgaaaaactacgcaagaaaagctcattctaccaatcctacctccgcaggacccagagcatgggaatacaactagaccaacgcataatcgtaatgttcatggtcgcatggggcaaagaagccgtcgacaacttccacctcggcgacgacatggaccccgaactccgcggcctagcccagatcctaatcgaccaaaaagtaaaagaaatctccaaccaagaacccatgaaactctaa

SEQ ID NO: 7945 - RNA, 1290 nt, synthetic construct
  misc_feature 1..1290: note = derived and/or modified CDS sequence (opt11) from SEOV(Cherwell)__KC626089.1__N
  source 1..1290: mol_type = other RNA
atggccaccatggaagaaatccaacgagagatctccgcacacgaaggccagctagtcatagccagacaaaaagtcaaagacgcggagaaacaatacgaaaaagaccccgacgacctcaacaaaagggccctacacgaccgcgaaagcgtcgcagccagcatacaaagcaaaatcgacgaactcaaaagacaactcgccgaccgaatcgcagccggcaaaaacatcggacaagaccgagaccccaccggcgtggaacccggcgaccacctcaaagaaagatccgccctctcctacggaaacaccctagacctcaactcactcgacatcgacgaacccactgggcaaaccgcagactggctcacaatcatagtatacctcacctccttcgtagtccccataatcctcaaagcactctacatgctaaccaccagaggccgccaaacatccaaagacaacaaaggcatgagaatccgcttcaaagacgactcatcctacgaagacgtcaacggaatccgcaaacccaaacacctctacgtctccatgccaaacgcgcaatccagcatgaaagcggaagaaatcacgcccggccgcttccgcacggccgtatgcggcctctaccccgcacaaataaaagcacgcaacatggtctccccagtcatgtccgtcgtcggcttcctagccctagccaaagactggacatcccgaatagaagaatggctaggagccccctgcaaattcatcgccgaaagccccatcgccggcagcctcagcggcaacccggtcaaccgcgactacatccgccaaagacaaggcgccctcgctggaatggaacccaaagagttccaagccctaagacaacatagcaaagacgcaggatgcaccctcgtcgaacacatagaaagccccagcagcatatgggtcttcgcaggcgcccccgacagatgcccaccaacctgcctattcgtcggaggaatggccgaactaggagccttcttcagcatcctccaagacatgcgcaacaccatcatggccagcaaaacagtcggcaccgccgacgaaaaactccggaaaaagagcagcttctaccagtcatatctcagacgaacccaaagcatgggcatacaactcgatcaacgaataatcgtcatgttcatggtagcctggggcaaagaagccgtagacaacttccacctaggcgacgacatggaccccgaactccgctccctagcgcaaatactcatcgaccaaaaagtgaaagaaatctcgaaccaagaacccatgaaactctaa

SEQ ID NO: 7946 - RNA, 1290 nt, synthetic construct
  misc_feature 1..1290: note = derived and/or modified CDS sequence (opt11) from SEOV(CixiRf23)__FJ803201.1__N
  source 1..1290: mol_type = other RNA
atggccacaatggaagaaatccagcgcgagatatccgcacacgaaggccaacttgtcatcgcacgacagaaagtcaaagacgccgaaaaacaatacgaaaaagaccccgacgacctcaacaagcgcgcactccacgaccgcgaatcggtagccgcctccatccagagcaaaatagacgaactcaaaagacagctagccgaccgcatagcagccggcaagaacatcggccaagaccgagaccccacaggcgtcgaaccaggcgaccacttaaaggaacgtagcgcactctcatacggaaacacactagacctgaactccctcgacatcgacgaaccaacaggccaaaccgcggactggctcacaataatcgtatacctcacctcattcgtagtccccataatcttaaaggccctctacatgctcacaacacgaggccgccaaacctccaaagacaacaaaggcatgcgcatccgcttcaaagacgatagctcatacgaagacgtcaacggcatccgcaaaccaaaacacctatacgtatccatgcccaacgcccaatccagcatgaaggccgaagaaatcacccccggccgcttccgaacagccgtgtgcggactatacccagcacagataaaagcacgcaacatggtatcgcccgtcatgtcggtcgtcgggttcctagcactggccaaagactggacatcccgcatcgaagaatggctcggcgccccatgcaaattcatggcagaatcacccatcgcaggatcactaagtggaaacccagtcaaccgcgactacatccgccaacgccagggggcactcgcaggaatggagccaaaagagttccaagccctgcgccaacacgccaaagacgccggacgaacactcgtagaacacatcgaaagcccctcctccatatgggtcttcgcaggagcccccgaccgctgcccaccaacctgcctcttcgtcggaggcatggccgaactcggcgccttcttctcaatactccaagacatgagaaacaccataatggcatccaaaacagtcggcaccgccgacgaaaaactaagaaagaaaagctcattctaccaatcctacctacgccgaacccagagcatgggcatccagctcgaccaacgcataatagtcatgttcatggtcgcctggggaaaagaagccgtcgacaacttccacctaggcgacgacatggaccccgaactccgcagcttagcccaaatcctcatagaccaaaaagtgaaagaaatctcaaaccaagaacccatgaaactatag

SEQ ID NO: 7947 - RNA, 1290 nt, synthetic construct
  misc_feature 1..1290: note = derived and/or modified CDS sequence (opt11) from SEOV(CixiRf56)__FJ803202.1__N
  source 1..1290: mol_type = other RNA
atggccaccatggaagaaatccagcgagaaatctccgcacacgaaggccaactcgtcatagcccgacaaaaagtcaaagacgccgaaaaacaatacgaaaaagaccccgacgacctaaacaaacgggccctccacgaccgcgaaagcgtcgccgccagcatccaatccaaaatagacgaactcaaaagacaactcgccgaccgcatcgccgccggcaaaaacatcgggcaagaccgcgaccccaccggcgtcgaacccggcgaccacctcaaagaacggtccgccctctcctacggcaacacactagacctaaactccctagacatcgacgaaccaaccggccaaacggccgactggctaacaatcatcgtctacctgacctccttcgtcgtccccatcatcctcaaagccctatacatgctcaccacacggggccgccaaaccagcaaagacaacaaaggcatgcgcatccgcttcaaagacgacagcagctacgaagacgtcaacggaatacgaaaacccaaacacctctatgtctccatgcccaacgcccaatcaagcatgaaagccgaagaaatcacccccggacgcttccgaaccgccgtctgtggcctctaccctgcccaaataaaagcacgcaacatggtctcacccgtcatgtccgtagttggattcctagcactagccaaggactggacctcacgaatcgaagaatggctaggagccccctgcaaattcatggcagaatcccccatcgccggctccctaagcggcaacccagtcaacagagactacatccgacaaggtcaaggcgccctagccggcatggaacccaaagagttccaagcccttcgccaacacgcaaaagacgccggctgcaccctcgtcgaacatatcgaatccccctcatcaatatgggtcttcgccggggcaccagacagatgcccacccacatgccttttcgtcggcggcatggccgaactaggcgccttcttctccatcctccaagacatgcgcaacaccataatggccagcaaaaccgtcggcacggccgacgaaaaactaagaaagaaaagctcattctaccaatcgtacctacgccgaacacaatccatgggcatacaactcgaccaaagaatcatagtcatgttcatggtcgcctggggcaaagaagccgtcgacaacttccccctcgtccacgacatggacccaaaactcagaagtctatcccaaatactaatcgaccaaaaagtcaacgagatctcgaaccaagaaccaatgaaactataa

SEQ ID NO: 7948 - RNA, 1290 nt, synthetic construct
  misc_feature 1..1290: note = derived and/or modified CDS sequence (opt11) from SEOV(CixiRn21)__FJ803205.1__N
  source 1..1290: mol_type = other RNA
atggccaccatggaagaaatccagcgagaaatcagcgcccacgaaggacaactcgtcattgcccggcaaaaagtcaaggacgccgaaaaacaatacgaaaaggacccagacgacctaaacaaacgcgcactccacgaccgagaaagcgtagcagcatccatacagtccaaaatcgacgaactcaaaagacaactcgccgaccgaatcgcagccggcaaaaacatcggccaagacagagaccccaccggagtcgaacccggagaccacctcaaagaacgaagcgcactatcctacggcaacaccctagacctaaactccctcgacatcgacgaacccaccggccaaaccgccgactggctcaccataatcgtctacctgacctccttcgtcgtacccatcatcctcaaagccctatacatgctcaccacccgcggaagacaaacaagcaaagacaacaaaggcatgagaatccgattcaaggacgacagctcatacgaagacgtcaacggaatccgaaaacccaaacacctctacgtatccatgccaaacgcacaatcaagcatgaaagccgaagaaataaccccaggccgcttccgcaccgcggtctgcggcctataccccgcccaaataaaagcccgcaacatggtctcaccagtaatgtctgtcgtcggattcctagccctcgcaaaagactggacttcccgcatcgaagagtggttaggagcaccctgcaaattcatggctgaatcacccatcgcaggaagcctcagcgggaacccagtaaacagagactacatacgacaacgacaaggcgcgctcgcaggaatggaaccaaaagagttccaagcgctccgccaacactcaaaagacgccggctgcaccctagtcgaacacatcgaatccccctcgtcaatctgggtattcgccggagcccccgaccgatgcccacccacatgcctcttcgtcggcggcatggacgaactcggagccttcttcagcatcctacaagacatgcgaaacaccatcatggcgagcaaaaccgtcggtaccgcggacgaaaaactcagaaagaaatcctccttctaccaaagctacctccgacgaacacaaagcatgggcatccaactagaccaccgcatcatagtaatgttcatggtcgcctggggcaaggaggccgtagacaacttccacctaggcgacgacatggaccccgaactccgaaccctcgcccaaatcctcatagaccaaaaagtcaaagaaatcagcaaccaggaaccaatgaaactctaa

SEQ ID NO: 7949 - RNA, 1290 nt, synthetic construct
  misc_feature 1..1290: note = derived and/or modified CDS sequence (opt11) from SEOV(CixiRn76)__FJ803206.1__N
  source 1..1290: mol_type = other RNA
atggccaccatggaagaaatccaacgcgaaataagcgcacacgaaggacaactggtaatagcccgccaaaaagtcaaagacgccgagaaacaatacgaaaaagacccggacgacctcaacaaaagggcactccacgaccgagaaagcgtagccgccagtatacaatccaaaatcgacgaactcaaacgccaactagccgacagaatcgccgctggcaaaaacatcggacaagaccgcgacccaaccggcgtcgaaccaggagaccacctcaaagaacgctcagcactaagctacggcaacaccctagatctaaacagcttagacatagacgaacccaccggccaaacagcagactggctcaccatcatagtctacctcaccagcttcgtcgtccccatcatcctaaaagccctatacatgctaacaacacgaggcagacaaaccagcaaagacaacaagggaatgcgcatccgcttcaaagacgactcctcatacgaagacgtcaacggtatccgaaaacccaaacatctctacgtctcaagccaaaacgcccaatcgtccatgaaagcagaagaaatcacccccggccgcttccgcaccgccgtctgcggcctctaccccgcccaaataaaagcacgcaacatggtcagcccagtcatgagcgtcgtcggtttcctagccctagccaaagactggacctccagaatagaagaatggctcggcgcgccatgcaaattcatggccgaaagccccatcgccggtagcctaagcggcaaccccgtcaaccgcgactacatccgacaaggacaaggcgcactcgccggcatggaaccaaaagagttccaggcgctacgccaacacgcaaaggacgcaggatgcacactcgtcgaacacatcgaaagtccttccagcatctgggtcttcgccggagccagagaccgatgccctcccacatgcctcttcgtcggcggcatggccgaactaggagcctttttcagcatcctccaagacatgcgaaacacaatcatggccagcaaaaccgtcggcacagcagatgaaaaactaagaaagaaaagcagcttctaccaatcatacctccgacgaacccaatccatgggcatccaactggaccaacgcatcatagtcatgttcatggtggcctgggggaaagaagccgtcgacaacttccacctcggcgacgacatggaccccgaactccgctccctcgcccaaatcctaatcgaccaaaaagtaaaagaaatctcaaaccaagaacccatgaaactatag

SEQ ID NO: 7950 - RNA, 1290 nt, synthetic construct
  misc_feature 1..1290: note = derived and/or modified CDS sequence (opt11) from SEOV(CUI)__GQ279395.1__N
  source 1..1290: mol_type = other RNA
atggccaccatggaagaactgcaacgcgaaatctcggcccacgaaggccaactcgtcatcgccagacaaaaagtcaaagacgcagaaaaacaatacgaaaaagaccccgacgacctaaacaaaagagccctccacgaccgcgaatccgtcgccgccagcatccaatcaaaaatcgacgaactaaaacgccaactcgcagaccgcatcgccgcaggcaaaaacatcggccaagaccgagacccaacaggcgtcgaacccggagaccacctcaaagaaagatccgccctctcctacggcaacaccctcgacttaaactcactcgacatcgacgaacccaccggccaaacggccgactggctaactatcatcgtatacctgaccagcttcgtcgtacctatcatactaaaagcactctacatgctcactacccgaggccgacaaacctcaaaagacaacaagggcatgcgaatccgcttcaaagacgactccagctacgaagacgtcaacggcatacgaaaacccaaacacctatacgtaagcatgcccaacgcccaatcatccatgaaagccgaagaaatcacccccggccgcttcagaacagccgtctgcggcctctacccagcacaaataaaagcccgaaacatgctctccccagtcatgtccgtagtaggcttcctcgccctagccaaagactggacatcccgcatagaagaatggctaggcgccccctgcaagttcatggccgaatcccccatcgctggtagcctatcaggcaaccccgtcaaccgcgactacatccgccaacgccaaggagccctcgccggaatggaaccaaaggagttccaggccctacgacaacactcaaaagacgccggatgcaccctagtcgaacatattgaatcacccagctccatctgggtcttcgccggcgcaccagaccgatgcccgcccacatgcctcttcgtcggcggaatggccgaactcggcgccttcttcagcatcctccaagacatgcgcaacaccatcatggccagcaaaacagtaggcaccgcagacaagaaactacgaaagaaatccagcttctaccaatcatacctccgccgcacccaatcaatgggcatacaactagaccaacgcatcatagtcatgttcatgttcgcctggggcaaagaagccgtagacaacttccacctcggagacgacatggaccccgaactccgaggactcgcccagattctaatcgaccaaaaagtaaaagagatctcaaaccaagaaccaatgaaactttaa

SEQ ID NO: 7951 - RNA, 1290 nt, synthetic construct
  misc_feature 1..1290: note = derived and/or modified CDS sequence (opt11) from SEOV(FeixianRn1)__GU592942.1__N
  source 1..1290: mol_type = other RNA
atggccacaatggaagaaatccaacgcgaaatctccgcccacgaaggccaactcgtcatcgcccgccaaaaagtaaaagacgcagaaaaacagtacgaaaaagaccccgacgacctcaacaaacgagccctccacgaccgggaatcagtcgcagcctcaatccaatccaaaatagacgaactcaaacgccaactcgccgaccgcatcgcagccggcaaaaacataggacaagaccgagacccaaccggcgtcgagcccggagaccacctaaaagaacgctccgccctatcctacggaaacaccctcgaccttaacagcctcgacatcgacgaacccacaggccaaaccgcagactggctaacgatcatcgtatacctcaccagcttcgtagtccccatcatactaaaagccctatacatgcttaccacccgcggcagacaaacctccaaagacaacaaaggaatgcgtatccgcttcaaagacgactcatcctacgaagacgtcaacggcatacgcaaaccaaaacacctatacgtttccatgcccaacgctcaatcctccatgaaagcagaagaaatcacccccggaagattccgaaccgccgtctgcggactctacccagcgcaaataaaagcccgcaacatggtatcccccgtcatgtccgtcgttggctttctcgccctagccaaagactggacatcccgcatcgaagaatggctcggcgcaccatgcaaattcatggccgaatcccccatcaccggctccctatccggcaacccagtcaaccgggactacatacgacaacgacaaggcgcccttgccggcatggaacccaaagaattccaagccctccgccaacacgccaaagacgccggatgcaccctagtcgaacacatagaatccccatcctcgatctgggtcttcgcaggagcaccagaccgatgcccccccacctgcctcttcgtcggaggcatggccgaactcggcgccttcttctcgatactccaagacatgagaaacacgatcatggcctctaaaacagtcggcacagccgacgagaaactaagaaaaaaatcgtcattctaccaatcctacctccgacgcacccaaagcatgggcatacaactagaccaacgcatcatagtcatgttcatggtagcctggggcaaagaagccgtagacaacttccacctaggagacgacatggaccccgaactccgatccctcgcccagatactaatagaccaaaaagtaaaagaaatctccaaccaagaaccaatgaaactctaa

SEQ ID NO: 7952 - RNA, 1290 nt, synthetic construct
  misc_feature 1..1290: note = derived and/or modified CDS sequence (opt11) from SEOV(GanyuRn66)__GU592932.1__N
  source 1..1290: mol_type = other RNA
atggccaccatggaagaaatacaacgcgaaatatcagcacacgaaggacaactcgtcatcgcacgccaaaaagtaaaagacgcagaaaaacaatacgaaaaagaccccgacgacctgaacaaacgcgccctacacgaccgcgagtccgtcgccgccagcatccaaagcaagatagacgaactcaaacgccaactcgccgacagaatcgccgcaggcaaaaacatcggacaagatcgcgacccaacaggcgtagaaccgggagatcacctcaaagaacgctcagcattatcctacggcaacaccctcgacctcaacagcctagacatagacgaacccaccggccaaaccgccgactggctcacaataatagtctacctaaccagcttcgtcgttccaataatcctaaaagccctctacatgctaacgacaagaggccgccaaaccagcaaagacaacaaaggaatgcggatccgattcaaagacgacagcagctacgaagacgtcaacggcatccgcaaacccaaacacctctacgtctcaatgcccaatgcacaatcctccatgaaagcagaagaaataacccccggccgcttccgaaccgccgtctgcggactctaccccgcgcaaataaaagcccgaaatatggtctccccagtgatgagcgtagtcggattcctagccctcgccaaagattggacctcgcgcatagaagaatggctcggcgccccctgcaaattcaccgccgaatccccaatcgccggaagcctctccggcaacccagtcaaccgcgattacataagacaacgacaaggcgccctcgccggcatggaaccaaaagagttccaagccctccgccaacacgctaaagacgcaggctgcaccctcgtcgaacacatcgagtcaccctcctccatctgggtcttcgccggcgccccggaccgatgcccacccacatgcctattcgtaggaggcatggccgaactcggagcattcttctcaatacttcaagacatgcgaaacaccatcatggcatcaaaaaccgtgggcaccgcagacgaaaaactacgcaagaaaagctcattctatcaatcctacctccgccgaacccagtccatgggtatccaactcgaccaacgcataatcgtaatgttcatggtagcctggggcaaagaagccgtagacaacttccacctaggcgacgacatggaccccgagctccgaagcctcgctcagatactcatcgaccaaaaagtcaaagaaatctccaaccaagaacccatgaaactctaa

SEQ ID NO: 7953 - RNA, 1290 nt, synthetic construct
  misc_feature 1..1290: note = derived and/or modified CDS sequence (opt11) from SEOV(Gongzhuling108)__KF745947.1__N
  source 1..1290: mol_type = other RNA
atggccaccatggaagaaatccaacgcgaaatctcagcccacgaaggccaactcgtcatagccagacaaaaagtcaaagacgccgaaaaacaatacgaaaaggacccagacgacctcaacaaaagcgccctacacgaccgcgaatccgtcgcagcatctatacaatccaaaatcgacgaactcaaacgtcagctcgcagaccgaatagccgccggcaaaaacatcggccaagaccgcgacccaaccggcgtcgaaccaggagaccacctgaaagaacgctcggccctctcctacggaaacacactagacctcaactcactcgatatcgacgaaccaaccggccagaccgcagactggctcaccatcctcgtctacctcacctcattcgtcgtgcccataatccttaaagcactatacatgctcacaacccgaggccgccaaacctccaaagacaacaaaggcatgcgcatccggttcaaagacgacggctcctacgaagacgtcaacggcatccgcaaacccaaacacctctacgtccccatgccaaacgcccaatcctcaatgaaagccgaagaaatcacccccggccgattccgcaccgcagtctgcggcctctaccccgcccaaataaaacctcgcaacatggtctccccagtaatgtccgtagtaggcttcctcgcactcgccaaagactggacctcccgaatcgaagaatggctcggcgcaccctgcaaattcatggcagaaagccccatcgcaggctccctcagcggcaaccccgtaaaccgtgactacatacgccaacgccaaggcgcactcgccggaatggaaccaaaagagttccaggcgctacgccagcacgcaaaagacgccggctgcaccctagtagaacacatcgaatccccatcctcaatcagagtattcgcaggagcccccgcccgctgccctcccacatgcctgttcgtcggcggcatggcagaactaggcgccttcttctccatccttcaagacatgcgcaacacaatcatggccagtaaaacagtcggcacagccgacgaaaaactccgcaagaaatcctctttttaccaatcatacctccgccgatcacaatcaatgggcatacagctcgaccaaagaattatcgtaatgttcatggtagcctcaggaaaagaagccgtcgacaacttccacctcggtgacgacatggaccccgaactacgctccctagtacaaatcctcatagaccaaaaagtcaaagaaatctcaaatcaagaacccatgaaactctaa

SEQ ID NO: 7954 - RNA, 1290 nt, synthetic construct
  misc_feature 1..1290: note = derived and/or modified CDS sequence (opt11) from SEOV(Gongzhuling147)__KF745948.1__N
  source 1..1290: mol_type = other RNA
atggcaaccatggaagaaatacaacgagaaatatccgcccacgaaggacagctagtaatcgcacgccaaatcgtcaaagacgccgaaaaacaatacgaaaaagacccagccgacctaaacaaaagagccctccacgaccgagaaagcgtagccgcatccatccaatctaaaatagacgaactcaaacgccaccttgccgacagaatagccgccggcaaaaacatcggacaagaccgcgaccccaccggagtagaacccggagaccaccttaaagaacgctccgcactaagctacgggaacaccctagacctaaactccctagacatcgacgaacccaccggccaaacggccgactggctcacaatcatagtctaccttacctcattcgtcgtcccaatcatactcaaagccctatacatcctcaccacgagcggcagacaaacctccaaagacaacaaaggcatgcgaatacgattcaaagacgacagcagctacgaagacgtcaacggaataagaatgcccaaacacctctacgtcccaatgcccaacgcgcaaagctccatgaaagcagaagacatcacccccggcagattccgcaccgccgtctgcgggctctaccccgcacaaataaaagcacggaacatggtctcaccactcatgtcagtcgtcggattcctagccctaccaaaagactggacctcccgaatagacgaatggttaggagcaccctgcaaattcatggccgaaagccccatagcaggcagcctctcaggcaacccggtgaaccgagaccacatcagacaacgccaaggcgccctagccgggatggacccaaaagagttccaagcagtcagacaacacgcaaaagacgcaggctgcacattagtagaacacatagaaagcccaagcagcatctgggtcttcgccggagccccagaccgctgcccaccaacctgcctcttcgtcggcggaatggccgaactcggcgcattcttcacaatcctacaggacatgcgaaacacaatcatgccctcaaaaaccgtaggcactgccgacgaaaaactcagaaagaaatcctccttctaccaatcatacctccgcaggacacaatccatgggaatccaactagaccaaagaatcatagtaatattcatggtagcctgggccaaagaagcggtcgacaactttcacctcggcgacgacatggaccccgaactcagatccctagctcaaatactcatcgaccaaaaagtaaaagaaatctccaaccaagtccccatgaaactatag

SEQ ID NO: 7955 - RNA, 1290 nt, synthetic construct
  misc_feature 1..1290: note = derived and/or modified CDS sequence (opt11) from SEOV(Gongzhuling415)__KF745949.1__N
  source 1..1290: mol_type = other RNA
atggccacaatggaagaaatacaacgagaaatcagcgcccacgaaggccaattggtcatcgcccgacaaatggtcaaagacgccgaaaaacaatacgaaaaagacctagcagacctcaacaaaagagccctccacgaccgcgaaagcgtggccgcctccatacaatcaaaaatagacgagctcaaaagacaactcgcagaccgcatcgcagcaggaaaaaacatcgaacaagaccgcgacccaaccggagtagaacccggcgaccacctcaaagaacgctccgccctcagctatggcaacaccctggacctcaactctctagacatcgacgaacccacaggccaaacggcagactggcttaccatcatagtttacctcacctcattcgtcgtccccatcatcctaaaagccctctacatactcaccacacgaggacggcaaactagcaaagacaacaaaggcatgacaatacgattcaaagacgactcatcatacgaggacgtaaacggtatccgcatgcccaaacacctctacgtcccaatgcctaacgcccaatcgagcatgaaagcagaagacatcacacccggacgcttccgcaccgccgtatgcggcctctaccccgcacaaatcaaagcgcgcaacatggtctcccccctcatgagcgtcgtcggattcctagccttacccaaagactggacatcacgcatcgacgagtggctcggcgcaccctgcaaattcatggcagaatcacctatagccggcagcctatcaggcaacccagtcaacagagaccacatccgccaacgccaaggcgcactagccggcatggacccaaaagaattccaagcagtccgccaacacgcaaaagatgccggctgcaccctcgtcgaacacatcgaaagcccctcctcaatctgggtcttcgcaggcgcaccagacagatgcctcccaacctgcctcttcgtcggcggcatggccgagctcggcgcattcttcaccatcctccaagatatgcgcaacaccatcatggccagcaaaaccgtcggcaccgccgacgaaaaactcggcaaaaaaagctccttctaccaatcctacctccgccgcacccaaagtatgggcatccaactcgaccaacgaatcatcgtaatgttcatggtcgcctgggccaaagaagccgttgacaacatccacctgggcgacgacatggacccagaattgaggtcgctagcacaaatcctcatcgaccaaaaagtcaaagaaatcagcaaccaagtcccaatgaaactctaa

SEQ ID NO: 7956 - RNA, 1290 nt, synthetic construct
  misc_feature 1..1290: note = derived and/or modified CDS sequence (opt11) from SEOV(Gongzhuling42)__KF745942.1__N
  source 1..1290: mol_type = other RNA
atggccaccatggaagaaatacaacgcgaaatctcggctcacgaaggccaactcgtcatcgcccgacaaaaagtcaaagacgcccaaaaacaatacgaaaaagaccccgacgacctaaacaaaagagccctccacgaccgagaaagcgtcgccgccagcatccaacttaaaattgacgaactcaaacgccaactcgcagaccgaatcgccgcaggcaaaaacatcggccaagaccgcgaccccaccggagtcgaacctggcgaccacctcaaagaacgcagcgcactgagctacggaaacaccctcgacctcaactccctggacatcgacgaacccacgggccaaacagccgactggctcacaatcatagtatacctgacctccttcgtagtccccataattctaaaggcactatatatgttaaccacccgcggccgccaaacctccaaagacaacaagggaatgcgaatacgcttcaaagacgacagctcctacgaagacgtaaaaggcatcagaaaacctaagcacctatacgtaccaatgcccaacgcccaatccagcatgaaagccgaagaaataacccccggaagatgccgcacagccgtctgcggcctatacccagcccaaataaaagcccgcaacatggtctcccccgtaatgagcgcagtcggcatcctcgcactggccaaagactggacttcccgcatcgaagaatggctcggaacaccatgcaaattcatggccgaaagcccgatcgccggctcactctccggaaaccccgtcaaccgagaccacatccgccagcgacaaggcgcactcgccggcatggaacccaaagaatttcaaggcctccgccaacacgccaaagacgccggatgcaccctcgtagaacacatcgaatcaccctcctcaatctgggtcttcgccggagcccccgaccgctgtccccctacgtgcctcttcgtaggaggcatggccgaactgggcgccttcttcgccatcctccaagacatgcgcaacaccatcatggccagcaaaacggtcggaaccgcagacgaaaaactccgcaaaaagtcgtccttctaccagtcctacctacgccgcacacaatccatgggaatacaactagaccagcgaatcatcgtaatgttcatggtcgcatgggccaaagaagcggtcgacaacttccacttaggcgacgacatggaccccgaactccgctccctagcccaaatactaatggaccaaaaagtcaaagaaataagcaaccaagaacccatgaaactctaa

SEQ ID NO: 7957 - RNA, 1290 nt, synthetic construct
  misc_feature 1..1290: note = derived and/or modified CDS sequence (opt11) from SEOV(Gongzhuling45)__KF745943.1__N
  source 1..1290: mol_type = other RNA
atggccaccatggaagagatccaacgcgagatctccgcccacgaaggccaactcgtaatcgcacgacaaatggtaaaggacgcagaaaaacaatacgaaaaagatccagccgacctaaataaaagagccctccacgaccgcgaatccgtcgcagcaagcatacaaagcaaaatagacgagctcaagcgccaactagccgacagaatcgccgccggcaaaaacatcggacaagaccgcgaccccacgggagtagaacccggcgaccacctcaaagaacgatcagccctcagctaccgaaacacactcgacctaaactccctcgacatcgacgaacccaccggacaaaccgccgactggctcaccataatcgtctacctcacctccttcgtcgtccccataatacttaaagccctatacatcctaactacccgcggccggcaaactagcaaagataacaaaggcatgaggatcagattcaaggacgactcctcatacgaagacgtaaacggcatacgcatgcccaagcacctctacctccccatgcccaacgcccaatcatccatgaaagcagaagacatcacccccggcagattccgcaccgcagtctgcggcctctacccagcccaaataaaagctcgaaacatggtcagcccactaatgtcagtcgtaggattcctcgcactccccaaagactggaccagcagaatcgacgaatggctcggggccccctgcaaattcatggccgaatcacccatcgccggctcactcagcggcaacccagtcaaccgagaccacatccgacaacgccaaggagcactagccggaatggaccccaaagagttccaagccgtccgccaacacgcaaaagacgccggctgcacactcgtagaacacatcgaatcccccagctccatctgggtcttcgccggcgcccccgacagatgcccacccacatgcctcttcgtcggcggaatggcagaactaggcgccttcttcacaatcctccaagacatgagaaacaccatcatggcttccaaaaccgtgggcaccgccgacgagaaacttcgaaagaaatcctcattctaccaatcatacctacgcagaacacaatcaatgggcatacaactagaccaacgcatcatcgtcatgttcatggtcgcttgggccaaagaagcagtcgacaacttccacctcggtgacgacatggaccccgaactcagatccctcgcccaaatactcatagaccacaaagtaaaagaaatctccaaccaagtcccaatgaaactttaa

SEQ ID NO: 7958 - RNA, 1290 nt, synthetic construct
  misc_feature 1..1290: note = derived and/or modified CDS sequence (opt11) from SEOV(Gongzhuling58)__KF745944.1__N
  source 1..1290: mol_type = other RNA
atggccaccatggaagaaatccaacgcgaaatctcggcccacgaaggacagctagtcatcgcccgccaaatggtcaaagacgccgaaaaacaatacgaaaaagaccccgccgacctgaacaaacgagcactacacgaccgggaaagcgtcgccgccagcatccaatccaaaatcgacgaactcaaacgacaactagctgaccgcatcgcggccgggaaaaacattggccaagaccgcgacccaaccggcgtagaacccggcgaccacctaaaagaacgctccgccctctcatacggaaacaccctcgacctgaactccctcgacatcgacgaacccaccggccaaaccgccgactggctcaccatcatcgtatatctcaccagcttcgtagtaccaataatactcaaagccctatacatcctaaccacccgcggccgacaaacaagcaaagacaacaaaggaatgagaatcaggttcaaagacgactcatcatacgaagacgtaaacggcatccgaatgccaaaacacctctacgtacccatgcccaacgcccaatcatcaatgaaagccgaagacatcacacccggacgcttccgaacagccgtctgcggcctataccccgcgcaaataaaagcccgcaacatggtcagccccctcatgagcgtggtcggattcctcgccctcccaaaagactggacctcgcgcatcgacgaatggttaggcgcaccctgcaaattcatggccgaatcacccatagcaggcagcctcagcggcaacccggtaaaccgcgatcacatacggcaacgccaaggcgccctagcaggcatggaccctaaagagttccaagccgtccgacaacatgccaaagacgccggctgcacactcgtcgaacacatagaaagcccatccagtatatgggtcttcgcaggggcccccgacaggtgcccacccacgtgcctcttcgtaggcggaatggcagaactcggcgcattcttcaccatcctccaagacatgcgaaacaccataatggcctcaaaaaccgtcggcactgccgacgaaaagctccgaaagaaaagctcgttctaccagtcctacctaagacgcacccaatccatgggcatacaactcgaccaacgaataatcgtaatgttcatggtggcctgggccaaagaagccgtcgacaacttccacctaggcgacgacatggaccccgaactccgctcactggcacaaatactcatagaccaaaaagtgaaagaaatctccaaccaggtacccatgaaactataa

SEQ ID NO: 7959 - RNA, 1290 nt, synthetic construct
  misc_feature 1..1290: note = derived and/or modified CDS sequence (opt11) from SEOV(Gongzhuling85)__KF745945.1__N
  source 1..1290: mol_type = other RNA
atggccaccatggaagaaatccaaagagaaatatccgcccacgaaggccaactcgtcatcgcacgccaaatggtcaaagacgccgaaaaacaatatgaaaaagaccccgcagacctcatcaaacgagccctccacgaccgcgagtccgtcgccgcctcaatccaatccaaaatcgacgaactaaaacgtcaactagcagaccgaatcgccgccggcaaaaacatcggacaagaccgtgaccccacaggcctcgaaccaggcgaccacctaaaagaacgatccgcactatcctacggcaacaccctcgacctcaactccctagacatcgacgaacccaccggccaaaccgccgactggctaactgtcatcgtatacctcacctccttcgtcgtccccatcatcctaaaagccctatacatcctcactacccggggtcgccaaacatcaaaagacaataaaggcatgagaatccgcttcaaagacgtctcatcatacgaggacgtaaacggcatccgaatgcccaaacacctatacgttcccatgccaaacgcccagtcgtccatgaaagccgaagacatcacacccggtcgcttccgcacagcagtctgcggcctctaccccgcacaaatcaaagcaagaaacatggtctcaccactcatgtccgtcgtcggcttcctcgccctccccaaagactggacctcacgcatcgacgaatggctcggcgccccatgcaaattcatggccgaaagcccaatcgccggcagcctatccggaaaccccgtcaacagagaccacatccgacaacgccaaggcgccctcgccggaatggaccccaaggagttccaagccgtccgccaacacgcgaaggacgcaggatgcaccctagtagaacacatagaatccccaagctccatctgggtcttcgccggcgcccccgaccgctgtcccccaacatgcctattcgtccgaggaatggcagaactcggcgctttcttcaccatcctccaagacatgcgcaataccataatggcctccaaaacagtcggcacagccgacgaaaaactaagaaagaaaagctccttctaccaatcctacctccgccgcacccaatccatgggaatacagctcgatcaacgaataatagtcatgttcatggtcgcctgggccaaagaagccgtcgacaacttccacctaggcgacgacatgcaccccgagctccgatccctcgcccaaatactcatagaccaaaaagtcaaggaaatctccaaccaagtccccatgaaactataa

SEQ ID NO: 7960 - RNA, 1290 nt, synthetic construct
  misc_feature 1..1290: note = derived and/or modified CDS sequence (opt11) from SEOV(Gongzhuling97)__KF745946.1__N
  source 1..1290: mol_type = other RNA
atggcgaccatggaagaaatacagcgagaaatcagcgcccacgaaggccaactcgtaatcgcccgacaaatggtaaaagacgcagaaaaacaatacgaaaaagaccccgcagacctcaacaaacgcgcactgcacgaccgcgagtcagtagccgcctccatccaatccaaaatagacgacctcaaacgccaactcgcagaccgaatagccgcaggaaagaacataggacaggacagagacccaacaggcgtcgaacccggcgaccaccttaaagagaggtccgccctaagctacggcaacacactcgacctcaactccctcgacatcgacgaacctaccggacaaaccgcagactggctgaccatcatcgtatacctgacatccttcgtggtccccatcatcctcaaagccctctacatgctcaccaccagaggcagacaaacaagcaaagacaacaaaggcatgagaatccgattcaaagacgactcatcctacgaagacgtcaacggcatccgaatgcccaaacacctctacgtccgcatgcccaacgcccaatcatccatgaaagcagaagacataacacccggacgcttccgaaccgccgtctgcggcctctacccagcacaaatcaaagcccgcaacatggtttcacccctcatgtcagtcgtcggcttcctcgcactccccaaagactggacctcccgcatcgacgaatggctcggagcaccctgcaaattcatggcagaatcacctatcgccggctccctctccggaaaccccgtcaaccgcgatcacatacgccaacgccaaggcgccctcgccggcatggaccccaaagagttccaagccgtccgccaacacgccaaagacgcaggctgcaccctagtagaacacatcgaaagcccatcctccatctgggtcttcgccggcgcacccgaccgttgtcccccaacatgcctcttcgtcggaggaatggccgagctcggcgcattcttcacaatactccaagacatgcgtataacaatcatggcctcaaaaaccgtcggcaccgcagacgaaaagctacgcaagaaaagctccttctaccaatcctacctccgccgcacccaatcaatgggaatacaactagaccaacgcctcatcgtcatgttcatggtcgcctgggccaaagaagcagttgacaacttccacctaggcgacgacatggacccagaactccgctccctcgcccaaatcctaatagaccaaaaagtcaaacaaatctccaaccaggttcccatgaaactctaa

SEQ ID NO: 7961 - RNA, 1290 nt, synthetic construct
  misc_feature 1..1290: note = derived and/or modified CDS sequence (opt11) from SEOV(Gou3)__AB027522.1__N
  source 1..1290: mol_type = other RNA
atggcaaccatggaagagatccaacgcgaaatatccgcccacgaaggacagctagtaatcgcccgtcaaaaagtcaaagacgccgaaaaacaatacgaaaaagaccccgacgacctgaacaaacgagccctccacgaccgagaatccgtagcagcctccatacaatcaaaaatagatgagctcaaacgccaactcgccgaccgaatagccgcaggcaagaacatcggccaagaccgcgaccccaccggcgtcgagcccggcgaccacctcaaagaacgatccgccctatcctacggaaacaccctcgaccttaacagcctcgacatcgacgagcccaccggacaaacagccgactggctaacaatcatagtctacctcaccagcttcgtcgtcccaatcatccttaaagccctatacatgctcacaacccgcggacgccaaacatcaaaagacaacaaaggaatgcgcatccgctttaaagacgacagctcctacgaagacgtaaacggcatcagaaaaccaaaacacctgtacgtaagcatgcccaacgctcaatcttccatgaaagcggaagaaatcacacccggctccttccgtaccgcagtctgcggactgtaccctgcaacaatcaaagcacgcaacatggtatccccagttatgtcagtcgtgggtttcctcgccctagccaaagactggacatcccgaatcgaagactggctcggagcaccctgcaaattcatggcagaatcacccatcgccggcagcctatcaggcaaccccgtaaatcgcgactatatacgacaaagacaaggcgccctagcaggcatggaacccaaagagttccaagccctccgtcagcacagcaaagacgccggatgcaccatggtcgaacaaatcgaaagcccaagctccatctgggtattcgcaggcgcccccgacagatgcccaccaacctgcctcttcgtcggcggcatggccgaactaggcgccttcttcagcatcctgcaagacatgcgcaacacaataatggcctccaaaacggtcggcacagccgacgaaaaactgcgcaagaaaagctccttctaccaatcatacctacgacgaacgcaatcaatgggaatacaactcgaccaacgaatcatcgtcatgttcatggtcgcctggggcaaagaagccgtagacaacttccacctaggcgacgacatggatcccgaactccgctccctcgcccaaatcctcatcgaccaaaaagtcaaagaaatcagcaaccaagaacccatgaaactataa

SEQ ID NO: 7962 - RNA, 1290 nt, synthetic construct
  misc_feature 1..1290: note = derived and/or modified CDS sequence (opt11) from SEOV(Hb8610)__AF288643.1__N
  source 1..1290: mol_type = other RNA
atggcgaccatggaagaaatccaacgagaaatatccgcccacgaaggccaactcgtcatagcccgacaaaaagtcaaagacgccgaaaaacaatacgaaaaagaccccgacgatctcaacaaacgagcgctccacgaccgcgagagcgtagccgcaagcatccaatcaaaaatcgacgagctaaagcgccaactagccgacagaatagcagccgggaaatccatcggccaagaccgagaccccacgggcgtagaacccggagaccacctaaaagagcgatcagccctgtcctatggcaacaccctagacctcaactccctcgacatagacgagcccacaggccaaacggcagactggctcacaatcatcgtctacctcaccagcttcgtagtaccaataatcctaaaagctctatacatgctcaccacacgcggaagacaaacatccaaagataacaaaggcatgagaatccgattcaaagacgacagcagctacgaggacgtaaacggcatacgcaaaccaaaacacctatacgtcagcatgccgaacgcacaatccagcatgaaagcagaagaaatcacgcccgggagattccgaacagccgtatgcggcctctaccccgctcaaatcaaagcacgcaacatggtaagccccgtcatgagcgtcgtcggattcctagccctagccaaagactggacctcacgcatcgaagaatggctaggcgccccctgcaaattcatggccgaatcacccatcgccggctcactaagcggcaaccccgtcaaccgagactacatccgccaacgccaaggagccctcgcaggaatggaaccaaaagaattccaagccctccgccagcacgccaaagacgccggctgcaccctagtagaacacattgaaagccccagcagcatctgggtcttcgccggcgcccccgaccgatgcccaccaacatgcctgttcgtcggcggaatggcagaactcggcgcattcttttccatcctccaggacatgcgaaacaccatcatggcaagcaaaaccgtcggcaccgcagacgaaaaactccgcaaaaaaagctccttctaccaatcctacctgcgccgaacccagagcatgggcatccaactggaccaacgaatcatcgtaatgttcatggtcgcctggggcaaaaaagccgtcgacaacttccacctcggcgacgacatggaccccgaactccgctccctcgcccaaatccttatcgaccaaaaagtcaaagaaatctccaaccaagaacccatgaaactctaa

SEQ ID NO: 7963 - RNA, 1290 nt, synthetic construct
  misc_feature 1..1290: note = derived and/or modified CDS sequence (opt11) from SEOV(HuBJ16)__GQ279380.1__N
  source 1..1290: mol_type = other RNA
atggccacaatggaggaaatccaacgggagatctcagcccacgaaggacagctcgtcatcgcccgacaaaaagtaaaaaacgcagaaaaacaatacgaaaaagacccagacgacctcaacaaacgagccctacacgaccgcgaatccgtcgcggcatcaatacaaagcaaaatcgacgaactaaaacgccaactcgccgaccgcatagccgcaggcaaaaacataggacaagaccgcgacccaaccggagtcgaaccaggcgaccacctcaaagaacgatccgccctaagctacggcaacacactcgacctcaacagcctggacatcgacgagccaaccggacaaactgccgactggctaaccataatcgtctacctaacctccttcgtcgtcccaatcatcctcaaagccctctacatgctaaccacacgcggccgccaaacctcaaaagacaacaaaggcatgcgaatacgcttcaaagacgacagctcctacgaagacgtcaacggaatccgaaaaccaaaacacctctacgtcagcatgccaaacgcacaaagctccatgaaagcagaagaaataacccccggccgattccgaaccgccgtctgcggcctctaccccgcccaaatcaaagcccgcaacatggtatcccccgtcatgtcagtggtcggcttcctcgcactcgcgaaagactggacaagccgcatcgaggaatggctaggggccccctgcaaattcatggccgaatcccccatcgccggctccctcagcggaacacccgtcaaccgcgactacatccgccaacggcaaggggcacttgccggcatggaacccaaagaattccaagccctacgacaacacgccaaagacgcaggctgcaccctcgtcgaacacatcgaatccccctcctcaatctgggtcttcgcaggggcacccgaccgatgccccccaacctgcctattcgtaggcggcatggccgaactcggcgccttcttcagcatactccaagacatgcgcaacacaatcatggccagcaaaaccgtaggaaccgccgacgaaaaactacgaaaaaaaagctccttctaccaaagctacttacgcagaacacaatccatgggcatacaactcgaccaacgtatcatagtaatgttcatggtcgcctggggaaaagaagccgtcgacaacttccacctcggggacgacatggaccccgaactcagatcactcgcacaaatcctcatcgaccagaaagtaaaagaaatcagcaaccaagaaccaatgaaactctaa

SEQ ID NO: 7964 - RNA, 1290 nt, synthetic construct
  misc_feature 1..1290: note = derived and/or modified CDS sequence (opt11) from SEOV(HuBJ22)__GQ279379.1__N
  source 1..1290: mol_type = other RNA
atggccactatggaggaaatacagcgcgaaatcagtgcccacgagggacagctagtaatcgcccgccaaaaagtcaaagacgccgaaaaacaatacgaaaaagaccccgacgacctcaacaaacgcgccctccacgaccgagaatccgtcgcagcctccatccaaagcaagatagacgaactaaagcgacaactggccgacagaatagccgccggcaaaaacatcggccaagaccgcgaccccacaggcgtagaacccggcgaccacctaaaagagcgcagtgctctcagctacggcaacaccctcgacctcaacagtctagacatcgacgaacccacaggccaaaccgcagactggctaaccataatcgtatacctaacctcattcgtcgtccccatcatcctcaaagccctatacatgctcacaaccagaggcagacaaacatcaaaagacaacaaaggcatgcgcatacggttcaaagacgactccagctacgaagacgtcaacggcatccgaaaacccaaacacctatacgtctcgatgccaaacgcccaatcatcaatgaaagcagaagaaatcacccccgggagattccgcaccgcagtatgcggcctctaccccgcccaaatcaaagcacgcaacatggtctcccccgtcatgagcgtcgtcggcttcctagcactcgcgaaagactggacctcacgcatagaagaatggctgggagccccctgcaaattcatggccgaatcgcccatagccggatccctctccggaacccccgtaaaccgcgactacatacgccaacgtcaaggcgccctcgcaggcatggagcccaaagagttccaagccctacgacaacacgcaaaagacgccggctgcaccctcgtagaacacatcgaatcaccatcctcaatatgggtcttcgctggtgcaccagaccgctgcccacccacatgcctattcgtaggcggcatggccgaactaggagcattcttcagcatcctacaagacatgcgcaacaccataatggcatccaaaaccgtaggcacagccgacgaaaaactccgaaagaaaagctccttctaccaatcatacctcagacgcacccaaagcatgggcatccaactagaccaacgcatcatagtcatgttcatggtcgcctggggcaaagaagccgtagacaacttccaccttggagacgacatggaccccgaactccgctccctagcccaaattctaatcgaccagaaagtaaaagaaatatccaaccaagaacccatgaaactttaa

SEQ ID NO: 7965 - RNA, 1290 nt, synthetic construct
  misc_feature 1..1290: note = derived and/or modified CDS sequence (opt11) from SEOV(HuBJ3)__GQ279391.1__N
  source 1..1290: mol_type = other RNA
atggcaaccatggaagaaatccaacgcgaaatatccgcccacgaaggccaactcgtaatagccagacaaaaagtcaaagacgcagagaaacaatacgaaaaagacccagacgacctaaacaaaagagccctacacgaccgagaaagcgtcgccgcaagcatacaaagcaaaatcgacgaactaaaacgccaactcgccgaccgtatcgccgccggcaagaacataggacaagacagagaccccaccggcgtagaaccgggagaccacctgaaagaacgctcagcactaagctacggcaacaccctagacctcaactcactagacatcgacgaaccaaccggacaaacagccgactggctaaccataatcgtatacctcacatcattcgtggtccccatcatcctgaaagccctgtacatgcttacgacaagaggacgccaaacatcgaaggtaaacaaaggaatgcgcatccgcttcaaggacgacagctcctacgaagacgtgaacggcatcagaaaaccaaaacacctctacgtatcaatgccaaacgcccaaagcagcatgaaagcagaagagatcacccccggacgcttccgaacagcagtatgcgggctatacccagcccaaataaaagcacgcaacatggtcagcccagtcatgagcgtggtcggattcctagcactagccaaagactggacctcacgaatcgaggaatggctaggcgcaccatgcaggttcatggcagaatctccaatagcaggcagcctaagcgggaacccagtcaaccgagactacatacgacaacgccaaggagcactcgccggcatggaacccaaagagttccaagccctcaggcagcacgcaaaagacgccggatgcacgctagtagaacacatcgaaagcccaagcagcatatgggtattcgccggggcacccgaaggctgcccgccaacctgcctcttcgtcggcggaatggcagaactgggagcattcttcagcatactccaagacatgagaaacaccatcatggcatccaaaaccgtaggcacggcggacgaaaagctcagaaagaaaagctcattctaccaaagttacctacgaagaacccaatcaatgggaatccaactggaccaaagaataatagtaatgttcatggtagcctggggaaaagaagccgtcgacaacttccacctcggcgacgacatggaccccgaactacgcagcctcgcacagatactaatagaccaaaaagtcaaagaaatatccaaccaagagccaatgaaactatga

SEQ ID NO: 7966 - RNA, 1290 nt, synthetic construct
  misc_feature 1..1290: note = derived and/or modified CDS sequence (opt11) from SEOV(K24-e7)__AF288653.1__N
  source 1..1290: mol_type = other RNA
atggcaaccatggaggaaatacaacgcgagatctccgcccacgaaggacaactcgtcatagcccgacaaaaagtcaaagacgccgaaaaacaatacgaaaaagaccccgacgatttcaacaaacgcgccctacacgaccgcgaatccgtagcagcatcgatccaatccaaaatcgacgaactcaaacgccaactcgccgaccgcattgccgcaggtaaaaacatcgggcaagaccgcgacccaacaggcgtggaaccaggcgaccacctcaaagaacgctccgcactatcctacgggaacacccttgacctcaacagcctcgacatagacgaacccacaggccaaacagccgactggctaaccatcatcgtctacctaacatcttttgtcgtccccataatcctcaaagccctctacatgctaaccaccagaggccgccaaacctccaaggacaacaaaggaatgcgaatccgattcaaagacgacagctcctacgaagacgtcaacggcatccgaaaacctaaacacctctacgtatccatgccaaacgcccaaagcagcatgaaagccgaagaaataacccccggccgcttccgtaccgcagtctgcggactttaccccgcacaaatcaaagcccgcaacatggtctccccagtcatgtccgtggttggcttcctcgcccttgccaaggactggacctcccgcatagaagaatggctaggcgccccatgcaaattcatggccgaatcaccaatagccggcagcctatcaggcaaccccgtaaaccgcgactacatccgccaacgacaaggcgcactcgccggaatggaacccaaagagttccaagcactccgccaacacgccaaagacgccggctgcacccttgtcgaacacatcgaaagcccatccagcatctgggtcttcgcaggcgcccccgaccgatgccctccaacctgcctcttcgtcggcggcatggcagaactcggcgccttcttctccatactccaagacatgcgcaacacaataatggcaagcaaaaccgtcggaaccgccgacgaaaaactgcgcaaaaagagctcattctaccaatcctacctccgacgcacacaatccatgggcatccaactggaccaaaggataatcgtcatgttcatggtagcatggggcaaagaagcagtcgacaacttccacctaggcgacgacatggaccccgaactccgctccctcgcacaaatactcatcgaccaaaaagtaaaagaaatatcaaaccaagaacccatgaaactctaa

SEQ ID NO: 7967 - RNA, 1290 nt, synthetic construct
  misc_feature 1..1290: note = derived and/or modified CDS sequence (opt11) from SEOV(K24-v2)__AF288655.1__N
  source 1..1290: mol_type = other RNA
atggcaaccatggaagaaatccaaagagaaatctccgcccacgagggacagctcgtaatagcccgacaaaaggtaaaagacgcagaaaaacaatacgaaaaagaccccgacgacttcaacaagcgcgccctacacgaccgggaaagcgtagcagcaagcatacagagcaaaattgacgagctcaaacgccaactcgccgaccgtatcgccgcaggcaaaaacataggacaagaccgcgaccccaccggagtcgaaccaggcgaccacctcaaagagcgctcagccctatcatacggcaacacactagacctgaactccctagacatagacgaaccaaccggacaaaccgccgactggctaaccatcatagtctacctcaccagcttcgtagtcccaataatactaaaagccctatacatgctcaccacaagaggccgccaaaccagcaaagacaacaaagggatgcgcatcagattcaaagacgactcttcctacgaagacgtaaacggaatccgcaaaccgaaacacctctacgtctccatgcccaacgcccaatcaagcatgaaagccgaagaaataacgcccggccgcttcagaaccgccgtctgcggcctctaccccgcccagatcaaggccagaaacatggtctccccagtaatgtcagtggtcggcttcctagccctagcaaaagactggacctcccgcatagaagaatggctaggcgcaccctgcaaattcatggcagaatcccccatcgctggcagcctgtccgggaaccccgtaaaccgagactacatccgacaaagacaaggagccctcgccggcatggagccaaaagagttccaggcactccgacaacacgccaaagacgccggatgcacactcgtagaacacatagaaagcccctcctcaatctgggtattcgccggagcacccgaccgatgcccaccaacctgcctattcgtcggcggaatggcagagctcggcgcattcttctcaatcctccaagacatgcgcaacacaatcatggcatcaaagaccgtaggaacagccgacgaaaagctccgcaagaaaagcagcttctaccaatcctacctgcgacacacccaatccatgggaatacaactcgaccaacgtatcatcgtcatgttcatggtagcctggggcaaagaagcagtcgacaacttccacctcggcgacgacatggaccccgaactacgctccctcgcccaaatcctaatcgaccaaaaagtcaaagaaatctcaaaccaagaacccatgaaactctaa

SEQ ID NO: 7968 - RNA, 1290 nt, synthetic construct
  misc_feature 1..1290: note = derived and/or modified CDS sequence (opt11) from SEOV(OuhaiRf35)__FJ803208.1__N
  source 1..1290: mol_type = other RNA
atggccacaatggaagaaatccaacgagaaatcagcgcccacgaaggacagctagtcatcgcaagacaaaaagtcaaagacgcggaaaaacaatacgaaaaagaccccgacgacctaaacaaacgcgcgctccacgaccgcgaaagcgtcgccgccagcatacaatccaaaatagacgaactcaaacgccagctcgccgaccgcatcgccgccggtaaaaacatcggtcaagaccgcgaccccacaggagtcgaaccaggcgaccacctaaaagaacgatcagcactaagctacggcaacacactggacctaaactccctcgacatcgacgaacccaccggccaaaccgccgactggcttaccatcatcgtctacctcacctcattcgtagtccccatcatcctcaaagcactctacatgctaaccacacgaggccggcaaacctcaaaagacaacaaaggcatgcggataagattcaaagacgactcctcatatgaagacgtcaacggaatccgcaaacccaaacacctctacgtcagcatgcccaacgctcaatccagcatgaaagccgaagaaatcacaccaggccgcttcagaaccgccgtctgcgggctctaccccgcccaaatcaaagcgcgaaacatggtctccccggtaatgtccgtagtaggcttcctcgccctagccaaagactggaccagccgaatagaagagtggctaggagcaccatgcaaattcatggcagaatctcccatcgccggcagcctctctggtaaccctgtaaaccgcgactacatccgccaacgccaaggagccctcgcaggcatggaacccaaagagttccaagccctccgacaacacgccaaagacgccggatgcacgctcgtcgaacacatcgaaagccccagctccatctgggtctttgcaggggcccgcgaccgatgcccaccaacctgcctattcgtcggcggaatggcagaactaggcgcattcttcagcatcctccaagacatgagaaacaccatcatggccagcaaaaccgtcggcacagccgacgaaaaactccgaaagaaaagctcattctaccaatcctacctacgccgcacccaatccatgggcatccaactagaccaacgaatcatcgtaatgttcatggtcgcctggggcaaagaagccgtcgacaacttccaccttggcgacgacatggaccccgaactacgctccctagcccaaatactaatcgaccaaaaagtaaaagaaatcagcaaccaagaacccatgaaactctaa

SEQ ID NO: 7969 - RNA, 1290 nt, synthetic construct
  misc_feature 1..1290: note = derived and/or modified CDS sequence (opt11) from SEOV(OuhaiRn146)__FJ803210.1__N
  source 1..1290: mol_type = other RNA
atggccaccatggaagaaatccaacgcgaaatctcagcacacgaaggccaactggtaatcgcccgccaaaaagtaaaagacgccgaaaaacaatatgaaaaagacccagacgacctcaacaaacgtgccctccacgacagagaaagcgtcgccgcctcgatccaatccaaaatcgacgaactaaaacgccaactagcagaccgcatcgccgccggcaaaaacatcggccaagaccgagaccccaccggagtagagcccggcgaccacctcaaagaacgctccgccctctcctacgggaacacactagacctaaacagcctcgacatcgacgaacccaccggccaaacagccgactggctcaccatcatcgtctacctgaccagcttcgtagtccccatcatcctaaaagccctatacatgctcacaacccgcggaagacagacatctaaagacaacaaaggaatgcgcatacgattcaaagatgactcctcatacgaagacgtaaacggcatccgcaaaccaaaacacctatacgtctcaatgcccaatgcacaatcaagcatgaaagccgaagaaataacccccggcagattcagaaccgcagtctgcggcctctaccccgcccaaatcaaagcccgcaacatggtctccccagtaatgtccgtcgttggcttcctagccctcgcaaaagactggaccagcaggatcgaagaatggctcggagccccctgcaaattcatggccgaatcacccatcgccggctccctaagcggtaaccccgtaaacagagactacatccgacaaggccaaggcgccctcgcaggaatggaacccaaagagttccaagccctccgccaacacgccaaggacgccggctgcaccctcgtcgaacacatcgaatcccccagcagcatctgggtcttcgccggagctcgagaccgctgcccacccacatgcctattcgtgggaggcatggccgaactaggcgccttcttctccatcctccaggacatgcgtaacaccatcatggcctccaagaccgtaggcaccgccgacgaaaaactccgcaagaaatcctccttctaccaaagctacctccgacgcacacaaagcatgggaatccaactagaccagcgcatcatagtgatgttcatggttgcatggggaaaagaagccgtcgacaacttccacctcggagatgacatggaccccgaactacgcagcctagcacaaatactcattgaccaaaaagtcaaagaaatctccaaccaagaacccatgaaactctga

SEQ ID NO: 7970 - RNA, 1290 nt, synthetic construct
  misc_feature 1..1290: note = derived and/or modified CDS sequence (opt11) from SEOV(Pf26)__AY006465.1__N
  source 1..1290: mol_type = other RNA
atggccacaatggaagaaatacaacgcgaaatctctgcccacgaaggccagctagtcatagcccgccaaaaagtcaaagacgccgaaaaacaatacgaaaaagaccccgacgacctcaacaaacgcgccctacacgacagagaatcagttgccgcctcagtccaatccaaaatagacgaactcaaacgccaactcgctgacagaatcgcagcaggcaaaaacataggacaggaccgcgaccccaccggagtagaacccggagaccacctaaaagaacgcagcgccctctcctacggaaacaccctcgacctaaactccctagacatagacgaacccacaggtcaaaccgccgactggctcaccattatcgtttacctcaccagcttcgtagtcccaatcattttaaaagccctctacatgctcaccacccgcggccggcagacaagcaaagacaacaaaggcatgcgcatacgcttcaaagacgactcctcctacgaagacgtaaacggaataagaaagcccaaacacctatacgtatcaatgcccaacgcacaatcatcaatgaaagccgaagaaatcacccccggccgattccgcaccgcagtctgcggcctctaccccgcccaaatcaaacctcgaaacatggtctcacccgtcatcagcgtcgtcggcttcctcgccctcgccaaagactggacatcccgaatagaggaatggctcggcgccccctgtaaattcatggccgaatccccaatcgctggcagcctctccggcaaccccgtcaaccgcgactacatacgacagcgacaaggcgccctagccggcatggaacccaaagagttccaagccctacgacaacacgctaaagacgcaggctgtaccctcgtcgaacacatcgaatccccctcctccatctgggtcttcgccggcgcccccgatcggtgcccacccacatgcctcttcgttggcggcatggccgaactaggagccttcttctccatcctccaggacatgcgcaacactatcatggcctccaaaaccgtcggcaccgcagacgaaaaactacgcaaaaagtcatccttctaccaaagctaccttcgccgcacccaatccatgggcatccaactcgaccaaagaataatcgtaatgttcatggtagcatggggcaaagaagcagtcgacaacttccacctcggcgacgacatggaccccgaactacgctcactagcccaaattctcatcgaccaaaaagtcaaagaaatctcaaaccaggaacccatgaaactataa

SEQ ID NO: 7971 - RNA, 1290 nt, synthetic construct
  misc_feature 1..1290: note = derived and/or modified CDS sequence (opt11) from SEOV(Rn-CP7)__GQ279382.1__N
  source 1..1290: mol_type = other RNA
atggcaaccatggaagaaatacaacgtgagatcagcgcccacgaaggccagctagtaatcgccagacaaaaagtcaaagacgccgaaaagcaatacgaaaaggaccccgacgacctcaacaaacgcgcactccacgacagagagagcgtcgccgcaagcatccaatccaaaatagacgaactcaaacgccaactagcagacagaatcgccgccggcaaaaacatcggccaagaccgcgacccaaccggcgtcgaacccggagaccacctaaaagaacgctcggccctcagctacggcaacaccctagacctaaactcactcgacatcgacgaaccaaccggccaaacagccgactggctcacaataatcgtctacctgacatcattcgtcgtaccaatcatactcaaagcactatacatgctcacaacacgaggacgacaaaccagcaaagacaacaaaggaatgcgcatccggttcaaagacgacagctcatacgaagacgtcaacggaatccgcaaaccaaaacacctctacgtctccatgccaaacgcacaatcgtcaatgaaagccgaagaaatcacccccggccgcttccgcacggccgtatgcgggctataccccgcccaaattaaagcccgctccatggtaagcccagtcatgagcgtagtcggattcctcgccctggccaaagactggacctcacgcatcgaagaatggctaggagcaccctgcaaattcatggccgaatcccccatcgcaggcagcctcagcggaaaccccgtcaaccgcgactacatacgccagagacaaggagccctagcaggcatggaaccaaaagagttccaagccctgcgccaacacgcgaaagacgccggatgcacactcgtcgaacatatcgaatcaccaagctccatctgggtcttcgctggcgcccccgaccgatgcccacccacatgcctattcgtaggcggcatggccgaactcggcgccttcttctccatcctacaagacatgcgcaacacaataatggcctcaaaaaccgtcggcacagcagacgaaaaactccgcaaaaagagctcgttctaccaatcatacctccgacgcacccaaagtatgggtatccaactagaccaaagaataatcgtaatgttcatggtagcatggggaaaagaagcagtagacaactttcacctaggcgatgacatggaccccgaactaagatcactcgcccaaatactaatagaccaaaaagtcaaagaaatatccaaccaagaacccatgaaactataa

SEQ ID NO: 7972 - RNA, 1290 nt, synthetic construct
  misc_feature 1..1290: note = derived and/or modified CDS sequence (opt11) from SEOV(Rn-DC8)__GQ279386.1__N
  source 1..1290: mol_type = other RNA
atggccaccatggaagaaatacaacgcgaaatatcagcccacgaaggccaactcgtcatcgcccgccagaaagtaaaagacgccgaaaaacaatacgaaaaagaccccgacgacctcaacaaacgcgcgctccacgaccgcgaatccgtagccgccagcatccagagcaaaatcgacgaactcaaacgccaactcgcggacagaatcgccgccggcaaaaacatagggcaagacagagaccccaccggcgtagaacccggcgatcacctcaaagaacgaagcgccctctcatacggcaacaccctagacctaaacagcctagacatagacgaaccaacaggccaaaccgcagactggctaaccatcatcgtctacctcacctcattcgtcgtccccatcatactaaaagccctgtacatgctcaccgcccgcggacgccaaacctccaaagacaacaaaggaatgagaatacgcttcaaggacgactcatcgtacgaagacgtcaacggcatccgcaaaccaaaacacctctacgtcagcatgccaaacgcccaatcctccatgaaagcagaagaaatcacacccggcagattccgcaccgcagtctgcggcctctaccccgcccaaataaaagcccgcagcatggtatcaccggtcatgtccgtcgtcggcttcctcgcactcgccaaagactggaccagccgaatagaggaatggctcggcgccccatgcaagttcatggccgaaagccctatcgcaggcagcctctcaggaaacccagtcaaccgcgactacatccgacaaaggcaaggcgccctcgccggaatggaaccaaaagagttccaagccctccgccaacacgccaaagacgccggctgcaccctagtcgaacacatcgaaagccccagctccatctgggtcttcgcaggagcgccagaccgatgcccaccaacctgcctattcgtcgggggcatggccgaactaggagccttcttctcaatcctccaagacatgcgcaacaccatcatggccagcaaaaccgtcggaaccgccgacgaaaaactacgaaagaaatcctccttctaccaatcctacctccgccgcacacaatcgatggggatccaactcgaccaacgaataatcgtcatgttcatggtcgcatggggaaaagaagcagtagacaacttccacctcggcgacgacatggaccccgaactacgcagcctcgcacaaatcctcatagaccaaaaagtcaaagaaatctcaaaccaagaaccgatgaaactctaa

SEQ ID NO: 7973 - RNA, 1290 nt, synthetic construct
  misc_feature 1..1290: note = derived and/or modified CDS sequence (opt11) from SEOV(Rn-M11)__GQ279383.1__N
  source 1..1290: mol_type = other RNA
atggcgaccatggaagaaatccaacgcgagatctcagcccacgaaggtcaactcgtcatcgcaagacaaaaagtcaaaaacgccgagaaacaatacgaaaaagaccccgacgacctcaacaaacgagcactacacgaccgagaatcagtcgccgcatccatccaatccaaaatagatgaactcaagcgccaactcgcagaccgcatcgccgccggcaaaaacatcggacaagaccgcgaccccaccggagtagaacccggcgaccacctcaaagaacgctccgccctatcttacggcaacaccctggacctaaactcattagacatcgacgagcccactggccaaaccgccgactggctcaccatcatcgtatacctcacatcattcgtcgtcccaatcatactcaaagccctttacatgctcacaacccgaggccgccaaaccagcaaagacaacaaaggcatgcgaatccgattcaaagacgacagctcatacgaggacgtcaacggcatccgcaagcccaaacacctctacgtatctatgcccaacgcccaatcctccatgaaagccgaagaaatcacccccggccgattccgcaccgccgtctgcgggctatacccagcccaaatcaaagcccgatctatggtcagccccgttatgagcgtagtcggcttcctcgccctagccaaagactggacctcccgtatagaagaatggctcggcgccccatgcaaattcatggccgaatcccccatcgccggatccctctccggaaaccctgtcaaccgcgactacatacgccaacgccgcggtgccctagccggcatggaacccaaagaatttcaagcactccgccagcatgcaaaagacgcgggctgcaccctcgtagaacacatcgaatcacccagctccatctgggtcttcgccggcgcccccgacagatgcccaccaacctgcctcttcgtcggcggcatggccgaactaggagccttcttctccatcctccaggatatgcgcaacaccataatggccagcaaaaccgtcggcaccgccgacgagaaactcaggaagaaaagctcattctaccaatcctacctccgacggacccagtcaatgggaatccaactcgaccaaagaatcatagtcatgttcatggtagcatggggcaaagaagcagtagacaacttccacctcggcgacgacatggaccccgaactcagatccctcgcccaaatactcatcgaccaaaaagtcaaagaaatatcaaaccaagaacccatgaaactctaa

SEQ ID NO: 7974 - RNA, 1290 nt, synthetic construct
  misc_feature 1..1290: note = derived and/or modified CDS sequence (opt11) from SEOV(RuianRf74)__FJ803213.1__N
  source 1..1290: mol_type = other RNA
atggccactatggaagaaatccagcgggaaatctcagcccacgaaggccagctagtcatcgcccgccaaaaagtaaaagacgcagaaaaacaatacgaaaaagacccagatgacctcaacaaacgtgccctacacgatcgcgaatccgtcgccgcctcaatccaatcaaaaatcgacgaactcaaacgtcaactggcagaccgtatagccgccggcaaaaacatcggacaagaccgcgacccaaccggagtcgaaccaggcgaccaccttaaagaacgatccgccctatcatacggcaacacactcgacctaaacagcttagacatcgacgaacccacaggccaaaccgccgactggctcaccatcatcgtatacctcacatccttcgtcgtacccataatacttaaagccctatacatgctaactacacgaggccgccaaacctccaaagacaacaaaggaatgcgaatccgcttcaaagacgactcatcctacgaagacgtaaacggaatacgcaaacccaaacacctatacgtatccatgcccaacgcccaatcctccatgaaagccgaagaaataacccccggccggttcagaatggcagtctgcggcctctaccccgcacaaatcaaagcacgcaacatggtctcccccgtcatgtccgtcgtcggcttcctcgcccttgccaaagactggacctcccgcatcgaagaatggcttggagccccgtgcaaattcatggcggaatcccccatcgcaggatcactctccggcaaccccgtcaaccgcgactacatccgccaacgacaaggcgcactagccggcatggaaccaaaagagttccaagccctgcgtcaacacgccaaagacgcaggctgcaccctggtcgaacacatcgaatccccctcctcaatctgggtcttcgccggagcccccgaccgctgcccaccaacctgcctcttcgttggcggcatggcagaactcggcgcattcttctccatcctccaagacatgcgaaacacaatcatggcctccaaaacagtcggcaccgccgacgaaaaactacgaaagaaatcatctttctaccagtcatacctccgccgcacccaaagcatgggcatccaactcgaccaacgcataatcgtcatgttcatggtcgcctggggcaaagaagccgtcgacaacttccacctaggagacgacatcgaccccgaactccgctccctcgcccaaatcctcatagaccaaaaagtcaaagaaatctccaaccaagaacccatgaaactctaa

SEQ ID NO: 7975 - RNA, 1290 nt, synthetic construct
  misc_feature 1..1290: note = derived and/or modified CDS sequence (opt11) from SEOV(RuianRn23)__FJ803214.1__N
  source 1..1290: mol_type = other RNA
atggccactatggaagaaatccaacgcgaaatatcagcacacgaaggccagctagtaatcgcacgccaaaaagtcaaagacgccgaaaaacaatacgaaaaagacccagacgaccttaacaaaagagccctccacgaccgcgagagcgtcgctgcctccatccaatccaaaatcgacgaactcaaacgccaactcgctgaccgcatcgccgccggcaaaaacattggacaagaccgcgaccccacaggtgtcgaacccggcgaccacctaaaagaacgctcagcactatcctacggcaacaccctcgacctcaactcactcgacatcgacgaaccgacaggccaaaccgcagactggctaaccatcatcgtctacctaacatccttcgtcgtgccaatcatactcaaagccctctacatgctgaccaccagaggccgacaaacatccaaagacaacaaaggcatgcgaatccgattcaaagacgactccagctacgaagacgtcaacggcattcgaaaaccaaaacacctctacgtatccatgccaaacgcgcaaagctccatgaaagccgaagaaatcacccccggacgcttcagaacagcagtatgcggactctaccccgcccaaatcaaagcccgcaacatggtcagccccgtcatgtccgtcgtcggattccttgcactcgcaaaagactggacctcacgcatagaagaatggctaggcgccccctgcaaattcatggccgaatcccccatcgctggctccctatcagggaaccccgtaaaccgagactacatacgacaacgccaaggagccctagccggcatggaacccaaagagttccaggccctccgacaacacgccaaagacgccggctgcacgctagtcgaacacatagaatcaccctccagcatctgggtcttcgccggcgcccccgacaggtgcccaccaacatgcctcttcgtcggcggcatggccgaactcggggccttcttctccatcctccaagacatgcgcaacaccataaaagcaagcaaaacagtcggcacagcagacgaaaaactaagaaagaaatcctcattctaccagtcctacctgagacgaacccaatccatgggcatccaactagaccaacgcatcatcgtcatgtttatggtcgcatggggaaaagaagcagttgacaacttccacctaggcgacgacatggaccccgaactccgctcactagcccaaatcctcatcgaccaaaaagtcaaagaaatctcaaatcaagaacccatgaaactctaa

SEQ ID NO: 7976 - RNA, 1290 nt, synthetic construct
  misc_feature 1..1290: note = derived and/or modified CDS sequence (opt11) from SEOV(RuianRn33)__FJ803215.1__N
  source 1..1290: mol_type = other RNA
atggcgaccatggaagaaatccaacgcgaaatatccgcacacgaaggacagctagtaatcgccagacaaaaagtcaaagacgcagaaaaacaatacgaaaaagacccagacgacctcaacaaacgagccctccacgaccgagaaagcgtcgcagcatccatacaaagcaaaatcgacgaactaaaacgccaattagcagaccgcatcgcagctggcaaaaatatcggccaagaccgagacccaacgggagtcgaacccggcgaccacctaaaagaacgatccgccctatcctacggaaacaccctcgacctcaacagcctagacatcgacgaaccaaccggacaaaccgccgactggctaaccatcatcgtgtacctcacctccttcgtcgtacccataatcctaaaagccctctacatgctcaccacccggggccggcagacctcaaaagacaacaaaggaatgcgcatccgattcaaagacgactcctcctacgaagacgtcaacgggatccgaaaacccaaacacctatacgtaagcatgcccaacgcccaaagctcaatgaaagccgaagaaataacacccggccgcttccgcaccgccgtctgcggactataccccgcccaaatcaaagcacggaacatggtctcccccgtaatgtccgtagtcggattcctcgccctcgcaaaagactggacctcccgaatcgaagaatggctcggcgcaccctgcaaattcatggccgaatcccccatagccggatccctctcaggaaacccagtcaaccgcgactacatccggcaacgccaaggagccctggccggcatggaacccaaagagttccaagccctacgccaacacgccaaagacgccggctgcaccctagtcgaacacatagaatccccatcctcaatatgggtcttcgccggcgcccccgaccgatgcccaccaacctgcctattcgttggaggcatggccgaactaggagccttcttcagcatcctccaagacatgcgaaacacaattatggcatccaagaccgtcggaacagccgacgaaaagctgcgcaagaaatccagcttctaccaatcatacctccgccgcacacaatccatggggatccaactcgaccaaagaatcatagtaatgttcatggtcgcccgcggcaaagaagctatgtacaacctacacctccgagacgacatgaccccacaactcctcctcctagtacaaatactactcgaccaccaagtcaaagaaatctccaaccaagaactaatgaaactatag

SEQ ID NO: 7977 - RNA, 1290 nt, synthetic construct
  misc_feature 1..1290: note = derived and/or modified CDS sequence (opt11) from SEOV(SC106)__GU361893.1__N
  source 1..1290: mol_type = other RNA
atggccacaatggaagaaatccaacgagaaatcagcgcccacgaaggccaacttgtcatcgcccgccaaaaagtcaaagacgccgaaaaacaatacgaaaaagacccagacgaccttaacaaacgcgccctccacgaccgcgaatccgtcgccgcaagcatccaatccaaaatagacgaactcaaacgccaactagccgacagaatcgcagccggcaaaaacatcggacaagaccgtgaccccaccggagtcgaacctggggaccacctcaaagaacgctcagccctaagctacggcaacactctcgacctcaactccctagacatcgacgagcccaccggccaaacagccgattggctaaccatcatcgtttacctaaccagcttcgtcgtcccaatcatcctcaaagccctgtacatgctaacaacccgcggacgacaaacctccaaagacaacaaaggcatgcgcatccgcttcaaagacgactcctcctacgaagacgtcaacggcatcagaaaacccaaacacctctacgtccccatgccaaacgcccaatcctccatgaaagccgaagaaatcacccccggccgcttccgcaccgccgtctgcggcctatacccagcccaaatcaaagcacgaaacatggtcagccccgtaatgtccgtagtcggattcctagccctcgctaaagactggaccagccgaatcgaggaatggctaggagcaccctgcaaattcatggcagaatcgccaatcgccggctccctctccggcaaccccgtcaaccgagactacatacgacaaagacaaggcgccctcgcaggcatggaaccgaaagagttccaagctctccgccaacacgctaaagacgccggctgcaccctagttgaacacatagaaagcccatcctccatctgggtcttcgccggagcccctgaccgctgtccccctacctgcctcttcgtaggcggcatggcagaactaggagccttcttctcaatcctccaggacatgcgcaacaccataatggcaagcaaaaccgtaggaaccgcagacgaaaaactgcgaaagaaatcctccttctaccaatcctacctccgacgcacccaatccatgggcatacaactcgaccaacgcatcatcgtcatgttcatggtagcctggggcaaagaagcagtagacaacttccacctcggcgacgacatggacccagaactacgaagcctcgcccaaatactcatcgaccaaaaagtcaaagaaatatcaaaccaagaacccatgaaactctaa

SEQ ID NO: 7978 - RNA, 1290 nt, synthetic construct
  misc_feature 1..1290: note = derived and/or modified CDS sequence (opt11) from SEOV(SEO/Belgium/Rn895/2005)__JQ898106.1__N
  source 1..1290: mol_type = other RNA
atggccacaatggaagaaatccaacgcgaaatctccgcccacgaaggacagctagtcatcgcaagacaaaaagtcaaagacgccgaaaaacaatacgaaaaagaccccgacgacctaaacaaacgggccctccacgaccgcgaaagcgtcgctgcatcaatacaatccaaaatagacgaactaaagcgccaactcgcagacagaatcgccgccggcaaaaacatcggccaagaccgcgaccccacaggcgtagaacccggcgaccacctcaaagaacgatcagccctgtcctacggcaacaccctcgacctaaactccctcgacatcgacgagccgaccggccaaaccgccgactggctaaccataatcgtctacctaacatccttcgtcgtcccaatcatacttaaagcactctacatgctaacgacccgcggacgccaaacctccaaagacaacaaaggcatgcgaatcaggttcaaagacgacagcagctacgaagacgtcaacggcatcagaaaacccaaacacctctacgtatccatgcccaacgcacaatcaagcatgaaggccgaagaaatcacccccggccgcttccgcacggcagtatgcggcctataccccgcacaaatcaaagcgcgcaacatggtaagcccagtcatgagcgtcgtcggattcctcgccctagccaaagactggaccagccgcatcgaagagtggctaggagcgccctgcaaattcatggcagactcacccatcgcaggcagcctctctggaaaccccgtcaaccgagactacatccgccaacgccagggcgccctcgcaggcatggaacccaaagagttccaagccctccgccaacactcaaaagacgcaggatgcaccctagtagaacacatcgaatcaccatcctcaatctgggtattcgccggagccccagacaggtgcccaccaacctgcctattcgtcggcggcatggccgaactcggcgccttcttctccatactccaagacatgcgaaacacaatcatggccagcaaaaccgtcggcacggcagacgaaaaactacgaaagaaatcctcattctaccaatcctacctccgccgcacccaaagcatgggaatccaactagaccaacgaataatagtcatgttcatggtcgcatggggaaaagaagcagtcgacaacttccacctcggagacgacatggaccccgaactccgatccctcgcacaaatcctcatagaccaaaaggtcaaagaaatatcaaaccaagaacccatgaaactctag

SEQ ID NO: 7979 - RNA, 1290 nt, synthetic construct
  misc_feature 1..1290: note = derived and/or modified CDS sequence (opt11) from SEOV(Taonan420)__KF745951.1__N
  source 1..1290: mol_type = other RNA
atggcaaccatggaagaaatccaacgagaaatatccgcccacgaaggccagctagtcatcgcccgccaaaacgtcaaagacgccgaaaaacaatacgaaaaagacccagacgacctcaataaaagagcgctccacgaccgcgagtccgtagccgcatcaatacaaagtaaaatcgacgaacttaaaagacaaccagccgaccgcatcgccgcaggcaaaaacatcggtcaagaccgagaccccaccggcgtcgaacccggcgaccacctaaaagaaagatccgccctatcctacggcaacacccttgacctaaaccgcctagacatcgacgaaccaacaggccaaagagcagactggctcaccataatagtctatctaacatccttcgtcgtccgaatcatcctgaaagccctatacatgttcagcacacgcggccgccaaacctccaaagacaacaaaggcctccgaatccgattcaaagacgactcatcctacgaagacttcaacggaatccgcaaacccaaacacctatacgtacccatgcccaacgcccagagcagcatgaaagcagaagaaatcacacccggccgcttcagaaccgcagtctgcggtctctacccagcccaaatcaaagcccgcaacatggtatcccccgtgatgagcgtagtcggcttcctcgccctcgccaaggactggacctcccgcatcgaagaatggctaggcgccccctgcaagttcatggccgaatcccccatcgcaggctccctatcaggcaaccctgtcaaccgagactacatacgacaacgccaaggcgccctagccgcaatggaaccaaaagagttccaagccctccgccaacacgccaaagaccccggctgcactctagtcgaacacatagaaagtccctccagcatctgggtctccgccggcgcaccagacagatgcccaccaacatgcctcttcgtcggaggcatggccgaactcggagccttcttcagcatattccaagacatgagaaacacaataatgccatccaaaaccgtcggcaccgcagacgaaaaactccgcaagaaatccctcttctaccaatcatacctccgccgcacacagtcaatgggaatacaactcgaccaacgtataatcgtcatgttcatggtagcctgggggaaagaggccgtggacaacttccacctacccgacgacatggaccccgagctacgaagcctagcccagatcctcatagtccagaaagtcaaagaaatatcaaaccaagaaccaatgaaactctag

SEQ ID NO: 7980 - RNA, 1290 nt, synthetic construct
  misc_feature 1..1290: note = derived and/or modified CDS sequence (opt11) from SEOV(Taonan52)__KF745950.1__N
  source 1..1290: mol_type = other RNA
atggcaacaatggaagaaatacaacgagaaatatcggcccacgaaggacaactcgtcaccgcaagacaaaaagtcaaagacgcagaaaaacaatatgaaaaagacccagacgacctcaacaagagagcactacacgaccgcgagtccgtagccgcaagcatacaatccaaaatagatgaagtcaagcgacagctcgcagacaggatcgcagccggcaaaaacatcggacaagaccgcgacccaacaggcgtcgaaccaggagaccacccaaaagaacgctcagccctatcctacggcaacacactagacctcaactccctcgacatcgacgaacccaccggccaaacagcagactggctaacaataatcgtatacctgacatcgttcgtcgtaccgatcatactcaaagccctatacatgtccactacccggggcagacaaaccagcaaggacaaccgaggaatgagaatacgattccaagatgacagctcatacgaagacgtcaacggaatccgaaaacccaagcacctctacgtccccatgccgaacgcacaatcaagcatgaaagcggaagaggtcacccccggccgattccgcacggccgtatgcggactctaccccgcacaaataaaagcacgcaacatggtacggccagtcatgagcgtagtaggattcctagccctcgccaaagcctggaccagccgcatagaagaatggctaggcgccccctgcaaattcatggcggaatcccccatagcaggaagcctaagcggcaacccagtctaccgcgactacatacgccaacgccaaggcgcactcgccggcatggaaccgaaagagttccaagcactaagacaacacgccaaagacgccggctgcaccctagtagaactcatcgaaagcccgtcctcaatttcagtattcgccggagcccccgaccgatgcccgcgcacatgcctgttcgtgggaggaatggccgaactaggcgccaacttcagcatgctccaagacatgtcaaacacaataatggccagcaagaccgtgggtacagccgacgaaaaactacgaaagaaaagcagcttctaccaatcatacctccgcagaacccagtccatgggcatccaactagaccaacgaatcatcgtaatgttcatggtcgcctcaggaaaagaagcagtagactacttccacctaggcgatgacatggaccccgaactacgcagcctcgcaccaatcctcatcgaccagaaagtaaaagaaatctccaaccaagaaccaatgaaactctag

SEQ ID NO: 7981 - RNA, 1290 nt, synthetic construct
  misc_feature 1..1290: note = derived and/or modified CDS sequence (opt11) from SEOV(WuhanMm24)__JQ665911.1__N
  source 1..1290: mol_type = other RNA
atggcgaccatggaagaaatccagagagaaatctcagcccacgaaggacagctagtcatcgcccgccaaaaagtcaaagacgccgaaaaacaatacgaaaaggacccagacgacctaaacaaacgcgccctacacgatcgagagagcgcggcagcctccatacaatccaaaatagacgaactcaaacgccaactcgcagaccgcatagccgcaggcaaaaacataggccaggaccgcgacccaaccggcgtcgaaccaggcgaccacctcaaagaacgctcagccctcagctacggcaacaccctcgacctcaacagcctagacatagacgaacccaccggccaaaccgcagactggctcaccatcatcgtctacctaacgagcttcgtcgtacccataatcctgaaagccctatacatgttaacaactcgcggacgccaaaccagcaaagacaataaaggcatgcgaatacgcttcaaagacgacagctcatacgaagacgtcaacggaatccggaaacctaaacacctctacgtctccatgccgaacgcccagtcctccatgaaagcagaagaaatcacccccgggcgattccgcaccgccgtctgcggactctaccccgcccaaataaaagcacgaaacatggtcagcccagtaatgtcagtggtcggcttcctggcactggccaaagactggaccagccgcatcgaagaatggcttggcgcaccctgcaaattcatggcagaatcacccatcgcaggctccctctccggaaaccccgtcaaccgagactacatacgccaacgccaaggcgcactcgccggcatggaaccaaaagaatttcaagcactacgacaacactccaaagacgccggatgcaccctcgtagaacacatcgaaagcccatccagcatctgggttttcgccggagccccagaccgctgcccaccaacctgcctcttcgtaggcggaatggccggcctcggggccttcttcagcatcctacaagacatgcgcaacaccatcatggcatcaaaaaccgtcggtacagccgacgaaaaactcaggaagaaatcctcattctatcaatcctacctccgacgcacacagtcaatgggcatccaactagaccaacgcatcatcgtcatgttcatggtcgcttggggcaaagaagccgtagacaactttcacctcggcgacgacatggaccccgaactacgctcactcgcccaaatcctaatagaccaaaaagtaaaagaaatatcaaaccaagaaccaatgaaactctaa

SEQ ID NO: 7982 - RNA, 1290 nt, synthetic construct
  misc_feature 1..1290: note = derived and/or modified CDS sequence (opt11) from SEOV(WuhanRf02)__JQ665912.1__N
  source 1..1290: mol_type = other RNA
atggcaaccatggaagaaatacaacgagaaatctccgcccacgaaggccagctagtcatcgcccgccaaaaagtaaaagacgccgaaaaacaatacgaaaaagaccccgacgacctcaacaaacgcgcactacacgaccgcgaatccgtcgccgccagcatccaatcaaaaatagacgaactcaaacgacaactagccgaccgaatcgcagccggcaaaaacatcggccaagaccgtgaccccacaggagtagaacccggcgaccacctcgaagaacgttcagccctctcctacggcaacacactcgacctcaactccctagacatcgacgaacccaccggacaaaccgcagactggctaaccatcatcgtctaccttacctccttcgtagtcccaatcatactcaaagccctatacatgctaaccacacggggccgccaaacaagcaaagacaacaaaggaatgcgcatcaggttcaaagacgacagctcctacgaagacgtcaacggaataaggaaacccaaacacctatacgtctcaatgccaaacgcacaaagcagcatgaaagcggaagaaatcacccccggccgcttccgcacagcagtctgcggactctaccccgcacagatcaaagcacgcgacatggtctcacccgtaatgagcgtcgtaggattcctcgccctcgccaaagactggacctcccgcatcgaggaatggctaggagcaccatgcaaattcatggccgaatcccccatcgccggctccctatccggcaaccccgtcaaccgcgactacatcagacaacgacaaggagcactcgcaggaatggaaccaaaagagttccaagcactacgacaacactcaaaagacgcaggatgcaccctagtcgaacacatagaatccccctccagcatctgggtcttcgccggtgcccgagaccgatgcccacccacgtgcctcttcgtcggaggcatggccgaactcggcgcattcttcagcatacttcaagacatgcgaaacacaatcatggcatcaaaaacggtcggcacggccgacgaaaaactcagaaagaaatccagcttctaccaatcatacctccgccgaacccagtccatgggaatccaactcgatcaacgcatcatcgtcatgttcatggtcgcctggggtaaagaagccgtcgataacttccacctaggcgacgacatggaccccgaactacgcagcttagcgcaaatcctcatagaccagaaagtcaaagaaatctcaaaccaagaacccatgaaactataa

SEQ ID NO: 7983 - RNA, 1290 nt, synthetic construct
  misc_feature 1..1290: note = derived and/or modified CDS sequence (opt11) from SEOV(WuhanRf07)__JQ665913.1__N
  source 1..1290: mol_type = other RNA
atggccaccatggaagaaatccaacgcgaaatctccgcacacgaaggacaactcgtcatcgcacgacaaaaagtaaaagacgccgaaaaacaatacgaaaaagaccccgacgacctcaacaaacgcgccctccacgacagagaaagcgtcgccgcaagcatccaaagcaaaatagacgaactcaaaagacagctcgccgaccgaatcgccgcaggcaaaaacatcggccaagaccgagaccccaccggcgtcgaacccggcgaccacctcaaagaacgatcagccctctcctacggaaacaccctagacctaaactcactagacatcgacgagcccaccggacaaaccgccgactggctaacgatcatcgtctacctaacctccttcgtagtcccaatcatcctaaaagccctatacatgctcaccacacgtggccgacaaacctcaaaagacaacaaaggcatgcgtatccgcttcaaagacgactcctcctacgaggacgtgaacggcatccgaaagccaaaacacctgtacgtatccatgccgaacgcacaatcgtccatgaaagcagaagaaatcacacccggcagattcagaaccgcagtctgcggcctatacccagcccaaataaaagccagaaacatggtatccccagtcatgtccgtagtcggcttcctagccctcgcaaaggactggacctcacgaatcgaagaatggctcggcgccccctgcaaattcatggccgaaagcccaatcgccggctccctctccggcaatcccgtaaaccgcgactacatacgccaacgccaaggcgcactcgcagggatggaaccaaaagagttccaagcactccgccagcacagcaaagacgccggatgcaccctagtcgaacacatagaatctccctcctcaatctgggtcttcgcaggagccagagaccgatgcccaccaacctgcctattcgtcggcggaatggcagaactgggagccttcttctccatactccaagacatgcggaacaccatcatggcatccaaaacggtagggacagcagacgaaaaactacgaaagaaatcctccttctaccaaagctacctcagaagaacgcaaagtatgggaatccaactagaccaacgaataatcgtcatgttcatggtcgcatggggcaaagaagcagtcgacaacttccacctaggagacgacatggaccccgaactccgctcactagcccagatcctaatcgaccaaaaagtcaaagaaatcagcaaccaggagcccatgaaattatga

SEQ ID NO: 7984 - RNA, 1290 nt, synthetic construct
  misc_feature 1..1290: note = derived and/or modified CDS sequence (opt11) from SEOV(ZJ5)__FJ753400.1__N
  source 1..1290: mol_type = other RNA
atggccacaatggaagaaatccagagagaaatatccgcccacgaaggccagctagtcatcgcccggcaaaaagtcaaggacgcagaaaaacaatacgaaaaggaccccgacgacctcaacaaacgcgccctccacgaccgagaatccgtcgcagcctcaatccaaagcaaaatcgacgaactaaaacgacaactagccgaccgaatcgcagccggcaagaacatcggccaagaccgcgaccccaccggcgtagaaccgggcgaccacctcaaagaaagatccgccctaagctacggcaacaccctcgacctcaactccctcgacatcgacgaacccacaggtcaaaccgccgactggctcaccataatcgtatacctcacctcattcgtagtaccaatcatcctcaaggccctttacatgctcacaacccgaggacgacaaaccagcaaagacaacaaaggaatgcgcatccgcttcaaagacgactcgtcatacgaagacgtaaacggaatccgaaaacccaaacacctatacgtctcaatgccaaacgcacaatcctcaatgaaagcagaagaaatcacgcccggacgcttcagaacagccgtctgcggactatacccggcacaaatcaaagcccgaaacatggtatcccccgtcatgtcagtcgtaggattcctcgcacttgccaaagactggacttcccgcatcgaagaatggctcggcgcaccctgcaaattcatggccgaatcacccatagcaggcagcctctccggcaacctagttaaccgagactacatccgccaacgccaaggcgcactcgccggcatggaacccaaagaattccaggcactacgacaacacagcaaagacgccggatgcaccctcgtcgaacacatcgaatccccctcctcaatctgggtcttcgccggagcacccgaccgctgcccccccacatgcctattcgtcggaggcatggcagaactcggagccttcttctccatactccaagacatgcgcaacaccatcatggcatccaaaaccgtcggcacagccgacgaaaagctacgaaaaaaatcctcattctaccaatcatacctccgacgaacccaatcaatgggcatccaactagaccaacgcatcatcgtcatgttcatagtcgcctggggcaaagaagcagtagataacttccacctcggcgacgacctcgaccccgaactccgctcactcgcacaaatcctcatcgaccaaaaagtaaaagaaatctccaaccaagaaccaatgaaactctaa

SEQ ID NO: 7985 - RNA, 1290 nt, synthetic construct
  misc_feature 1..1290: note = derived and/or modified CDS sequence (opt11) from SEOV(ZT10)__AY766368.1__N
  source 1..1290: mol_type = other RNA
atggccctgtgcgaagaaatccaacgcgaaatctcagcccacgaagggcaactagtcatagcacgccaaaaagtaaaagacgcagaaaaacaatacgaaaaagaccccgacgacttcaacaaacgagccctgcacgaccgcgaaagcgtagccgccagcatacaatcaaaaatagacgaactcaaacgccaactagccgaccgaatcgcagccggcaaaaacatcggacaagaccgtgaccccaccggagtggaacccggcgaccacctaaaagaacgaagcgccctaagctacggaaataccctagacctaaactcactagacatcgacgaacccaccggacaaacagccgactggctgaccatcatcgtatacctaacatcattcgtcgtcccaatcatcctcaaagccctatacatgctaacaaccagaggacgccagaccagcaaagacaacaaaggcatgcgcatccgcttcaaagacgacagctcatacgaagacgtcaacggaatcagaaaacccaaacacctctacgtctcaatgccaaacgcacaatcaagcatgaaagccgaagaaatcacaccaggccgctttcgcacagcagtctgcggcctctaccccgcgcagatcaaagcccgcaacatggtatccccagtcatgagcgtcgtcggcttcctagccctggccaaagactggacatcccgcatcgaagaatggctgggagcaccctgcaaattcatggcagaatccccaatagccggcagcctcagcggcaaccccgtaaaccgcgactacatacgccaacgccaaggcgcgctcgcaggcatggaaccgaaagagttccaagccctccgccagcacgccaaagacgccggatgcactctcgtcgaacacatcgaatcaccatcctccatctgggtcttcgccggagcccccgacagatgcccaccaacctgcctattcgtcggcggcatggcagaactcggcgccttcttctccggactcgcggacatgagaaacacaattatggccagcaaaacagaaggaaccgcagacgaaaaactaaggaaaaaaagctcattctatcaatcgtatctcagacgccaacagagcatgggcatccaactcgaccaacgcataatagtcatgttcatggtcgcatggggaaaagaagcagtcgacaacttccacctcggagacgacatggacccagaactccgcagcctagcacaaatcctcatcgaccaaaaagtgaaagaaatatcaaaccaggaaccaatgaaactataa

SEQ ID NO: 7986 - RNA, 1290 nt, synthetic construct
  misc_feature 1..1290: note = derived and/or modified CDS sequence (opt11) from SEOV(ZT71)__AY750171.1__N
  source 1..1290: mol_type = other RNA
atggcaaccatggaagaaatccaaagagaaatctcagcacatgaaggccaactcgtaatagcccgccaaaaagtcaaagacgcagaaaaacaatacgaaaaggacccagacgacttcaacaaaagagcccttcacgaccgcgaatccgtcgccgccagcatccaatcaaagatagacgaacttaaacgccaactcgcggaccgcatcgcagccggcaaaaacatcggacaagaccgcgaccccacaggagtagaacccggagaccacctaaaagaacgatccgccttaagctacggcaacaccctggacctcaactccctcgacatagacgaaccaacaggccaaaccgccgactggttaacaataatagtctacctaacctccttcgtcgtccccatcatcctaaaagcactctacatgctaaccacccgaggccgacaaacctccaaagacaacaaaggaatgcgaatcagattcaaggacgacagctcatacgaagacgtaaacggaatacggaaacccaaacacctatacgtcagcatgccgaacgcccaatcaagcatgaaagcagaagagataacccccggccgcttccgcaccgccgtctgcggactataccccgcccaaatcaaagcacgaaacatggtctcccccgtcatgagcgtcgtcggattcctagccctcgccaaagactggacatcacgcatcgaagagtggctcggcgccccctgcaaattcatggcagaatcccccatagccggcagcctgagcggcaacccagtcaaccgcgactacatcagacaacgccaaggcgcactagcaggcatggaacccaaagagttccaagccctacgccagcacgcaaaagacgccggctgcaccctcgtcgaacacatcgaaagcccaagcagcatatgggtcttcgccggggccccggaccgctgcccacccacatgcctgttcgtgggcggaatggccgaacttggcgccttcttcagcatccttcaagacatgcgaaacacaataatggccagcaaaaccgaaggcaccgccgacgaaaaactacgcaagaaatcctcattctaccaatcatacttaagacgacaacaaagcatgggcatccaactagaccaacgcatcatcgtaatgttcatggtcgcctggggaaaagaagccgtcgacaactttcacctgggagatgacatggaccccgaactccgatcactcgcacaaatactaatagaccaaaaagtcaaagaaatttcaaaccaagaacccatgaagctctag

SEQ ID NO: 7987 - RNA, 1290 nt, synthetic construct
  misc_feature 1..1290: note = derived and/or modified CDS sequence (opt11) from SEOV(zy27)__AF406965.1__N
  source 1..1290: mol_type = other RNA
atggccaccatggaagaaatacaacgagaaatatccgcccacgaaggccagctagtcatcgcccgacaaaaagtcaaagacgcagaaaagcaatacgaaaaagatccagacgacagcaataaacgagcactacacgaccgcgaaagtgttgccgcatcaatccaatcaaaaatagacgaactcaagcgccaactcgcagaccgcatcgccgccggcaaaaatattggacaagaccgagacccaaccggcgttgaacccggcgaccacctaaaagaacgctccgcccccagctacggcaataccctagacctcaactcactcgacatagacgaacccactggccaaacggcagactggctgaccatcatcgtatacctaacctccttcgtagtaccgatcatcctcaaagccctctacatgctaaccacccgcggccgccaaaccagcaaagacaacaaaggaatgcggatcagattcaaagacgactcctcatacgaagacgtaaacgggatccgaaaaccaaaacacctctacgtctctatgccaaacgcccaatcctcaatgaaagccgaagaaatcacacccgaaagattccgaaccgccgtatgcggcctataccccgcccaaatcaaagcacgaaacatggtctcccccgtcatgagcgtagtcggcttcctagccctcgccaaagactggacctcccgcatcgaagaatggctaggcgccccatgcaaattcatggccgaatcccccatagccggctcactaagcggaaaccccgtaaaccgagaccacatacgccaacgccaaggcgccctcgcgggaatggaaccaaaagagttccaagccctccgccagcacgccaaagacgcagggtgcaccctagtcgaacacatcgaaagcccctcctcaatctgggtctttgccggagcaccagacaggtgtcccccaacatgcctgttcgtaggcggcatggccgaactcggcgcattcttcagcatcctccaagacatgcgcaacacaataatggccagcaagacagtcggaacagccgacgaaaaactacgcaaaaagtcctccttctatcaatcatacctcagacgcacccaaagcatgggcatacaactagaccaacgtatcatagtaatgttcatggtcgcctggggaaaagaagccgtcgacaacttccacctcggcgacgacatggaccctgaactacgctcactggcccagatcctaatagaccaaaaagtaaaagaaatctccaaccaagaacccatgaaactctaa

SEQ ID NO: 7988 - RNA, 1290 nt, synthetic construct
  misc_feature 1..1290: note = derived and/or modified CDS sequence (opt11) from SEOV(DN2)__KX289954.1__N
  source 1..1290: mol_type = other RNA
atggcaaccatggaagaaatccaacgcgaaatcagcgcccacgaaggccagctagtgatcgcccgccaaaaagccaaagacgccgagaaacaatacgaaaaagatcccgatgacctcaacaaacgcgcgctccacgaccgcggaagcgtcgccgcctccatacaatccaaaatcgacgaactcaaacgccaactcgcagaccgcattgcagccggtaaaaacataggacaagaccgcgaccccaccggagtcgaaccaggagaccacctcaaggaacgctcggccctctcatacggcaacaccctagacctaaactcactcgacatcgacgaaccaaccggacaaaccgcagactggctcaccataatcgtctacctaacatccttcgtcgtccccatcatcctcaaagccctatacatgctaaccacccgcggccgacaaactagcaaagacaacaaaggaatgcggatccgattcaaagacgacagctcatacgaagacgtcaacggcatccgcaaaccaaagcacctgtacgtaagcatgcccaacgcccaaagctcaatgaaagcagaagaaatcaccccaggccgcttcagaacagccgtatgcggcctctacccagcccaaataaaagccagaaacatggttagccccgtgatgtccgtcgtaggcttcctagccctagccaaagactggacctcgcggatcgaagaatggctcggagaaccctgcaaattcatggccgaatccccaatagcaggaagcctatccggtaacccagtaaaccgcgactacatccgccaacgccaaggcgccctcgcaggcatggaacctaaagagttccaagcgcttcgccaacacagcaaagacgccggctgcacactcgtcgaacacatcgaatccccaagcagcatctgggtcttcgccggcgccccagacagatgtcccccaacctgcctcttcgtcggtggcatggcagaactcggagtattcttctcaatcctccaagacatgcgaaacaccataatggcaagcaaaaccgtgggaaccgccgacgaaaaactcagaaagaaatcctccttctaccaatcctacctccgccgaacccaatcaatggggatccaactcgaccaacgaatcatcgtcatgttcatggtcgcatggggcaaagaagcagtagacaacttccacctcggcgacgacatggacccagaactccgcagcctcgcccaaatcctcatcgaccaaaaagtcaaagaaatcagcaaccaagaacccatgaaactctaa

SEQ ID NO: 7989 - RNA, 1290 nt, synthetic construct
  misc_feature 1..1290: note = derived and/or modified CDS sequence (opt11) from SEOV(IR162)__KX079476.1__N
  source 1..1290: mol_type = other RNA
atggccacaatggaagaaatacaaagagaaatctccgcacacgaaggacagctagtcatagcccgccaaaaagtcaaagacgcagaaaaacaatacgaaaaagatccagacgacctaaataagcgcgccctccacgaccgtgaatccgtcgccgcctcaatacagtccaaaatcgacgaacttaaacgccaactcgctgaccgaatcgccgccggcaaaaacataggacaggaccgcgaccccaccggcgtcgagcccggagaccacctcaaagaacgctccgccctctcctacggaaataccctcgacctaaacagcctcgacatcgacgaacccaccggccaaaccgcagactggctcacaatcatcgtctacctcacctcattcgtcgtccccatcatcctaaaagccctctacatgcttaccacccgcggccgccaaaccagcaaagacaacaaaggaatgagaatcagattcaaagacgactcaagctacgaagacgtcaacggcatacgcaaacccaaacacctctacgtatccatgcccaacgcacaaagctccatgaaagcagaagaaatcacacccggcagattccgcacagccgtatgcggcctgtaccccgcccaaatcaaagcccgcaacatggtctcccccgtaatgtcagtagtaggcttcctagccctcgcaaaagactggacctcccgaatcgaagaatggctcgacacaccctgcaaattcatggtcgaatcccccatcgccggctccctctccggaaatcccgtcaaccgagactacatccgccaacgccaaggcgcactagcaggcatggaacccaaagagttccaagccctccgacaacactcaaaagacgccggatgcaccctcgtagaacacatagaatcccccagcagcatctgggtattcgcaggcgccccagaccgatgcccacccacatgcctattcgtcggaggcatggccgaactcggcgccttcttctccatcctccaagacatgcgaaacaccatcatggccagcaaaaccgtaggcaccgccgacgaaaaacttcgcaagaaaagcagcttctaccagtcctacctacgccgcacccagagcatgggcatccaactcgaccaacgcatcatcgtcatgttcatggtagcatggggcaaagaagcagtcgacaacttccacctcggcgacgacatggaccccgaactaagatcactagcccagatcctaatagaccaaaaagtcaaagaaatttccaaccaggaaccaatgaaattataa

SEQ ID NO: 7990 - RNA, 1290 nt, synthetic construct
  misc_feature 1..1290: note = derived and/or modified CDS sequence (opt11) from SEOV(Gou3)__AF184988.1__N
  source 1..1290: mol_type = other RNA
atggccacaatggaagaaatccaacgcgaaatctcagcgcacgaaggacaactcgtcatagcacgccgcaaagtaaaagacgccgaaaaacaatacgaaaaagaccccgacgatcttaacaaaagagccctgcacgaccgcgaaagcgtcgctgccagcatccaatccaaaatcgacgaactcaaacgccaactcgcagaccgcatcgcagccggcaagaacatcggccaagaccgagaccccaccggagtcgaaccgggcgaccacctcaaagaacgctccgccctaagctacgggaacaccctcgacctcaactcactcgacatcgacgaacccaccggccagaccgccgactggctaaccatcatcgtctacctcaccagcttcgtagtcccaatcatactaaaagcactctacatgctcacaacaagaggacgacaaaccagcaaggacaataaaggcatgcgtatacgcttcaaagacgactcatcatacgaagacgtaaacggaatacgaaaaccgaaacacctctacgtctccatgccaaacgcccaaagctccatgaaagcagaagaaatcacgcccggacgcttccgcacggccgtgtgcggcctataccccgcccaaatcaaagcccgcaacatggtatccccagtcatgagcgtagtcggcttcctcgccctcgccaaagactggacctcacgcatcgaagactggcttggcgcaccatgcaaattcatggcagaaagccccatagccggcagcctctccggcaacccagtcaatcgagactacatcagacaacgacaaggcgcactcgccggcatggaacccaaagagttccaagcactccgccaacactccaaggacgccggatgcacactcgtcgaacacatcgaaagccctagctccatctgggtattcgccggagccccagaccgatgcccacccacatgcctcttcgtcggcggcatggcagaactcggcgccttcttcttcatcctacaagacatgcgaaacaccatcatggcatccaaaaccgtcggaaccgccgacgaaaaactcagaaagaaatccagcttctaccaatcctaccttcgccgcacccaaagcatgggcatacaactagaccagcgaataatcgtcatgttcatggtcgcctggggcaaagaagcagtggacaacttccacctaggagacgacatggacccagaactgcgctcactcgcccaaatcctcatagaccaaaaagtaaaagaaatctccaaccaagaacccatgaaactataa

SEQ ID NO: 7991 - RNA, 1290 nt, synthetic construct
  misc_feature 1..1290: note = derived and/or modified CDS sequence (opt11) from SEOV(Gou3-v9)__AF288651.1__N
  source 1..1290: mol_type = other RNA
atggccacaaaagaagaaatccaacgagaaatcagcgcccacgaaggccaactcgtaatcgcccgacaaaaagtcaaagacgccgaaaaacaatacgagaaagaccccgacgtcctaaacaaacgagcccttcacgacagagaaagcgtcgccgcaagcatccaatccaaaatcgacgaactgaaacgccaactggcagaccgcatcgcagccggcaaaagcataggccaagaccgagacccgacaggcgtagaaccaggcgaccacctgaaagaacgcagcgccctaagctatggcaacaccctagacctaaactcactagacatcgacgaacctaccggccaaaccgcagactggctcacgatcatcgtctacctaacctccttcgtagtccccatcatccttaaagcactctacatgctaaccacacgaggccgccaaacctccaaagacaaccgcggaatgcgaatcaggttcaaagacgactcctcatacgaggacgtaaacggcatcagaaaacccaaacacctctacgtctcgatgcccaacgcccagtcctccatgaaagccgaagaaatcacaccaggccgcttccgtaccgccgtatgcgggctgtaccccgcccaaatcaaagcccgaaacatggtgagtccagtcatgtccgtagtcggcttcctagccctagccaaagactggacctcccgaatcgaagactggctcggcgcaccctgcaaattcatggccgaatccccaatcgcaggatcactcagcggcaaccccgtcaaccgtgactacatacgacaacgacaaggcgccctagcaggcatggagcccaaagagttccaagccctcaggcagcactcaaaagacgccggatgcacactcgtcgaacacatcgaatcacctagctccatctgggtcttcgccggcgcccccgaccgctgcccaccaacctgcctgttcgtaggcggcatggctgaactaggcgcattcttctccatcctccaagacatgagaaacaccattatggcaagcaaaaccgtcggaaccgcagacgaaaaactacgtaagaaatcatcattctaccaatcgtacctacgccgcactcaatcaatgggaatccaactcgaccaacgcatcatcgtcatgtttatggtagcatggggcaaagaagccgtcgacaacttccacctaggggacgacatggaccccgaactccgctccctcgcccaaatcctaatcgaccaaaaagtaaaagaaatctccaaccaagaacccatgaaactataa

SEQ ID NO: 7992 - RNA, 1290 nt, synthetic construct
  misc_feature 1..1290: note = derived and/or modified CDS sequence (opt11) from SEOV(IR461)__AF329388.1__N
  source 1..1290: mol_type = other RNA
atggcaaccatggaagaaatccaacgggaaatctccgcccatgaagggcaactcgtcatcgcaagacaaaaagtcaaagacgccgaaaaacaatacgaaaaagaccccgacgacctaaacaaacgcgccctccacgaccgagaatccgtagccgcatcaatacaatccaaaatcgacgaactcaaacgacaactcgccgacagaatagcggccggcaaaaacataggccaagaccgcgacccaacaggcgtcgaaccaggagaccacctcaaagaacgcagcgcactctcctacgggaacacactcgacctgaactcactagacatagacgaaccaacgggccagaccgcagactggctcaccataatcgtatatctaaccagcttcgtcgtcccaatcatactaaaggccctctacatgctaacaacacgcggccgccaaacatccaaagacaacaaaggaatccgcatcagattcaaagacgacagcagctacgaaaacgtcaacggcatacgtaaacccaaacacctctacgtctcaatgccaaacgcacaatccagcatgaaagcagaagaaataacccccggacgattccgcaccgccgtctgcggcctataccccgcccaaatcaaagccggcaacatggtctcccccgtcatgtcggtcgtcggcttcctagcattagccaaagactggaccagccgcatcgaagaatggctcgacacaccctgcaagttcatggtcgagtcccccatcgccggctccctctccggcaaccccgtaaaccgagactacatccgccaaaggcaaggcgccctcgccggcatggaacccaaagagttccaagcgctccgccaacacagcaaggacgccggctgcaccctcgttgaacacatcgaatcaccatcctccatctgggttttcgccggagccccagaccgatgcccaccaacctgcctattcgtaggaggcatggccgaactaggcgccttcttctccatcctacaagacatgcgaaacacaattatggcatctaaaacggtcggcaccgcagacgagaaactccgcaagaaaagctccttctaccaatcctacctacgacgcacccaatccatgggaatacaacttgaccaacgaatcatcgtcatgttcatggtcgcgtggggaaaagaagccgtcgacaacttccacctaggcgacgacatggaccccgaactccgcagcctagcgcaaatactcatcgaccaaaaagtcaaagaaatatccaaccaagagcccatgaaactttga

SEQ ID NO: 7993 - RNA, 1290 nt, synthetic construct
  misc_feature 1..1290: note = derived and/or modified CDS sequence (opt11) from SEOV(JUN5-14)__DQ217791.1__N
  source 1..1290: mol_type = other RNA
atggccaccatggaagagttccaacgcgaaatatcggcccacgaaggccaactcgtcatagccagacaaaaagtcaaagacgccgaaaaacaatacgagaaagaccccgacgacctcaacaaacgcgctctccacgacagagaatccgtcgccgcaagcatccaatccaaaatagatgaacttaagcgccaactcgccgaccgaatagcagccggcaaaaacatcggacaagaccgcgacccaacaggcgtagaaccaggagaccacctcaaagaacgaagcgccctcagctacggaaacaccctcgacctcaactccctagacatcgacgaacccaccggacaaacggccgactggctgaccatcatcgtatacctcacctcattcgtcgtccccataatcctaaaagccctatacatgctaaccacccgaggccgacaaaccagcaaagacaacaaaggcatgcgaatcaggttcaaagacgacagctcctacgaggacgtcaatggcatccgaaaacccaaacacctatacgtatcaatgcccaacgcccaatcgagcatgaaagcagaagaaatcacaccaggcagattccgaaccgccgtatgcggcctctacccagcccaaatcaaagcccggaacatggtcagcccggtcatgagcgtcgtcggattcctcgcactggccaaagactggacctcaagaatcgaagaatggctcggcgcaccatgcaagttcatggccgaatcacccatcgcaggctcactcagcggaaacccagtcaaccgcgactacatcagacaacgccaaggagccctagccggcatggagcccaaagagttccaagccctccgccaacacgcaaaagacgcaggctgcacactcgtcgaacacatagagagtccaagcagcatctgggtcttcgccggagcccccgacagatgcccaccaacctgcctattcgtaggcggcatggccgaactcggcgccttcttctccatcctgcaagacatgcgcaacaccatcatggccagcaaaaccgtaggcaccgcagacgaaaaactccgaaagaaaagcagcttctaccaaagctaccttcgccgcacacagtccatgggcatccaactagaccaacgcatcatagtcatgttcatggtagcatggggtaaggaagcagtagacaacttccacctaggcgacgacatggaccccgaactccgctcgctcgcacaaatcctaatagaccaaaaagtaaaagaaatctccaaccaagaaccgatgaaactctaa

SEQ ID NO: 7994 - RNA, 1290 nt, synthetic construct
  misc_feature 1..1290: note = derived and/or modified CDS sequence (opt11) from SEOV(L99)__AF488708.1__N
  source 1..1290: mol_type = other RNA
atggcaacaatggaagaaatccaacgcgaaatcagcgcacacgaaggccaactggtcatagcccggcaaaaagtaaaagacgcagaaaaacaatacgaaaaagaccccgacgacctcaacaaaaggaccctacacgaccgcgaaagcgtcgccgccagcatacaatccaaaatcgacgaactcaaacgacaactcgccgacaggatcgctgccggaaagaacatcggtcaagaccgagaccccaccggcgtcgaaccaggtgaccacctcaaagaacgcagcgccctcagctacggcaacaccctggacctcaactcactagacatagacgaacccacaggccaaacagccgactggctcaccatcatagtatacctaacctcattcgtcgtaccgatcattctaaaagccctctacatgctaacaacccgaggacgccaaaccagcaaagacaacaaaggcatgcgcatcagattcaaagacgactcaagctacgaggacgtaaacggcatacggaaacccaaacacctatacgtgtcaatgcccaacgcccagtcaagcatgaaagccgaagaaatcacccccggacgctttcggacagccgtctgcggcctctacccagcacaaatcaaagcacgaaacatggtcagcccagtcatgagcgtagtaggcttcctcgcactagcaaaagactggacatccagaatagaagaatggctaggagccccatgcaaattcatggccgaatcgcccatcgccggatccctcagcggtaaccccgtcaaccgcgactacatccgacagcgacaaggagccctagcaggcatggaaccaaaagagttccaggccctaagacaacacgccaaagacgccggctgcaccctcgtggaacacatcgaaagcccctcctccatttgggtcttcgcaggcgcccccgaccgatgcccacctacctgccttttcgtcggcggaatggcagaactcggcgcattcttcagcatactccaagacatgcggaacaccatcatggccagcaaaacagtcggcacagcagacgaaaagctcagaaagaaatccagcttctaccaatcctacctacgacgaacacaaagcatgggcatacaactcgaccaacgaataatcgtaatgttcatggtcgcctggggcaaagaagcagtcgacaacttccacctaggcgatgacatggaccccgaactccgctccctcgcccaaatactcatcgaccaaaaagtgaaagaaatctccaaccaagaaccaatgaaactctaa

SEQ ID NO: 7995 - RNA, 1290 nt, synthetic construct
  misc_feature 1..1290: note = derived and/or modified CDS sequence (opt11) from SEOV(R22)__AF488707.1__N
  source 1..1290: mol_type = other RNA
atggcaacgatggaagaaatacaacgcgaaataagcgcccacgaaggccagctagtcatcgcccgccaaaaagtaaaagacgcagagaaacaatacgaaaaagaccccgacgacctaaacaaacgtgcactccacgaccgagaatctgtagcagcctcaatccaatccaagatcgacgaactcaaaagacaactcgcagaccgaatcgccgcaggtaaaaacatcggacaagaccgcgacccaaccggagtcgaaccaggagaccacctcaaagaacgctcagcactatcctacggaaacaccctcgacctaaacagcctcgacatagacgagccaaccggccaaaccgccgattggctaaccataatcgtatacctcacctccttcgtagtccccattatactaaaagcactatacatgctaactacccgaggccgacaaacatccaaagacaacaaaggaatgcgcattcgcttcaaagacgactctagctacgaagacgtcaacggcatccgcaaacccaaacacctctacgtcagcatgcccaacgcacaatcctcaatgaaagccgaagaaatcacacccggccgattcagaaccgctgtctgcggcctataccccgcccaaataaaagcccgcaacatggtaagccccgtcatgtccgtggtcggattcctagcgctcgcaaaagactggaccagccgaatagaggaatggctaggcgctccctgcaaattcatggccgaatcccccatcgccggatccctctccggcaacccagtcaaccgcgactacatcagacaacgacaaggcgccctagccgggatggaacccaaagagttccaagcactcagacaacacgccaaagacgcaggatgcacgctcgtcgagcacatcgaatccccaagcagcatatgggtattcgcaggagcaccagaccgctgcccaccaacctgcctcttcgtcggccgcatggctgaactaggcgccttcttctccatcctccaagacatgaaaaacaccataatggcatcaaaaaccgtcggcaccgccgacgaaaaactccgtaagaaatcctccttctaccagagctacctacgccgcacacaatccatgggcatacaactagaccaacgcatcatcgtcatgttcatggtcgcatggggaaaagaagcggtagacaacttccacctcggagacgacatggaccccgaactcagatccctagcccaaatactcatagaccaaaaagtaaaagaaatctccaaccaagaacccatgaaactctaa

SEQ ID NO: 7996 - RNA, 1290 nt, synthetic construct
  misc_feature 1..1290: note = derived and/or modified CDS sequence (opt11) from SEOV(TURCKHEIM/Hu/FRA/2016/2016.00044)__KX064270.1__N
  source 1..1290: mol_type = other RNA
atggccacaatggaggaaatccaacgcgaaatctcagcccacgaaggccaactcgtcatcgcacggcaaaaagtaaaagacgccgaaaaacaatacgaaaaagacccagacgacctaaacaaaagagcactacacgaccgcgaaagcgtcgcagcatccatccaatcaaaaatagacgaactcaaacgacaactcgccgaccgcatagctgcaggaaaaaacatcggacaagaccgagaccccacaggcgtcgaaccaggcgaccacctgaaagaacgctccgccctcagctacggaaacactctcgacctcaactcactcgacatcgacgaacccacaggacagaccgccgactggctcaccatcatcgtctacctaaccagcttcgtagtccccataatcctcaaagcactctacatgctcaccacaagaggccgccaaacatccaaagacaacaaaggaatgagaatccgattcaaagacgactcctcatacgaagacgtaaacggcatccggaaaccaaaacacctctacgtctcgatgcccaacgcccaatcctcaatgaaagcagaagaaataacgccaggcagattccgcaccgcagtgtgcgggctctaccccgcacaaataaaagcccgcaacatggtctccccagtcatgagcgtagtaggtttcctcgcgctcgcaaaagactggacatccagaatcgaagaatggctggacgcaccatgcaaattcattgcagaatccccaatcgcaggctccctcagcggaaacccagtcaaccgagactacatccgccaacgacagggagcactcgcgggaatggaaccaaaagaattccaagcactccgccaacactccaaagacgcaggctgcacgctagtagaacacatcgaatccccctcctcgatctgggtcttcgcaggagcccccgaccgctgtccaccaacgtgcctattcgtaggcggaatggcagaactgggcgccttcttcagcatactacaagacatgcgaaacacgatcatggccagcaaaaccgtaggaaccgccgacgaaaaactacgaaaaaaaagttcattctaccaatcttacctacgacgcacccaaagcatgggcatccaacttgaccaacgaataatcgtcatgtttatggtcgcctggggcaaagaagccgtcgacaacttccacctcggcgacgacatggaccccgaactacgctccctagcccaaatcctcatcgaccaaaaagtaaaagaaatctccaaccaagaacccatgaaactctaa

SEQ ID NO: 7997 - RNA, 1290 nt, synthetic construct
  misc_feature 1..1290: note = derived and/or modified CDS sequence (opt11) from SEOV(Z37)__AF187082.1__N
  source 1..1290: mol_type = other RNA
atggccacaatggaagaaatacaaagagaaatcagcgcccacgaaggccaactcgtaatcgccagacagaaagtaaaagacgccgaaaaacagtacgaaaaagacccagacgacttcaacaaacgagccctccacgaccgcgaaagcgtcgcggcaagcatccaatcgaaaatcgacgaactaaaacgccaactcgcagacagaatagcagccggcaaaaacatcggacaagaccgcgacccaacaggcgtcgaaccaggcgaccaccttaaagaacgatccgccctcagttatggcaataccctggacctaaactccctagacatcgacgaaccgaccggacagacagccgactggctcacaatcatcgtctacctcacctccttcgtcgtccccatcatactcaaagcactatacatgctcaccaccaggggcagacaaacaagcaaagacaacaaaggcatgagaatacgcttcaaagacgactcatcatacgaagacgtaaacggcattcgcaaaccgaaacatctttacgtcagcatgcccaacgcacaatccagcatgaaagccgaagaaatcacccccggacgattccgcaccgccgtgtgcggcctataccccgcgcaaataaaagcccgcaacatggtgtctcccgtcatgtcagtcgtaggcttcctcgcactcgcaaaagactggaccagtcgcatagaagaatggctaggcgccccatgcaaattcatggccgaatcccccatcgccggaagcctatccggaaacccagtaaaccgagactacatccgccaacgccaaggcgccctcgcaggcatggaaccaaaagagttccaagccctacgccaacacgcgaaagacgccggctgcaccctggtcgaacacatcgaaagcccatccagcatatgggtcttcgccggcgcacccgacagatgcccacccacatgcctcttcgtgggaggaatggcagaactcggcgccttcttcagcatcctccaagacatgcgcaacacaatcatggccagcaaaaccgttggaacagcagacgaaaaactacgcaagaaaagctccttctaccaatcgtacctacgaagaacacaaagcatgggaatacaactcgaccaacgcatcatcggcatgttcatggtagcctggggcaaagaagccgtcgacaacttccacttaggcgacgacatggaccccgaactccgctccctcgcccaaatattaatcgaccaaaaagtcaaagaaatctccaaccaagaaccaatgaaactataa

SEQ ID NO: 7998 - RNA, 1290 nt, synthetic construct
  misc_feature 1..1290: note = derived and/or modified CDS sequence (opt11) from SEOV(Tchoupitoulas (TCH))__AF329389.1__N
  source 1..1290: mol_type = other RNA
atggccaccatggaagaaatccagagggaaatctccgcccacgaagggcaactcgtcatcgcccgacaaaaagtaaaagacgccgaaaagcaatacgaaaaagacccggacgacttctacaagagggccctacacgatcgcgaatccgtcgccgcgagcatccaatcaaaaatagacgaactcaaacgccaactcgcagaccgcatcgcagccggcaaaaacataggacaagaccgagaccccaccggagtcgaaccaggcgaccacctaaaagaacgaagcgccctctcctacggcaataccctcgacctcaactcactcgacatagacgaaccaacaggccaaaccgccgactggctaaccataatcgtctacctcacctcattcgtagtcccgatcatactcaaagccctatacatgctcaccacccgcggccgacaaaccagcaaagacaacaaaggcatgcgaatacgcttcaaagacgactcctcatacgaagacgtcaacggcatccgaaaacccaaacacctctacgtctcaatgcccaacgcgcaatctagcatgaaagccgaagaaataacacccggccgcttcagaaccgcagtctgcggcctatatcctgcccaaattaaagcccgcaacatggtcagcccagtcatgagcgtcgtcggattcctcgccctcgccaaagactggacctcacgcatcgaagaatggctaggagcaccatgcaaattcatggccgaatcccccatcgcaggctccctgtccggcaaccccgtcaaccgcgactacatacgccaacgccaaggcgccctcgcaggcatggaaccaaaagagttccaagcactccgccaacactcaaaagacgccggatgcaccctcgtggaacacatagaatccccgtcatccatctgggtcttcgccggtgccccagaccggtgcccacccacttgcctattcgtcggcggaatggcagaactcggcgcattcttcagcatactccaggacatgcgcaacaccatcatggccagcaaaaccgtcggcacagccgacgaaaaactccgcaagaaaagctccttctaccaatcctacctacgacgcacccaaagcatgggaatacagctcgaccagcgaatcatagtcatgttcatggtcgcctggggcaaagaagccgtcgacaactttcacctcggagacgacatggaccccgaactccgctcgctcgcacaaatcctaatagaccaaaaagtcaaagaaatctccaaccaggaaccaatgaaactctaa

SEQ ID NO: 7999 - RNA, 1290 nt, synthetic construct
  misc_feature 1..1290: note = derived and/or modified CDS sequence (opt11) from SEOV__M34881.1__N
  source 1..1290: mol_type = other RNA
atggcaactatggaagaaatccaaagagaaataagcgcccacgaaggacaactcgtaatcgcccgacagaaagtaaaggacgcagaaaaacaatacgaaaaagatcccgacgacctaaacaaaagagcactccacgaccgggaaagcgtcgcagcctcgatacaaagcaaaatcgacgaactcaaacgccaactagccgacagactccaacaagggcgcacctcaggccaagaccgagaccccacaggcgtcgaaccaggcgaccacctaaaagaaagatccgccctctcgtacggcaacaccctagacctcaactcacttgacatagacgaacccacaggacaaaccgccgactggctaaccatcatcgtctacctcacctccttcgtcgtccccatcatactcaaagccctatatatgctaacaacccgcggccgccaaacctccaaagacaacaaaggcatgaggatcagattcaaagacgacagctcctacgaagacgtcaacggcatccgcaaaccaaaacatctctacgtctccatgcccaacgcacagtcgagcatgaaagccgaagaaatcacgcccggacgattccgaaccgcagtctgcggcctataccccgcacaaatcaaagcacgcaacatggtaagccccgtcatgtcagtagtcggcttcctagccctggccaaagactggacctcacgcatagaagaatggctaggcgccccctgcaaattcatggcagaatccctcatcgccggcagcctatcaggcaacccggttaaccgcgactacatccgccaacgacaaggagcactagccggaatggaaccaaaagagttccaagcactacggcaacactccaaagacgccggctgcaccctcgtcgaacacatcgaatccccctcctccatctgggtcttcgcaggcgctcctgaccgatgcccaccaacgtgcctgttcgtcggtggaatggccgaactgggagccttcttctccatcctccaagacatgcgcaacaccataatggccagcaaaaccgtaggaaccgccgacgaaaaactacgcaagaaatctagcttctaccaatcctacctgcgccgcacacaaagcatgggaatccaactagaccaacgcatcatcgtcatgttcatggtcgcctggggcaaagaagcagtcgacaacttccacctcggagacgacatggaccccgaactccgctcactagcgcaaatcctcatcgaccaaaaagtcaaagaaatctcaaaccaagaacccatgaaactctaa

SEQ ID NO: 8000 - RNA, 1287 nt, synthetic construct
  misc_feature 1..1287: note = derived and/or modified CDS sequence (opt11) from SNV(H10)__NC_005216.1__N
  source 1..1287: mol_type = other RNA
atgagcaccctcaaagaggtacaagacaacatcaccctgcacgaacaacaactcgtcaccgcccgccaaaaactcaaagacgcagagcgcgccgtagaactcgaccctgacgacgtcaacaaatccaccctccaatcccgacgcgccgccgtcagcgcactcgaaaccaaactaggcgaactcaaacgcgaactagcagacctcatcgcagctcaaaaactcgcctcaaaacccgtcgaccccaccggcatcgaacccgacgaccatctcaaagaaaaatcctcactcagatacggcaacgtcctcgacgtcaactccatcgacctcgaagaaccatccggccaaacagccgactggaaatctatcggcctctacatcctctcttttgcccttccaatcatcctcaaagccctctacatgctaagcacgcgaggccgacaaaccatcaaagaaaataaaggcacccgcatccgcttcaaggacgactcttcctatgaagaagtaaacggcatccgcaaacccagacacctgtacgtatccatgcccacagcccaatccacaatgaaagccgacgaaatcacccccggacgattccgcaccatcgcctgcggcctcttcccagcccaagtcaaagcccgaaacataatctccccagtaatgggagtaatcggtttctccttcttcgtcaaagactggatggaacgcatagatgacttcctcgccgccaggtgtccattcctccccgaacaaaaagacccacgcgacgccgcactagccacaaaccgcgcatacttcatcacacgacaactccaggtagacgaatcaaaggtctctgacatcgaggacctgatcgcagacgccagagcagaatccgccacaatctttgctgacatcgccacgccccactccgtctgggtcttcgcatgcgcccccgaccgctgcccacccaccgccctctacgtagccggcatgccagaactgggagccttcttcgccatcctccaagacatgcgcaacaccataatggcctccaaatccgtaggcacctcagaagagaaactcaaaaagaaatccgcattctaccagtcctacctacgccgtactcaatcaatgggaatccaactcgaccagaaaatcatcatcctctacatgtcacactggggccgcgaagcagtcaaccacttccaccttggcgacgacatggaccccgaacttcgagaactcgcgcaaaccctcgtcgacataaaagtacgagaaatcagcaaccaagaaccactaaaactctag

SEQ ID NO: 8001 - RNA, 1287 nt, synthetic construct
  misc_feature 1..1287: note = derived and/or modified CDS sequence (opt11) from SNV(2)__JQ690282.1__N
  source 1..1287: mol_type = other RNA
atgagcacactcaaagaagtccaagacaacatcacactccacgaacaacaactcgtaaccgcacgacaaaaactcaaagatgccgaacgcgccgtcgaacttgaccccgacgacgtaaacaaatcaaccctacaaagcagacgagcagcagtctccgccctcgaaaccaaactcggcgaactaaaacgtgaactagcagacctcatcgccgcacaaaaactagcctccaaaccagtcgacccaaccggcatcgaacccgacgaccacctcaaagaaaaatcctctctacgctacggaaacgtactcgacgttaactccatagacctagaagaaccctcagggcaaaccgccgactggaaatccatcggactctacatcctctctttcgccctaccaatcatcctaaaagcactatacatgctcagcacccgcggccgacaaaccatcaaagaaaacaaaggaacacgaatccgcttcaaagacgactcatcctacgaagaagtaaacggcatcagaaaaccccgacacctatacgtgtccatgcccaccgcccaaagcaccatgaaagccgacgagataacacccggcagattccgaaccatcgcctgcggcctcttccccgcccaagtaaaagcccgaaacattatctcacccgtcatgggcgtcataggattcagcttcttcgtcaaagactggatggaacgcatagacgactttctcgcagccagatgcccattcctcccagaacaaaaagacccgcgagacgccgcactcgccaccaaccgagcctacttcatcacacgacaaatgcaggtcgacgaaagcaaggtctccgacatcgaagacctaatagccgacgccagagccgaatccgcgacaatctttgccgacatcgccacaccccactccgtatgggtcttcgcctgcgcacccgaccgctgcccgcccaccgccctctacgtcgccgggatgcctgaactaggtgcgttcttcgccatccttcaagacatgcgcaacaccatcatggcctccaaatcagtaggcacctccgaagaaaaactcaaaaagaaatctgccttctaccaatcatacctaagacgaacccaaagcatgggcattcaactcgaccagaaaataatcatactctacatgtcacactggggccgagaagccgtcaaccactttcacctcggagacgacatggacccagaactccgcgaactcgcacaaacactcgtagacataaaagtacgggaaatatccaaccaagaacccctaaaactctag

SEQ ID NO: 8002 - RNA, 1287 nt, synthetic construct
  misc_feature 1..1287: note = derived and/or modified CDS sequence (opt11) from SNV(3)__JQ690278.1__N
  source 1..1287: mol_type = other RNA
atgtcaaccctaaaagaagtccaagacaacataactctccatgaacaacaactcgtcaccgcaagacaaaaactcaaagacgccgaacgcgctgtcgaactcgaccccgacgacgtcaacaaatcaacactacaatctcgccgcgccgccgtatccgccctcgaaaccaaactcggcgaactcaaacgcgaactcgccgacctcatcgcagcccaaaaactagcatccaaaccagtcgaccctaccggcatagaaccagacgaccacctcaaagaaaaatcctccctccgctacggcaacgtcctcgacgtcaactccatcgacctagaagaaccatccggacaaaccgcagactggaaatcgataggcctatacatattatccttcgccctacccatcatactcaaagccctatacatgctctccacacgcggccgccaaaccatcaaagaaaacaaaggcacccgaatccgattcaaagacgactcctcatacgaggaagtaaacggcatccgaaaacctcgccacctctacgtcagcatgcccacagcccaatccacaatgaaagccgacgaaataaccccaggccgcttccgcacaatagcctgcggcctctttccagctcaagtcaaagcacgcaacatcatctcacccgtcatgggtgtcatcggcttctccttcttcgtaaaagactggatggaacgcatagacgacttcctagccgcccgctgtcccttcctacccgaacaaaaagacccccgcgacgctgccctcgcaacaaacagagcatacttcatcacccgacaactccaagtcgacgaatccaaagtctccgacatagaagacctaatagccgacgcccgcgcagaaagcgccaccatcttcgccgacatcgccaccccacacagcgtctgggtcttcgcctgcgcccccgaccgatgtccacccaccgccctatacgtagccggtatgcccgaactgggcgccttcttcgccatactccaagacatgcgcaacacaatcatggcctccaaatccgtcggcacatcagaagaaaagctcaaaaagaaatccgccttctaccaatcatacctcagacgcacccaaagcatgggaatccaacccgaccagaaaatcatcatcctatacatgagccactggggacgagaagcagtaaaccacttccacctaggggacgacatggaccccgaactccgagaactagcccaaacactcgtagacatcaaagtccgcgagatctccaaccaagaaccactcaaactataa

SEQ ID NO: 8003 - RNA, 1287 nt, synthetic construct
  misc_feature 1..1287: note = derived and/or modified CDS sequence (opt11) from SNV(CC107/POR)__KT885046.1__N
  source 1..1287: mol_type = other RNA
atgtcaaccctcaaagaagtccaagacaacataaccctccacgaacaacaactcgtcaccactcgccaaaaactaaaagacgccgagcgagcagtcgaactcgaccccgacgacgtaaacaaaagcacgctccaatcccggcgcgcagccgtctcagcccttgaaacaaagctcggtgaactaaaacgagaactagcagacctcatcgcagcccaaaaactagcctccaaaccagtggacccaaccggaatagaacccgacgaccacctcaaagaaaaatcctccctccgctacggcaacgtactcgatgtcaactccatcgacctagaagaaccatccggccaaaccgccgactggaaaagcatcggcctctacatcctctccttcgcactaccaataatcctcaaagccctctacatgctctccacacgaggacgccaaacaatcaaagaaaacaaaggcacccgcatccgcttcaaagacgactccagctacgaagaagtaaacggcatacgaaaaccccgccacctctacgtctccatgccaacagcccaatccacaatgaaagccgacgaaattaccccaggacgcttccgcacaatcgcatgcggcctcttccccgcccaagtcaaagcccgaaacatcatatcgcccgtcatgggagtaatcggcttcagctttttcgtcaaagactggatggaacggatcgacgagttcctcgccgcccgctgccccttcctccccgaacaaaaagacccccgagacgccgcccttgccactaaccgcgcttacttcatcacacgccaaatgcaagtagacgaatccaaagtaagcgacatcgaagacctcatcgcagacgcacgagccgaatcagccacaatcttcgcagacatagccaccccacactccgtatgggtattcgcctgcgcccccgaccgctgcccacccacagccctctacgtagccggaatgcccgaactgggcgcattcttcgccatcctacaagacatgcgaaacaccatcatggcctcaaaatccgtaggcacctcagaagaaaaactcaaaaagaaatccgccttctaccaatcatacctccgccgtacccaaagcatgggcatacaactcgaccagaaaataatcatcctctacatgagccactggggacgcgaagcagtcaaccacttccaccttggcgacgacatggacccagaacttcgtgagctcgcccaaaccctcgtagacataaaagtacgtgaaatctccaatcaagaacctctcaaactctaa

SEQ ID NO: 8004 - RNA, 1287 nt, synthetic construct
  misc_feature 1..1287: note = derived and/or modified CDS sequence (opt11) from HPS(Convict Creek 107)__L33683.1__N
  source 1..1287: mol_type = other RNA
atgtccacactcaaagaagtccaagacaacatcacccttcacgagcaacaactcgtcaccactcgacaaaaacttaaagacgccgaacgcgccgtcgaactcgaccccgacgacgtaaacaaaagcacactccaatcccgacgcgcagccgtcagcgccctcgaaaccaaactcggcgaactcaaacgcgaactcgcggatctcatagcggcccaaaaactcgccagcaaacccgtcgacccaaccggcatcgaaccagacgaccatctcaaggaaaaatcatccctccgatacggcaacgtactcgacgtcaactcaatcgacctcgaggagccctccggacaaaccgccgactggaagtctatcggactctacatactctccttcgcactacccatcatcctcaaagccctatacatgctatccacccgcgggcggcaaacaatcaaagaaaacaaaggcacccgaatccgcttcaaagacgactcctcctacgaagaagtcaatggaatccgaaaaccccgacatctctacgtcagcatgccaaccgcccaatcaaccatgaaagcagacgaaataacacccggacgattccgaaccatagcctgcggcctattccccgcccaagtcaaagcccgaaacatcatctcccccgtcatgggcgtcatcggattctccttcttcgtaaaagactggatggaacgcatcgacgagttcctcgccgcccgctgcccattcctacctgaacaaaaagacccacgagacgccgccctcgccaccaaccgagcctacttcataacccgccaaatgcaagtcgacgaatccaaagtcagcgacatcgaagacctgatagccgacgccagagctgaatcagccaccatcttcgccgacatcgccaccccacactcagtatgggtcttcgcctgcgcacccgaccgctgcccacccacagcactctacgtcgcaggaatgcccgaactcggcgccttcttcggcatacttcaagacatgcgaaacacaataatggccagcaaatccgtaggaacctccgaagaaaaactcaagaagaaatcagccttctaccaatcctacctccgacgaacccaaagtatgggaatccaactcgaccagaaaatcatcatcctctacatgtcccactggggacgagaagccgtcaaccacttccacctcggcgacgatatggaccccgaactccgagaactagcccaaaccctcgtagacatcaaagtccgtgaaatatccaaccaagaaccactaaaactctaa

SEQ ID NO: 8005 - RNA, 1287 nt, synthetic construct
  misc_feature 1..1287: note = derived and/or modified CDS sequence (opt11) from HPS(Convict Creek 74)__L33816.1__N
  source 1..1287: mol_type = other RNA
atgagtacgctcaaagaagtacaagacaacatcaccctacacgaacaacaactcgtcacctccagacaaaaactcaaagacgctgaacgcgccgtcgaactagaccccgacgacgtcaacaagtcaacgctccaatcccgccgagccgccgtcagcgcactcgaaaccaaattaggcgaacttaaacgagaactagcagaccatatcgccgcccaaaaactagcatcaaaacccgtagaccccacagggatagaacccgacgaccacctcaaggaaaaatcctccttacgatacggcaacgtcctcgacgtcaactccatagacctcgaagaacccaacggccaaaccgcagactggaaatccataggactctatatcctctcattcgccctacccatcatccttaaagcactctacatgctctccacacgcggccgccaaaccatcaaagaaaacaaaggcacacgcatacgcttcaaagacgacagcagctacgaagaagtcaacggcatccgaaaaccccgacacctctatgtatccatgccaacagcccaatccacaatgaaagccgacgaaataacacccggccgcttccgcaccatagcctgcggtctcttccccgcccaagtcaaagcaagaaacataatcagccccgtcatgggcgtcatcggcttctccttcttcgtcaaagactggatggaacgcatcgacgagttcctcgccgctcgctgccctttcctacccgaacaaaaagacccccgagacgccgccctcgccaccaaccgcgcctacttcatcacccgacaactccaagtcgacgaatcaaaagtatccgacatcgaggacctcatcgctgacgcccgcgccgaatccgccaccatattcgcagacatcgcaacaccccactccgtctgggtcttcgcctgcgcccccgaccgatgcccacccaccgccctctacgttgccggcatgcccgaactcggcgccttcttcggcatcctccaagacatgcgaaacaccataatggcctccaaatccgtcggcacctccgaagaaaaactcaagaagaaatccgcattctaccaatcctacctccgccgcacccaatccatgggaatccaactagaccagaaaatcatcatcctttacatgtcccactggggccgcgaagctgtaaaccacttccacctcggcgacgacatggaccccgaactgcgagaactcgcacaaaccctcgtcgacatcaaagtccgagaaatctccaaccaagaacccctcaaactttaa

SEQ ID NO: 8006 - RNA, 1287 nt, synthetic construct
  misc_feature 1..1287: note = derived and/or modified CDS sequence (opt11) from HPS(H-NY1)__U47135.1__N
  source 1..1287: mol_type = other RNA
atgtccaccctcaaagaagtccaagacaacatcaccctccacgaacaacaactcgtcaccgcacgccaaaaactcaaagacgccgaaaaagccgtcgaagtcgacccagatgacgtcaacaaaagcaccctccaaggaagacgagccgccgtctccgccctcgaaaccaaactaggcgaactcaaacggcaactcgcagacctcatcgccgcccaaaaactcgcctcaaaaccaattgacccaaccggtatagaacccgacgaccacctcaaagaaaaatcctctctacgatacggcaacgtcctcgacgtcaactcaatcgacctcgaagaaccttccggacaaaccgcagactggaaagccatcggaatgtacatcctctccttcgccatcccgataatcctcaaagcgctatacatgctatcaacccgcggccgacaaaccgtaaaagaaaacaaaggcacccgcatacgattcaaagacgactcctcatacgaagaagtcaacggcatccgcaagccccgccacctctacgtctccatgcccacagcccaaagcaccatgaaagcagacgaaatcacacccggacggttcagaaccatcgcctgcggcctcttccctgcacaagtaaaagcccgcaacatcatctcacccgtaatgggtgtcatcggcttcaacttcttcgtaaaagactggatggaccgcatcgacgatttcctcgccgaacgctgtcccttcctccccgaaccccgcgaccccaaagacgccgccctcggcaccaaccgcgcatacttcatcacccgccaagcacaggtcgacgaatcaaaagtcgtagacatcgaagaattaatagtcgacgcccgtgccgaatcagccaccctcttcaccgacatcgccacaccccactcagtctgggtcttcgcctgcgcccccgaccgctgcccacccaccgccctctacgtcgccggaatgcccgaacttggcgccttcttcgctattctccaagacatgcggaacacaatcatggccagcaaatccgttggcaccgccgaagaaaaactcaaaaagaaatccgcattctaccaatcttacctccgccgcacccaaagcatgggcatacaactagaccagaaaatcataatactatacatgatccactggggcaaagaagccgtcaaccacttccaccttggcgacgacatggaccccgaactccgcgagctagcccaagccctcgtcgacgccaaagtcaaagaaatctcgaaccaagaacccctcaaactataa

SEQ ID NO: 8007 - RNA, 1290 nt, synthetic construct
  misc_feature 1..1290: note = derived and/or modified CDS sequence (opt11) from THAIV(Nakhon Ratchasima/Bi0017/2004)__AM397664.1__N
  source 1..1290: mol_type = other RNA
atggcaacaatggaagaactacaacgcgagatcaatgctcacgaaggacagctagtcgtagccagacaaaaagtcaaagacgcagaaaaacaatacgaaaaagacccggacgacctcaaccgccgagcactacacgaccgcgaatccgtcgccgcgagcatccaatccaaaatagacgaactcaaacgacaactcgcggaccgcatagccagcggccgcacaatcggtcaagaccgagaccccacaggcgtagaaccaggcgaccacctacgagaacgctctatgctgagctacggcaacgtcctagacctaaacaacctcgacatcgaagaaccaaccggccaaacggcagactggctcaccatcatcgtatacctaacctccttcgtcatcccaataatacttaaagccctgtacatgctcacaaccagaggacgacaaacaaccaaagacaacaaaggaatgcgaatccgattcaaagacgacagctcatacgaggacgtaaacgggattcgaaaaccaaaacacctctacatctccatgcccaacgcccaatcctccatgaaggcagaagagatcacacccggacgattccgaaccgctgtatgcggactctaccccgcacaagtgaaagcacgcaacatggtgagcccagtcatgagcgtaatcggattcatggcactcgcaaaagactggacagaccgcatacaagactggctgggcgcaccctgcaaattcctaccagacctaagcacacaatcgctacacgcctccccacccaccaacgcagactacatagcccaacgacaaggactactcgccggcatggaaacgaaagaatcaaaaggcatccgcgaccacgcacgcgacgccggatgcacactcgtagaccacctcgacagccccagctcaatatgggtattcgctggagccccagacagatgcccgccgacgtgcctgttcatagccggaatggcagaactaggagcattcttcagcatcctccaagacatgcgcaacacaataatggcaagcaaaacagtaggcacatccgaggaaaaactcaaaaagaaatcatcattctaccaatcctacttgagaaggacccaaagcatgggcatacaattagaccaacgaatcatcgtaatgttcatggtagcctggggcaaagaagcggtagacaactttcacctaggcgacgacatggacccagaactccgcaacctagcacaactacttatagaccaaaaagtaaaagaaatatcgaaccaagaacccctgaaactctaa

SEQ ID NO: 8008 - RNA, 1290 nt, synthetic construct
  misc_feature 1..1290: note = derived and/or modified CDS sequence (opt11) from TULV(Tula/Moravia/5302Ma/94)__NC_005227.2__N
  source 1..1290: mol_type = other RNA
atgtcccaactcaaagaaatacaagaagaaatcacccgccacgaacaacaaatagtcatcgcacgccaaaaactaaaagacgcagaaaagacagtcgaagcagaccccgacgacgtcaacaaatccaccctccaatcccgccgggccgcagtctcagccctggaagacaaactcgccgacttcaaacgacagctcgccgacctagtctcctcccagaaaatgggcgaaaaacccgtcgaccccacaggactcgaaccagacgaccacctcaaagaacgctcctccctccgctacggcaacgtgctagacgtcaacgcaatagacatcgacgaacccagcggccaaaccgcagactggttttccataggccaatacataaccggcttcgcgctcgccatcatcctcaaagcattatacatgctctccacacgcggacgacaaaccatcaaagaaaacaaaggcacccgcatccgattcaaagacgactcctcatacgaagaaatcaacggaatccgccgacccaaacacctctacgtcagcatgccaaccgctcaatccacaatgaaagcggacgaactcaccccaggccgtttccgcacaatcgtgtgcggactattccccgcccaaatcatgcaccgcaacatcatcagccccgtaatgggcgtcatcggcttctccttcttcgtcaaagactggcccgagaaaatcgaagaatttctaatcaaaccttgccccttcctcaagaaatcaggcccctccaaagaagaagacttcctagtcagcaacgacgcatacctcctaggacgagaaaaagccctccgcgaatcacacctcgccgaaatagacgacctaatcgacctcgccgcatccggagaccccactccacccgactctatcaaaagcccccaagcaccctgggtgttcgcttgccgccccgaccgatgcccacccacatgcatctacatcgccggcatggccgaactaggcgccttcttctccatcctccaagacatgcgcaacaccataatggccagcaaaactgtcggcaccgccgaagaaaaactcaaaaagaaaagctcattctaccaatcatacctacgccgaacccaaagcatgggcatccaactagaccagagaatcatccttctcttcatgaccgaatggggctcagacatcgtcaatcacttccacctgggcgacgacatggaccccgaactccgcacgctagcccaatccctaatcgaccaaaaagtcaaagaaatctccaaccaagaacccctaaaaatataa

SEQ ID NO: 8009 - RNA, 1293 nt, synthetic construct
  misc_feature 1..1293: note = derived and/or modified CDS sequence (opt11) from TULV(D17-98)__AF289820.1__N
  source 1..1293: mol_type = other RNA
atgtcccaactcaaagaaatccaagaagaaataacccgccacgaacaacaaatagtcatcgcacgccaaaaactcaaagacgccgagaaaaccgtcgaagccgaccccgacgacgtcaacaaaagtaccctacagtcccgccgcgccgcagtaagcgctctcgaagataagctcgcagacttcaaacgacaactggcagacctcgtctcctcccagaaaatgggcgaaaaacccgtcgaccccaccggtctcgaacccgacgaccacctcaaagaacgctcctcactccgatacggcaacgtcctcgatgtcaacgccatagacatcgacgaaccctcaggccaaaccgccgattggttctcaatcggccaatacatcataggcttcgcactagccatcgtcctcaaagccctctatatgctctccacccgcggacgccaaaccatcaaagaaaacaaaggaacccgcatacgattcaaagacgactcatcctacgaagaaatcaacggcatccgccgccccaaacacctatacgtctcaatgcccaccgcccaatccaccatgaaagccgacgaactgacccccggacgcttccgcaccatcgtctgcggactcttcccagcccaaatcatgcaccgcaacatcatctcacccgttatgggcgtcatcggcttctccttcttcgtaaaagactggcccgacaaaattgaagagttcctaatcaaaccctgcccattcctcaagaaacaaggaggccccaacaaagacgaagagttcctcgtctcctacgacgcctacctcctcggccgcgaaaaagccctccgagaatcccacctagccgaaatcgacgacctcatcgacctagctgcctccggagacccaacgccacccgactccatcaaatccccacaaggaccctgggtcttcgcctgcgcgcccgaccgatgcccaccaacctgcatctacgtcgcaggcatggccgaacttggcgcctttttctccatactccaagacatgcgaaacaccatcatggcatcaaaaacagtcggcaccgccgaagaaaaacttaaaaagaaatcatcattctaccaatcctaccttcgccgcacacaatccatgggaatccaactagaccaacgcatcatccttctattcatgatggaatggggctccgacatcgtcaaccacttccacctcggcgacgacatggaccccgaactccgtaccctcgcccaatcgctcatcgaccaaaaagtcaaagaaatctccaaccaagaacccctcaaaatctaa

SEQ ID NO: 8010 - RNA, 1293 nt, synthetic construct
  misc_feature 1..1293: note = derived and/or modified CDS sequence (opt11) from TULV(D5-98)__AF289819.1__N
  source 1..1293: mol_type = other RNA
atgagccaactcaaagaaatccaagaagaaatcacacgccacgaacaacaaatcgtaatagcacgccaaaaactaaaagacgccgagaaaacagtcgaagccgaccccgacgacgtcaacaaaagcaccctacaaagccgccgcgcagccgtctctgcactcgaagacaaactagccgacttcaaacgccaacttgctgacctcgtctcctcccaaaagatgggcgaaaaacccgtcgacccaaccggcctcgaacccgacgaccacctcaaagaaagatcctcgctccgctacggaaacgtcctagacgttaacgccatagacatcgacgaacccagcggccaaacggccgactggttctcaataggccaatacatcatcggcttcgctctcgccatcgtcttaaaagccctatacatgctctccacacgaggccgccaaaccataaaagaaaacaaaggcacacgaatccgcttcaaagacgacagcagctacgaagaaatcaacggcatccgccgcccaaaacacctctacgtctcaatgcccacagcccaatccacaatgaaagcagacgaactgacccccggccgcttccgaacaatagtctgcggactattcccagcacaaatcatgcaccgcaacataatctccccagtcatgggagtcatcggcttctcattcttcgtcaaagattggcccgacaaaatcgaagaatttctcataaaaccctgcccattcctaaagaaacaaggcggtcccaacaaagacgaagagttcctcgtaagctacgacgcctacctactcggccgagaaaaagccctccgcgaatcccacctggccgaaatagacgacctcatcgacctcgcagcctccggagaccccacacccccagactcaatcaaaagcccacaagccccatgggtcttcgcgtgcgcacccgaccgctgcccaccaacctgcatctacgtcgccggaatggccgaactcggcgccttcttctccatactacaagatatgcgcaacaccatcatggcatccaaaaccgtgggaacagccgaagaaaaactcaaaaagaaatccagcttctatcaatcctacctccgcaggacacaaagtatgggcatccaactcgaccagcgaatcatcctactcttcatgatggaatggggctccgacatcgtcaaccacttccacctcggcgacgacatggaccccgaactgcgcacactcgctcaatcactcatcgaccaaaaagtcaaagaaatctccaaccaagaacccctaaaaatataa

SEQ ID NO: 8011 - RNA, 1293 nt, synthetic construct
  misc_feature 1..1293: note = derived and/or modified CDS sequence (opt11) from TULV(D63-98)__AF289821.1__N
  source 1..1293: mol_type = other RNA
atgtcccaactcaaggaaatccaagaagaaatcacccgtcacgaacaacagatcgtcatcgcccgccaaaaactgaaagacgccgaaaaaacagtcgaagccgaccccgacgacgtcaacaaatccactctacagtcccgccgcgcagccgtatccgcactcgaagacaaactagccgatttcaaacgacaactcgccgacctcgtaagctcacagaaaatgggcgaaaaacccgtcgaccccaccggcctagaaccagatgaccacctcaaagaacgctccagcctccgctacggaaacgtactagacgtcaacgccatagacatagacgaaccctccggccaaacagccgactggttctcaatcggccaatacataataggtttcgccctcgccattgtccttaaagccctatacatgctctcaacccgtggccgacaaacaatcaaagaaaacaaaggaacccgcatccgcttcaaagacgactcatcctacgaagaaataaacggcatccgccgccccaaacacctatacgttagcatgccaaccgcccaaagcaccatgaaagccgacgaactaaccccaggccgattcagaaccatcgtatgcggcctatttccagcccaaatcatgcaccgcaacatcatctcgcccgtcatgggcgtcataggattctccttcttcgtaaaagactggcccgacaaaaaagaagagtttctaataaaaccatgccccttcctgaaaaaacaaggcggacccaacaaagacgaagaattcctcgtctccaacgacgcatacctcctcggacgcgaaaaagccctccgtgaatcccacctcgccgaaatagacgacctcatcgacctcgccgcctcaggagaccctacgcctcccgactccatcaaatccccacaaggaccctgggtattcgcctgcgccccagaccgctgcccccccacctgcatctacgtcgccggcatggcagaactcggcgcattcttcagcatcctccaggacatgcgcaacaccattatggctagcaaaaccgtcggcacagccgaagaaaaactaaaaaaaaaatcctccttctatcaatcgtacctccgccgcacacaatccatgggaatccaacttgaccagcgcatcatcctcctattcatgatggagtggggatccgacatcgtcaaccacttccacctcggcgacgacatggaccccgaactccgtaccctcgcccaatccctaatagaccaaaaagtgaaagaaatatcaaaccaagaaccactaaaaatctag

SEQ ID NO: 8012 - RNA, 1290 nt, synthetic construct
  misc_feature 1..1290: note = derived and/or modified CDS sequence (opt11) from TULV(MG23/Omsk)__AF442621.1__N
  source 1..1290: mol_type = other RNA
atgtcaaccctgaaagaaatacaagaagaaatcacacgtcacgaacaacaaatcgtaatcgccagacaaaaactcaaagacgcagagaaaaccgtagaagccgaccccgacgacgtcaacaaaaacaccctccaatcacgccgagcggccgtaagcaccctagaagacaaactcgccgaatttaaacgccaactagcagacctcgtatcctcccaaaagatgggcgaaaaaccagtagatcccacaggcctcgaacccgacgaccacctaaaagaacgctcctccctacgctacggaaacgtccttgacgtgaacgccacagacatcgacgagccttcaggccaaaccgccgactggttctccatcggccaatacatcatgggctttgccctcgcaatcgtactcaaggccctctacatgctctccacccgcggacgccaaaccatcaaagaaaacaaaggtacccgcatcaagttcaaagacgacagctccatcgaagaaatcaacggcataagacgacccaaacacctatacgtatccatgcccaccgcccaatccaccatgaaagccgacgagctaacccccggccgcttccgaacaatcgtatgcggcctgttccccgcccaaataatgcaccgcaacatcatctcccctgtcatgggagtaattggcttctccttcttcgtaaaagactggcccgacaaaatagaagagttcctaatcaaaccctgccccttcctcaagaaacaaggaagcaccaaagaagaagagttcctcgtctccaacgacgcgtacatgctaggacgcgaaaaagcactccgcgaatcccacctcgccgaaatagacgaactcatcgatctcgccgactcgggagaccccacaccacccgactccataaaatctccccaagccccctgggtattcgcctgcgcacccgacagatgcccacccacatgcatctacatagccgggatggccgaactcggcgctttcttctcgatcctccaagacatgagaaataccataatggcaagcaaaaccgtcgggacagccgaagaaaaacttaaaaagaaaagctcattctaccaatcctacctccgacgcacccaatccatgggaatccaactcgaccaacgcatcattctactcttcatgatggaatggggctcagacatagtcaaccacttccacctcggagacgacatggaccccgaactccgcactctagcccaatccctcatcgaccaaaaagtcaaagaaatctccaaccaagaaccgctcaaaatctaa

SEQ ID NO: 8013 - RNA, 1290 nt, synthetic construct
  misc_feature 1..1290: note = derived and/or modified CDS sequence (opt11) from TULV(c109-s)__AF164094.1__N
  source 1..1290: mol_type = other RNA
atgtcccaactaaaagaaatccaagaagaaatcacacgccacgaacagcaaatcgtcatcgcccgacaaaaactaaaagacgctgaaaaaaccgtcgaagcggaccccgacgacgtaaacaaatccaccctccaatcccgacgcgccgcagtctcagcccttgaagacaaactcgccgacttcaaacgccaactcgccgacctcgtctcgtcacaaaaaatgggtgaaaaacccgtcgaccccacaggcctcgaacccgacgaccaccttaaagaacgatcatcccttcgctacggcaacgtactcgacgtcaacgcaatagacatagacgaaccctccggacaaacagccgactggttctccatcggccaatacatcacaggcttcgccctagcaatcatcctaaaagccctctacatgctctcaaccagaggacgccaaacaataaaagaaaacaaaggcacccggatccgcttcaaagacgattcatcctacgaagaaatcaacggcatacgacgacccaaacacctctacgtatccatgccaactgcccaatccaccatgaaagctgacgaactaacaccaggccgattccgcaccatcgtctgcggcctattcccagcccaaatcatgcaccgtaacatcatctccccagtcatgggagtcataggattctccttcttcgtcaaagactggcccgaaaagattgaagaattcctaatcaaaccctgccccttcctaaaaaaatccggcccttccaaagaagaagacttcctagtctccaacgacgcatacctgctcggccgcgagaaagccctacgcgaatcacatctcgcggaaatagacgacctcatcgaccttgccgcctcaggcgaccccactccccccgactcaatcaagtcaccccaagccccatgggtcttcgcatgcgcccccgaccgctgcccacccacctgcatctacatcgcaggaatggccgaactaggcgccttcttctccatactacaagacatgcgaaataccatcatggcctccaaaacagtcggcacatccgaagaaaaactcaaaaaaaaatccagcttctaccaatcctacctacgccgaacccaatccatgggcatccaactagaccaaagaatcatactactcttcatgaccgaatggggctccgacatcgtcaaccacttccacctaggggacgacatggacccagagctccgaacgcttgcacagtccctcatcgatcaaaaagtcaaagaaatctccaaccaagaacccctaaaaatctaa

SEQ ID NO: 8014 - RNA, 1290 nt, synthetic construct
  misc_feature 1..1290: note = derived and/or modified CDS sequence (opt11) from TULV(CHEVRU/Hu/FRA/2015/15.00453)__KT946591.1__N
  source 1..1290: mol_type = other RNA
atgtcacaactcaaagaaatccaagaagaaataacccgccacgaacaacaaatagtcatagcccgccaaaaactcaaagacgccgaaaagaccgttgaagccgaccccgacgacgtcaacaaatccaccctccagtcacgacaagcagcagtctccgccctcgaagataaactcgccgacttcaaacgcaaactagccgacctcgtctccagccagaaaatgggcgaaaaacccgtcgacccaaccggcctagaacccgacgaccacctaaaagaacgctcctctctccgatacggcaacgtcctcgatgtcaacgccatagacatagacgaaccctcaggacaaacagcagactggttctccatcggccaatacgtcatgggattcgccctggccatcatcctaaaagcactatacatgctctcgactcgcggccgccaaacaatcaaagaaaacaaaggcactcgcatccgcttcaaagacgacagctcatacgaagaaatcaacggaatccgccgccccaaacacctatacgtcagcatgccaaccgcccaatcaaccatgaaagcagacgaactcaccccaggcagattccgcaccatcgtctgcggcctattcccagcccaaatcatgcaccgcaacatcatcagccccgtcatgggcgtcatcggcttctctttcttcgtaaaagactggcccgagaaaatcgaagaatttctcatcaaaccatgcccattcctcaagaaatccggcccctccaaagaagaagacttcctcgtaagcaacgacgcctacctcctcggccgcgaaaaagccctccgagactcacacctagccgaaatcgacgacctaatcgacctcgcagaatcaggcgaccctacaccacccgactcaatcaaaagcccccaagccccctgggtattcgcctgcgccccagacagatgcccaccaacctgcatctacatcgccggcatggccgaactaggcgccttcttctccatcctccaagacatgcgcaacaccataatggcaagcaaaacagtcggcacagccgaagaaaaactgaaaaagaaatcctccttctaccaatcatacctccgacgcacccaatcgatgggaatacaactagaccaacgcatcatactactcttcatgatagaatggggctccgacatcgtaaaccacttccacctcggcgacgacatggaccccgaactccgcaccctggctcaatccctaatcgaccaaaaagtcaaagaaatctccaaccaagaacccctcaaaatctag

SEQ ID NO: 8015 - RNA, 1290 nt, synthetic construct
  misc_feature 1..1290: note = derived and/or modified CDS sequence (opt11) from TULV(g20-s)__AF164093.1__N
  source 1..1290: mol_type = other RNA
atgtcccaactcaaagaaatacaagaagaaatcacccgccacgaacaacaaatcgtgatcgcacgccaaaaactcaaagacgcggagaaaaccgttgaagcagaccccgacgacgtcaacaaaagcaccctacaatcccgccaagccgccgtaagcgcccttgaagacaaactagcagactttaaacgaaaactcgcagacctcgtcagctcacaaaagatgggagaaaaacccgtcgaccccaccggactcgaacccgacgaccacctcaaagaacgatcatcactccgctacggcaacgttctagacgtcaacgccatcgacatcgacgaaccctccggacaaaccgccgactggttctccatcggccaatacgtcatgggtttcgccctcgccatcatcctaaaagccctgtacatgctgtccacacgaggccgccaaacaatcaaagaaaacaagggcacacgcattcgattcaaagatgactcctcctacgaagaaataaacggcatacgacgacccaaacatctatacgtatccatgccaactgcacaatccaccatgaaagctgacgaactcacccccggccgtttccgcaccatcgtatgcggactcttcccagctcaaatcatgcaccgcaacatcatatcacccgtcatgggcgtcatcggctttagcttcttcgttaaagactggccagaaaagatagaagagttcctcatcaaaccatgcccattcctaaagaaatcaggcccctcaaaagaagaagacttcctcgtctccaacgacgcctaccttctcggccgagaaaaagccctccgcgacagccaccttgccgaaatcgacgacctaatagacctcgccgaatcaggagacccaacaccacccgactccatcaaaagcccccaagccccctgggtcttcgcctgcgcccccgatagatgccctcctacctgcatatacatcgcaggcatggccgaactcggcgccttcttctccatcctccaagacatgcgcaacaccatcatggcttccaaaaccgtcggcaccgcagaagaaaaactcaaaaagaaaagctcattctaccaatcctacctcagacgcacccaatcaatgggcatccaactcgaccaacgaatcatcctcctattcatgaccgaatggggctccgacatcgtcaaccacttccacctcggagacgacatggaccccgaactccgcaccctggcccaatccctgatagaccaaaaagtaaaagaaatcagcaaccaagaacccctaaaaatatga

SEQ ID NO: 8016 - RNA, 1293 nt, synthetic construct
  misc_feature 1..1293: note = derived and/or modified CDS sequence (opt11) from TULV(Sennickerode Sen05/174)__EU439948.1__N
  source 1..1293: mol_type = other RNA
atgtcccaactcaaagaaatccaagaagaaatcacccgccacgaacaacaaatcgtaatagcacgccaaaaactaaaagacgccgaaaagaccgtcgaagcagacccagacgacgttaacaaatccaccctccaaagccgacgcgccgcagtctccgccctggaagacaaactcgccgacttcaaacgccaactggccgacctcgtctcctcccagaaaatgggcgaaaaaccagtagaccccaccggcctcgaacccgacgaccacctcaaagaacgctcctcgctccgctacggcaacgtactcgacgtaaacgccatcgacatagacgaaccatccggtcaaaccgccgactggttctcaatcggacaatacatcatcggcttcgccctagccatagtactcaaagcactctacatgctatccacgcgcggcagacaaacaataaaagaaaacaaaggtacacgaatccgattcaaagacgactcctctttcgaagaaataaatggaatccgcagacccaaacacctctacgtctcaatgcccacagcacaatcaaccatgaaagcagacgaactcaccccagggcgcttcagaacaatcgtctgcggactcttcccagcacaaatcatgcacagaaacatcatctccccagtaatgggcgtaatcggattcagcttcttcgtcaaagactggcccgacaaaatcgaagaatttctaatcaaaccctgcccattcctcaagaaacaaggcggcccaaacaaagacgaagacttcctagtatcaaacgacgcctacttccttggccgcgaaaaagcactacgcgaaagccacctcaacgaaatcgacgacctaatcgaactagccgcctcgggcgaccccaccccacccgacagcatcaaatcaccccaagccccctgggtcttcgcctgcgcacccgaccgctgcccacccacttgcatctacgtagcaggcatggccgaactcggagccttcttctccatcctccaagacatgcgcaacacaatcatggcctccaaaaccgtaggaaccgccgaagaaaaactaaagaagaaatcctcattctaccaaagctatctccgccgcacccaatcaatgggcatacaacttgaccaacgcatcatcctcctattcatgatggaatggggctccgacatcgtaaaccacttccacctcggcgacgacatggacccagaacttcgcacacttgcccaatccctgatcgaccaaaaagtaaaagaaatcagcaaccaagaaccactcaaaatctaa

SEQ ID NO: 8017 - RNA, 1293 nt, synthetic construct
  misc_feature 1..1293: note = derived and/or modified CDS sequence (opt11) from TULV(Sennickerode Sen05/175)__EU439949.1__N
  source 1..1293: mol_type = other RNA
atgtcgcaactcaaagaaatacaagaagaaatcacccgccacgaacaacaaatagttatcgcccgccaaaaattaaaagacgccgagaaaaccgtcgaagccgaccccgacgacgtcaacaaatccaccctacaatcacgccgcgcagcagtctccgcactcgaagacaaactcgctgacttcaaacgccaactagctgacctcgtctcatcccagaaaatgggcgaaaaaccagtcgaccccaccggcctagaaccagacgaccacctcaaagaacgaagctccctacgctacggcaacgtcctagacgtaaacgcaattgacatcgacgaaccctccggacaaacagcagactggttctcgatcggccaatacatcataggcttcgcactagcaatcgtcctcaaagccctctacatgctcagcacccgcggccgccaaaccatcaaagaaaacaaaggcacccgaatccgcttcaaagacgactcctccttcgaagaaatcaacggcatccgccgccccaaacacctctacgtcagcatgccaacagcacaatccaccatgaaagccgatgaactaaccccaggacgcttccgtaccatcgtatgcggactattcccagcccaaatcatgcacagaaacatcatctctcccgtaatgggggtcatcggattctccttcttcgtcaaagactggcccgacaaaatcgaagagttcctcatcaaaccctgccccttcctaaagaaacaaggcggccccaacaaagacgaagacttcctcgtctccaacgacgcgtacttcctcggccgagaaaaagccctccgagaatcacacctaaacgaaatcgacgacctgatcgaactagcagcatccggcgaccccaccccacccgactcaattaaatcaccccaagcaccctgggtcttcgcatgcgcccccgaccgctgcccacccacatgcatatacgtagccggcatggccgaactcggagccttcttctccatcctccaagacatgcgaaaatccatcatggcctccaaaaccgtcggcaccgcggaagaaaaactaaagaagaaaagctcattctaccaaagctacctacgccggacccaaagcatgggcatccaactcgaccaacgaatcatcctcctattcatgatggaatggggctccgacatcgtcaaccacttccacctcggagacgacatggaccccgagctccgaaccctcgcacaatcgctcatcgaccaaaaagtaaaagaaatatccaaccaagaacccctcaaaatctaa

SEQ ID NO: 8018 - RNA, 1293 nt, synthetic construct
  misc_feature 1..1293: note = derived and/or modified CDS sequence (opt11) from TULV(TUL/Karatal/Ma322/2003)__AM945877.1__N
  source 1..1293: mol_type = other RNA
atgtcccaactcaaagagatccaagaagaaatcaccagacacgaacaacaaatagtcatcgcccgacaaaaactaaaagacgccgaaaaaactgtcgaagccgacccagacgacgtaaacaaaaacacactacaatcaagacgcgccgcagtctccgccctcgaagacaaactcgccgaattcaaacgccaactagccgacctagtatcatcccaaaaaatgggcgaaaagcccgtagaccccacaggcctcgaacccgacgaccacctaaaggaacgctcctcactccgatacggcaacgtcctcgacgtcaacgccattgacatcgacgaaccctccggacaaaccgcagactggttctccatcggccaatacgtcatgggtttcgccctagccatcgtcttaaaagccctatacatgctcagcacccgcggccgccaaactatcaaagaaaacaaaggcacccgaatcagattcaaggacgactccagcttcgaagaaatcaacggcatccgccgccccaaacacctttacgtatccatgcccaccgcccaaagcacaatgaaagccgacgaactaacacccggacgcttccgcaccatcgtctgcgggctattcccagcccaaatcatgcacagaaacatcatctcccccgtcatgggcgtcatcggcttctccttcttcgtcaaagactggcccgaaaaaatcgaagaattccttatcaaaccatgcccattcctcaaaaagcaaggatcatcaggcaaagaagaggaattcctagtctccaacgacgcctacctaatcggccgcgagaaaacccttcaagaatcccacctcactgaaatcgacgacctcatagacctagcagactccggcgaccccacaccccccgactccatcaaaagcccccaagccccctgggtcttcgcatgcgcacccgaccgatgcccacccacatgcatctacatagctggcatggcagaactaggagccttcttctccatactccaagacatgcgcaacactatcatggccagcaaaaccgtcggtacagccgaagaaaaactgaaaaaaaaatcctccttctaccaaagctacctccgccgaacccaatcaatgggcatccaactcgaccaaagaatcatcctactattcatgatggaatggggctcagacatcgtaaaccacttccacctcggcgacgacatggaccccgaactccgaaccctcgcccaatcactcatcgaccaaaaagtaaaagaaatctcgaaccaagaaccactcaaaatatag

SEQ ID NO: 8019 - RNA, 1293 nt, synthetic construct
  misc_feature 1..1293: note = derived and/or modified CDS sequence (opt11) from TULV(Tula/Kosice144/Ma/95)__Y13979.1__N
  source 1..1293: mol_type = other RNA
atgtcacaactcaaagaaatccaagaagaaatcaccagacacgaacaacagatcgtcatagcccgccaaaaactcaaagatgcagagaaaaccgtagaagccgatcccgacgacgtaaacaaatctaccctccaaagccgccgcgccgccgtctccgccctcgaagacaaactagccgacttcaaacgtcaactcgccgacctcgtcagctcccagaaaatgggcgaaaaaccagtagaccccacaggccttgaacccgacgaccacctaaaagaacgttcctccctccgctacggcaacgtccttgacgtaaacgccatcgacatcgacgaaccatccggccaaaccgccgactggttctccataggacaatacatcatcggcttcgccctcgccatcgtactaaaagccctttacatgctctcaacccggggccgccaaacaatcaaagaaaataaaggcactcgcatccgattcaaagacgacagctccttcgaagaaatcaacggcatccgccgacccaaacacctctacgtctcaatgccgaccgcccaatcgaccatgaaagccgacgaactcaccccaggccgattccgcaccatcgtctgcggcctcttccccgcacaaatcatgcaccgaaacatcatctccccagtaatgggtgtaatcggcttcagcttcttcgtaaaagactggcccgagaaaatagaagagttcctcatcaaaccctgccccttcctaaagaaacaaggcgccccaggcaaagaagaagacttcctcgtcagcaacgacgcctacctactcggacgcgaaaaagccctccgagaatcacacctcgccgaaatagacgacctcatcgacctcgccgcatcaggcgaccccacccctcccgactccatcaaatcaccccaagccccatgggtcttcgcctgcgcccccgaccgctgcccacccacatgcatctatatcgccggcatggcggaacttggagcattcttctcaatcctccaagacatgcgcaacaccatcatggccagcaaaacagtcggcaccgcggaagaaaagctcaagaagaaatcctcattctaccaatcatacctccgccgaacccaatcaatgggaatccaactagaccagcgaatcatactcctattcatgacagaatggggatccgacatcgtaaaccacttccacctcggcgatgacatggaccccgaactacgcacactggcccaatccctcatcgaccaaaaagtcaaagaaatatcgaaccaagaacccctcaaaatctaa

SEQ ID NO: 8020 - RNA, 1293 nt, synthetic construct
  misc_feature 1..1293: note = derived and/or modified CDS sequence (opt11) from TULV(Tula/Kosice667/Ma/95)__Y13980.1__N
  source 1..1293: mol_type = other RNA
atgtcccaactcaaagaaatccaagaagaaatcacccgccacgaacaacaaatagtcatcgcccgccaaaaactcaaagacgccgaaaagacggtagaagccgaccccgacgacgtcaacaaatccaccctccaatcccgacgcgccgcagtttcagcccttgaagacaaactcgcagacttcaaaagacaactagccgacctcgtatccagccagaaaatgggcgaaaaacccgtcgaccccaccggcctcgaacccgacgaccaccttaaagaacgctcctcactccgctacggcaacgtactagacgttaacgccattgacatcgacgaaccctcaggccaaacagccgactggttctcaatcggccaatacataatcggcttcgccctcgccatagtcctaaaagccctctacatgctctccacccgaggacgacaaaccatcaaagaaaacaaaggcacccgcatccggttcaaagacgactcatccttcgaagaaatcaacggcatccgacgccccaaacatctctacgtctccatgcccaccgcacaatctaccatgaaagccgacgaactaacacccggccgcttccgcaccatcgtatgcggtttattccccgcccaaatcatgcaccgaaacataatctcacccgtcatgggcgtgatcggcttctccttcttcgtaaaagactggcccgagaaaatcgaagagttcctaatcaaaccctgccccttcctcaagaaacaaggcgcccccggcaaagaagaagacttcctcgtctccaacgacgcatacctcctgggccgggaaaaagccctacgcgaatcccacctagccgaaattgacgacctcatagacctagctgcctccggcgacccaacccctcccgactcaatcaaatctccccaagccccctgggtattcgcctgcgcccccgatcgctgcccaccaacctgcatctacatcgccggaatggccgaactcggagccttcttctccatactacaagacatgcgcgacacaatcatggcctccaaaacagtcggcaccgcagaagaaaaactcaagaagaaatcctcattctaccaatcctacctaagacgcacccaatcaatgggcatacaactcgaccaacgcatcatcctcctattcatgaccgaatggggctccgatatcgtaaaccacttccacctcggcgacgacatggaccccgaactccgaacccttgcacaatcactcatagaccaaaaagtcaaagaaatctcaaaccaagaacccctcaaaatctag

SEQ ID NO: 8021 - RNA, 1290 nt, synthetic construct
  misc_feature 1..1290: note = derived and/or modified CDS sequence (opt11) from TULV(Tula/Koziky/5247Ma/94)__AJ223600.1__N
  source 1..1290: mol_type = other RNA
atgtcccaactcaaagaaatacaagaagaaatcacccgccacgaacaacaaatagtaatcgcccgccaaaaactaaaagacgccgagaaaaccgtcgaagcagaccccgacgacgtaaacaaatccacactacaatcccgccgcgccgccgtctccgccctagaagacaaactcgccgacttcaaacgccaactagccgaccttgtctcctcccagaaaatgggcgaaaaacccgtcgaccccaccggcctcgaaccagacgaccacctgaaagagcgctcgtccctccgctacggcaacgtactcgacgtaaacgccatcgacatagacgaaccaagcggacaaacagccgactggttcagcatcggacaatacataacaggcttcgccctcgccatcatactaaaagccctatacatgctctcaacccgaggccgccaaacaatcaaagaaaacaaaggcacccgaatccgcttcaaagacgactcctcatacgaagaaatcaacggcatccgacgacccaagcacctctacgtctctatgcccacagcccaatccaccatgaaagccgatgaactcacacccggccgattccgcaccatagtctgcggcctcttccccgcccaaatcatgcaccgcaacatcatctcccccgtaatgggcgtaatcggtttctctttcttcgtaaaggactggccagagaaaatcgaagagttcctcattaaaccatgccccttcctcaaaaagaacggaccctccaaagaagaagacttcctagtcagcaacgacgcctacttactcggccgcgaaaaagcccttcgcgaatcccacctcgccgaaatcgacgacctgatcgacctcgccgcctccgaagaccccacacccccagactcaataaaatcaccacaagcaccctgggtctttgcctgccgacccgaccgatgcccaccgacctgcatctacatcgccggaatggcagaactcggcgccttcttctccatcctccaagacatgcgcaacaccataatggcctccaaaacagtaggcaccgccgaagaaaaactaaagaagaaatcctccttctaccaatcctacctacgaagaacccagtccatgggaatccaactcgaccagcgcatcatcctcctattcatgaccgaatggggctcagacatcgtcaaccattttcacctgggcgacgacatgtcccccgaacttcgcaccctcgcacaatccctcatcgaccaaaaagtcaaagagatctccaaccaagaacccctcaaaatatag

SEQ ID NO: 8022 - RNA, 1290 nt, synthetic construct
  misc_feature 1..1290: note = derived and/or modified CDS sequence (opt11) from TULV(Tula/Moravia/5302v/95)__Z69991.1__N
  source 1..1290: mol_type = other RNA
atgtcccaactcaaagaaatacaagaagaaatcacccgccacgaacagcaaatcgtcatagcaagacaaaaactcaaagacgtcgagaaaacagtcgaagcagacccagacgacgtcaacaaatcaacactccaatcccgccgagcggccgtcagcgcacttgaagacaaactggcagacttcaaacgccagctcgccgacctagtctcgagccagaaaatgggcgaaaaacccgtcgaccccaccggactcgaacctgacgaccacctgaaagaacgctcctcactacgctacggcaacgtcctggacgtcaatgccatcgacatcgacgaacccagcggccaaacagccgactggttctcaatcggccaatacatcaccggattcgccctagccatcatcctcaaagccctctacatgctctccacacgaggacggcaaaccataaaagaaaacaaaggcacacgcatcagattcaaagacgactcaagctacgaagaaataaacggcatcagacgaccaaaacacctctacgtctccatgccaaccgcacaatccacaatgaaagccgacgaactcactccaggtcgattccgcacaatcgtctgcggactattcccagcacaaatcatgtaccgaaacatcatcagcccagtaatgggagtcatcggcttttcatttttcgtcaaagactggccagagaaaatcgaagaatttttgataaaaccatgccccttcctcaagaaatcaggcccctccaaagaagaagacttcctcgtaagcaacgacgcatacttactaggccgcgaaaaagccctccgagaatcccaccttgccgaaatcgacgacctcatcgacctcgccgcaagcggagaccccaccccgcccgactccatcaaaagcccccaagccccctgggtcttcgcatgccgcccagaccgatgcccacccacgtgcatctacatcgccggcatggcagaactgggagccttcttctccatcctccaagacatgcgcaacacaataatggcctccaaaaccgtcggcaccgcagaagaaaaacttaaaaagaaaagctcattctaccaatcatacctaaggcgcacccaaagcatgggaatacaactcgaccaacgcatcatactcctcttcatgaccgaatggggctccgacatcgtcaaccacttccacctaggagacgacatggaccccgaactccgcaccctcgcccaaagcctgatcgaccaaaaagtcaaagaaatatcaaaccaagaaccccttaaaatctaa

SEQ ID NO: 8023 - RNA, 1293 nt, synthetic construct
  misc_feature 1..1293: note = derived and/or modified CDS sequence (opt11) from TULV__AF017659.1__N
  source 1..1293: mol_type = other RNA
atgagccaactcaaagaaatacaagaagaaataacccgccacgaacaacaaatagttatcgcacgccaaaaactcaaagacgcagaaaagaccgtcgaagcagaccccgacgacgtcaacaaatccacactccaaagccgacgagccgcagtctccgcacttgaagacaaactagccgacttcaaacgccaactcgccgacctcgtatcatcccaaaagatgggcgaaaaacccgtagacccaacaggcctcgaacccgacgaccacctaaaagaacgctcctccctaagatacggtaacgtcctcgacgtcaacgcaatcgacatcgacgaaccctcaggccaaaccgccgactggttttccatcggtcaatacattatcggcttcgccctcgcaatcgtcctaaaagccctatacatgctctccacacgcggccgccaaaccatcaaagaaaataaaggcacacgcatacgcttcaaagacgactcatccttcgaagaaatcaacggcatcagacggcccaaacacctctacgtcagcatgcccaccgcacaatcaaccatgaaagccgacgaactcacacccggccgattccgcacaatcgtatgcggcctgttcccggcccagatcatgcaccgtaacatcatctcaccggtaatgggggtcataggcttcagcttcttcgtcaaagactggcccgagaaaatagaagagttccttataaaaccatgccccttcctcaagaaacaaggagcccccggaaaagaagaagatttcctggtcagcaacgacgcctatctcctcggccgcgaaaaagccctccgagaatcccacctcgccgaaatcgacgacctcatcgacctcgccgcctcaggcgacccaacaccaccagacagcataaaatccccacaagccccctgggtcttcgcctgcgctcccgaccgatgccctccaacctgcatctacgtcgccggcatggcagaactaggcgcattcttctccatactccaagacatgcgcaacaccataatggcctctaaaaccgtaggcaccgccgaagaaaaactcaaaaagaaatcatccttctaccaatcatacctccgccgaacccaatccatgggcatccaactcgaccaacgcatcatcctcctcttcatgaccgaatggggctctgacatcgtgaaccacttccacctcggcgacgacatggaccccgaactccgaaccctagcccagtccctcatcgaccaaaaagtcaaagaaatctccaaccaagaaccactaaagatatag

SEQ ID NO: 8024 - RNA, 1293 nt, synthetic construct
  misc_feature 1..1293: note = derived and/or modified CDS sequence (opt11) from TULV(Lodz-1)__AF063892.1__N
  source 1..1293: mol_type = other RNA
atgaccgaactcaaagaaatacaagaggaaatcacccgccacgaacaacaaatcgtcatcgccagacaaaaactcaaagacgcagagaaaaccgtcgaagccgaccccgacgacgtaaacaaatccaccctccaatcacgccgcgccgccgtatccgccctcgaagacaaactcgccgacttcaaacgccaactcgctgacctcgtctcctcccagaaaatgggcgaaaaaccagtcgacccaaccggactcgaacccgatgaccacctcaaagaacgctcctctctccgttacggcaacgtcctcgacgtcaacgccatagacatcgatgaaccctccggccaaaccgccgactggttctccatcggacaatacatcatgggcttcgcactggccatcgtcctcaaagccctttacatgttatccacacgcggacgccaaaccataaaagagaacaaaggaacccgcatccgcttcaaagacgactccagctacgaagaaataaacggcatccgccgccccaaacacctctacgtctccatgcccaccgcccaatccactatgaaggccgacgaactcaccccaggccgcttccggaccatcgtatgcggactcttccccgcccagatcatgcaccgcaacatcatctcccccgtcatgggcgtaatcggcttcagctttttcgtcaaagactggcccgacaaaatcgaagagttcctaatcaaaccctgccccttcctaaagaaacaaggcggcccaaataaagacgaagagttcctcgtaagcaacgacgcctacctactcgggcgtgaaaaagccctcagagaatcacacctcgcggaaatcgacgacctaatcgacctcgcggcctccggcgacccaacaccccctgactcaatcaaatccccacaagcaccctgggtcttcgcctgcgccccagaccgctgcccaccaacctgcatctacgtcgccggaatggccgaactaggagcattcttctccatcctccaagacatgcgcaacaccatcatggccagcaaaaccgtcggcaccgcagaagaaaaactaaagaagaaaagctcattctaccaatcctacctacgccgaacccaaagcatgggaatccaactcgaccagcgcataatattactattcatgatggaatggggatccgacatcgtaaaccactttcacctcggcgacgacatggaccccgaacttcgaaccctcgcacagtcactcatagaccaaaaagtaaaagaaatatcaaaccaagaacccctcaaaatataa

SEQ ID NO: 8025 - RNA, 1293 nt, synthetic construct
  misc_feature 1..1293: note = derived and/or modified CDS sequence (opt11) from TULV(Lodz-2)__AF063897.1__N
  source 1..1293: mol_type = other RNA
atgactgaacttaaagaaatacaagaagaaatcacccgccacgaacaacaaatagtcatcgcgcgccaaaaactcaaagacgccgagaaaaccgtcgaagcagaccccgacgacgtaaacaaaagcaccttacaatcacgctgggccgcagtctccgccctagaagacaaactcgccgacttcaaacgccagctagccgacctagtcagctcccagaaaatgggcgaaaagccagtagacccaaccggcctcgaacccgacgaccaccttaaggaacgctcctcactccgatacggcaacgtcctcgacgtcaacgccatcgacatagacgaaccatctggccaaacagccgactggttctccataggccaatacatcatgggcttcgcactcgcaatagtactcaaagccctctacatgctatccacacgcggccgccaaacgatcaaagaaaacaaaggaacgcgcatccgattcaaagacgacagctcctacgaagaaatcaacggcatccgacgacccaaacacctctacgtctccatgcccacagcacaatccaccatgaaagcagacgaactcacccccggcagattccgaacaatcgtctgcggactcttccccgcccaaatcatgcaccgcaacataatctcccccgtcatgggcgtcatcggattcagcttcttcgtcaaagactggcccgacaaaatcgaagagttcctcatcaaaccatgccccttcctaaagaaacaaggcgggcccaacaaagacgaagagttcctagtcagtaacgacgcctaccttcttggacgagaaaaagcactacgcgaatctcacctggcagaaatagacgacctaattgacctcgccgcctcaggcgaccctacaccgcccgactccatcaaatccccacaagccccatgggtcttcgcctgcgcgccggaccgctgcccacccacatgcatctacgtcgccggaatggcagaactcggcgcattcttctccatactccaagacatgcgcaacaccataatggcctcaaaaaccgtaggcaccgccgaagaaaaactcaaaaagaaatccagcttctaccaatcctacctccgccgcacacaatccatgggcatccaactagaccaacgcatcatcctcctcttcatgatggaatggggctcagacatcgtcaaccacttccacctaggagacgacatggaccccgaactacgaacactcgcccaatccctaatagaccaaaaagtaaaagaaatatcaaaccaagaacccctcaaaatataa

SEQ ID NO: 8026 - RNA, 1449 nt, synthetic construct
  misc_feature 1..1449: note = derived and/or modified CDS sequence (opt11) from CCHFV(IbAr10200)__NC_005302.1/U88410.1__N
  source 1..1449: mol_type = other RNA
atggaaaacaaaatcgaagtgaacaacaaagacgaaatgaaccgctggttcgaagagttcaagaaaggaaacggacttgtagacaccttcacaaactcctacagcttctgcgaatcagtaccaaacctagaccgattcgtcttccaaatggccagcgccacagacgacgcgcaaaaagactcaatatacgcctcggccctagtcgaagccaccaaattctgcgcgcccatctacgaatgcgcctgggtatcctcaacagggatcgtgaagaaaggcctagaatggttcgagaaaaacgccggaaccataaaaagctgggacgaatcctacacagaattaaaagtagacgtacccaaaatcgaacaactaaccggctaccaacaagccgccctgaaatggcgaaaagacataggcttccgagtaaacgcaaacacagcagcgctctccaacaaagtcctagcagaatacaaagtccccggcgaaatcgtaatgtcggtcaaggaaatgctatccgacatgatccgacgcagaaacctaatcctcaaccgcggaggcgacgaaaacccacgcggaccagtctcccacgaacatgtcgactggtgtcgcgagttcgtcaaaggcaaatacatcatggccttcaatccgccgtggggcgacatcaacaaaagcggcagaagcggaatcgccctcgtcgccaccggactcgccaagctagcagaaacggaaggcaaaggcatcttcgacgaagccaagaaaacagtagaagccctaaacggctacctagacaaacacaaggacgaagtagaccgcgcgagcgcagactccatgataacaaacctcctcaaacacatagccaaagcacaagaactctacaaaaacagcagcgccctccgagcacaatcagcccaaatcgacaccgcattctccagctactactggctatacaaggcaggcgttacccccgaaaccttcccaaccgtcagccaattcctcttcgaactcggcaaacaaccccggggcacgaaaaagatgaagaaagcgctcctctccacaccaatgaaatggggaaagaaactatacgaactattcgccgacgactcgttccaacaaaaccgtatctacatgcaccccgcagtcctcaccgccgggcgcatctccgaaatgggagtatgcttcggcacaatccccgtcgcaaaccccgacgacgccgcacaaggatcaggacacaccaaaagcatactcaacctcagaaccaacaccgaaaccaacaacccatgcgccaaaacaatcgtaaaacttttcgaagtccagaaaaccggcttcaacatccaagacatggacatcgtcgcttccgaacacctcctacaccagagcctcgtcgggaaacaaagcccgttccaaaacgcgtacaacgtaaaaggcaacgcaacatcagccaacataatctaa

SEQ ID NO: 8027 - RNA, 1449 nt, synthetic construct
  misc_feature 1..1449: note = derived and/or modified CDS sequence (opt11) from CCHFV(Turkey-Kelkit06)__GQ337053.1__N
  source 1..1449: mol_type = other RNA
atggaaaacaaaatagaagtaaactccaaagacgaaatgaacaaatggttcgaagagttcaagaaaggcaacggactcatggacacattcacaaactcgtactcattctgcgaaaacgtaccaaacctagacaaattcgtcttccaaatggcaagcgcaaccgacgacgcccagaaagactcaatctacgcctcagccttagtcgaagcaaccaaattctgcgcacccatctacgaatgcgcctgggtcagctcaaccggcatagtcaagaaaggcctcgaatggttcgaaaaagacagcgggaccatcaaaagctgggacgaaaactacgccgaactgaaagtggacgtccccaaaatagaacaactcgctaactaccaacaagccgcactaaaatggcgcaaagacatcggtttccgcgtgaacgccaacacagccgccctctcaaacaaagtcctggcagaatacaaagtcccgggcgagatagtaatgtccgtcaaagaaatgctctccgacatgatccgacgcagaaacctaatcctgaaccgcggaggagacgaaaacccccgaggacccgtgagcagagagcacgtcgaatggtgccgcgagttcgtaaaaggcaagtacatcatggcattcaatcccccttggggcgacatcaacaaatcgggcagaagcgggatcgccctcgtcgccaccggcctcgccaaactcgccgaaacagaaggcaagggggttttcgacgaagccaagaaaacagtcgaagccctgaacgggtacctcgacaaacacagagacgaagtagacaaagccagcgccgactcaatgatcaccaacctccccaaacacattgccaaagcgcaagaactctacaaaaacagcagtgccctccgcgcccaaggcgcccaaatagacacaccattcagcagcttctactggctgtacaaagcgggtgtcacaccggaaacattccccaccatctcacagttcctctttgaactaggcgagcaaccacgcggcaccaagaaaatgaagaaagcactcctcagcacaccaatgaaatggggcaagaaactctacgaactattcgccgacgactccttccaacaaaaccggatctacatgcacccagccgtactcacagcaggacgcataagcgaaatgggggtctgcttcgggacaatacctgtggcaaaccccgacgacgccgcccaaggctcaggccacaccaaaagcatcctaaacctcaggacatccaccgaaaccaataacccatgcgcaaaaacaatcgtcaaactattcgaaatccaagaaacaggcttcaatattcaagacatggacatagtggccagcgaacacctacttcaccaaagcatagttggcaaacaatcccctttccagaacgcgtacaacgtcaaaggaaacgcaacgtccgcaaacatcatatga

SEQ ID NO: 8028 - RNA, 1449 nt, synthetic construct
  misc_feature 1..1449: note = derived and/or modified CDS sequence (opt11) from CCHFV(Baghdad 12)__AJ538196.1__N
  source 1..1449: mol_type = other RNA
atggaaaacaaaatagaggtcaactccaaagacgaaatgaataaatggttcgaagagttcaagaaaggcaacggcctagtcgacacatacaccaactcgtacagcttctgcgaatcagtgccgaacctcgaccgcttcgtcttccaaatggcaggagccacagacgatgcccaaaaagacagcatctacgcctccgccctcgtcgaagccaccaaattctgcgcaccgatttacgaatgcgcctgggccagctcaaccggcatcgtaaagaaaggcctagaatggttcgagaaaaacaccggcaccataaaatcctgggatgaatcatacacggaactaaaagtggaagtccccaaaatcgaacaactgttcaactaccaacaagcggcactcaaatggcggaaagacatcggcttccgagtcaacgccaacacagccgccctatccaacaaagtcctggccgaatacaaagtcccaggcgaaatagtgatgtccgtcaaagaaatgctttccgacatgataagacgacgcaacctaatactaaaccgcggcggtgacgaaaacccacgaggaccagtcagccgagaacacgtcgaatggtgccgcgagttcgtcaaaggcaaatacataatggcattcaacccaccctggggcgacataaacaaatcaggccgatcaggtatcgcactcgtcgcaacaggactagcaaaactcgcagaaaccgaagggaaaggcgtcttcgacgaagccaagaaaaccgtcgaagcactaaacgggtacctagacaaacacaaagacgaagtcgacaaagcctcagcagacaacatggtcaccaacctactcaaacacgtagccaaagcccaggaactctacaaaaactccagcgctctacgagcccaaggggcccaaatcgacaccgtattcagcagctactactggctctacaaagccggcgtaacccccgaaaccttccccaccgtatcccaattcctattcgagctcggcaaacaccccagaggcaccaaaaagatgaagaaagccctactcagcaccccaatgaaatggggcaagaaactctacgaactcttcgcagacgacagcttccaacaaaaccgaatatacatgcaccccgcggtactcaccgcgggccgaatcagcgaaatgggcgtctgcttcggaaccatccccgtagcaaaccccgacgacgcagcgctcggctcaggccacaccaagagcatcctcaacctccgcaccaacaccgagaccaacaacccatgcgcccgcacgatcgtaaaactcttcgaaatacagaaaaccggcttcaacatccaacacatggacatagtcgccagcgaacacctcctgcaccaatccctagtaggaaaacagagcccgttccaaaacgcatacaacgtcaaaggcaacgcaacatccgccaacataatctaa

SEQ ID NO: 8029 - RNA, 1449 nt, synthetic construct
  misc_feature 1..1449: note = derived and/or modified CDS sequence (opt11) from CCHFV(SR3)__AJ538198.1__N
  source 1..1449: mol_type = other RNA
atggaaaacaaaatagaagtcaactccaaagacgaaatgaacaaatggttcgaagagttcaagaaaggcaacggactcgtcgacacattcacaaactcctactccttctgcgaatctgtccccaacctagaccgcttcgtattccaaatggctagcgcaaccgacgacgcccaaaaagactccatatacgcctccgccctcgtcgaagccaccaaattctgtgcgccaatatacgaatgcgcctgggcaagctccacagggattgtcaagaaaggcctagaatggttcgagaaaaacgccggaactatcaaatcgtgggacgaatcatacaccgaactgaaagtcgaagtgcccaaaatcgaacaactctctaactaccagcaagccgccctaaaatggcgcaaagacataggcttccgggtaaacgccaacaccgccgccctctccaacaaagtgctcgccgaatacaaggtacccggcgagatcgtcatgtcagtcaaagaaatgctatccgacatgatcagacgaagaaacctcatcctgaacagaggcggagacgaaaacccccgagggccagtaagccgagaacacgttgaatggtgccgcgagttcgtaaaaggaaaatacatcatggccttcaatccgccctggggagacatcaacaaatcgggccgcagcggcatcgccctcgtggctaccggactcgccaaactcgccgaaaccgagggcaaaggagtcttcgacgaagccaagaaaacagtagaagccctcaacgggtacctggacaaacacaaagacgaagtcgacaaagctagcgcagactccatgataaccaacctactcaaacacatcgccaaagcccaagaactatacaaaaacagctcggccctacgcgcccagggcgcccaaatcgacacagtcttctcctcctactactggctctacaaagccggcgtcaccccagacaccttcccggccgtaagccaattcctattcgaactaggcaaacaacccagaggcacaaagaaaatgaagaaagccctcctcagcacacccatgaaatggggtaagaaactctacgaactattcgccgacgactcgttccagcaaaacagaatatacatgcaccccgcagtactcacggccggccgaatatccgaaatgggcgtctgcttcggcacaatccccgtcgcaaaccccgacgacgcagccctaggctcaggccacaccaaaagcatcctaaacctccgcaccaacaccgaaacgaacaacccctgcgcaaaaaccatcgtaaaactcttcgagatacagaaaaccggcttcaacatacaagacatggacatcgtcgcctcagaacacctcctccaccaaagcctagtaggcaaacaatccccgttccagaacgcctacaacgtaaaaggcaacgccacaagcgcaaacatcatctaa

SEQ ID NO: 8030 - RNA, 1449 nt, synthetic construct
  misc_feature 1..1449: note = derived and/or modified CDS sequence (opt11) from CCHFV(Gaib)__KX013446.1__N
  source 1..1449: mol_type = other RNA
atggaaaacaaaatagaagtaaacaacaaagacgaaatgaacaaatggttcgaagagttcaagaaaggcaacggcctcgtggacacattcaccaactcatatagcttctgcgaatcagtcccaaacctagacaggttcgtattccagatggcatcagcaaccgacgacgcccaaaaagactcgatatacgcctcagccctagtagaagcaacaaaattctgcgcaccaatatacgaatgcgcatgggtaagctccaccggaatagtaaagaaaggactagagtggttcgagaaaaacgccggaacaatcaaatcatgggacgaaagctacaccgaactaaaagtggaagtaccaaaaatcgagcaactggcaaactaccaacaagccgccctgaaatggcgaaaagacatcggattccgggtaaacgccaacacagccgcactaagccacaaagtactagccgaatacaaagtccccggcgaaatcgtcatgagcgtaaaagagatgctatccgacatgatccggcgcagaaacctcatcctcaaccgcggcggagacgaaaacccacgaggccctgtcagcagagaacacgtagaatggtgcagagagttcgtaaaaggaaaatacatcatggccttcaacccgccctggggagacatcaacaaatccgggcgctcaggcatcgcactcgtagccaccggactcgccaaactagcggaaaccgaagggaaaggagtcttcgacgaagcaaagaaaacagtagaagccctcaacggctacttagacaaacacaaagacgaagtcgacaaagcctccgccgacaacatgattaccaacctactgaaacacattgccaaagcacaagaactatacaaaaactcatcggcactcagagcacaaggagcccaaatcgacactgccttcagctcctactactggctctacaaagccggcgtcaccccagaaacattccccacagtcagccaattcctcttcgaactcggtaaacaaccccgcggcacaaagaaaatgaagaaagccttactctccaccccaatgaaatggggcaagaaactctacgaactattcgccgacgactccttccaacaaaaccggatctacatgcacccagcagtcctgacggcaggccgtatcagcgaaatgggcgtgtgcttcgggacaatcccagtcgccaaccccgacgacgccgcccaaggcagcggccatacaaaaagcatactcaacctacggaccaacaccgaaaccaacaacccctgcgccaaaacaatcgtaaaattgttcgaaatccagaaaaccggcttcaacatccaagacatggacatcgtagcaagcgaacacctcctgcaccaaagcctggtcggaaaacaaagccccttccagaacgcatacaacgtaaaaggcaacgcgacctccgcaaacatcatctaa

SEQ ID NO: 8031 - RNA, 1449 nt, synthetic construct
  misc_feature 1..1449: note = derived and/or modified CDS sequence (opt11) from CCHFV(Hodzha)__KX013449.1__N
  source 1..1449: mol_type = other RNA
atggaaaacaaaatagaagtcaacaacaaagacgaaatgaacaaatggttcgaagagttcaagaaaggcaacgggctggtcgacacattcacaaacagctactccttctgcgaatccgtccccaacctcgacagattcgtcttccaaatggcctcagccaccgacgacgcccaaaaagactccatctacgcttccgccctagtagaagcaacaaaattctgcgctcccatatacgaatgcgcctgggtaagctccaccggcatcgtaaagaaaggcctcgaatggttcgagaaaaacgccggcaccatcaaatcctgggacgaatcatacaccgaactcaaagtcgaagtccccaaaatcgaacagctggccaactaccaacaagccgccctgaaatggcgcaaagacatcggcttctgcgtaaacgccaacacagcagccctatcccaaaaagtcctctcagaatacaaagtccccggcgaaatcgtaatgtcagtcaaagaaatgctctccgacatgatccgccgccgaaatctcatcctaaatcgcggcggggacgaaaacccaagaggccccgtatcccgcgaacacgtcgaatggtgccgagagttcgtaaaaggaaaatacataatggccttcaacccaccctggggagacatcaacaagagcggccgatccggcatcgccctagtagcaacaggcctagccaaacttgcggaaaccgaagggaaaggcgtcttcgacgaagcaaagaaaaccgtcgaagccctaaacggctacctagacaaacacaaagacgaggtggacaaagccagcgcggacaacatgaccaccaacctcctaaaacacatcgcgaaagcacaagaactctacaaaaacagctccgctctacgcgcacaaggggcccagatcgacaccgccttctcaagctactactggctatacaaagcaggcgtcacccccgaaaccttccccaccgtcagccaattcctcttcgaactcggaaaacaaccccgcggcaccaaaaagatgaagaaagccctactcagcacgcccatgaaatggggcaagaaactctacgaactcttcgccgacgacagcttccaacaaaaccgaatatacatgcaccccgccgtcctcaccacaggacgaatctccgaaatgggcgtctgcttcggaaccgtccccgtcgctgaccctgacgacgccgcccaaggatccggacacaccaaaagcatactaaaccttcggaccaacacagaaacgaacaacccatgcgccaaaaccatcgtaaaactcttcgaaatccagaaaaccggcttcaacatccaagacatggacatcgtcgccagcgaacaccttctccaccaaagcctcgtaggaaaacaatcccccttccaaaatgcatacaacgtaaaaggaaacgccacctccgcgaacattatataa

SEQ ID NO: 8032 - RNA, 1449 nt, synthetic construct
  misc_feature 1..1449: note = derived and/or modified CDS sequence (opt11) from CCHFV(IbAn7620)__KX013452.1__N
  source 1..1449: mol_type = other RNA
atggagaacaaaatagaagtaaacaacaaagacgaaatgaaccgatggttcgaggaattcaaaaaagaaaacggactcgtcgacaccttcacgaactcccactccttctgcgaatccgtccccaacctcgacaaattcgtcttccaaatggcctccgccaccgacgacgcgcagaaagactcgatctacgccgccgcactagtcgaagccacaaaattctgcgcaccaatatacgaatgcgcctgggtatcatccactggcatagtcaaaaaaggcctcgaatggttcgaaaaaaacgcaggcacaataaagagctgggacgagagctacaccgaactgaaagtcgaagtacccaaaatcgaacaactctcaaactaccaacaagcagccctcaaatggagaaaggacatagggttcagagtcaacgccaacaccgctacactatcacacaaagtcctcgccgaatacaaggtcccaggcgaaatcgtcatgtccgtaaaagagatgctctcagacatgatccgccgccgaaacctcatcctaaacagaggcggagacgaaaaccccagaggccccgtatcccgcgaacacgtcgaatggtgccgcgaattcgtcaaaggaaaatacatcatggcctttaacccgccctggggagacatcaacaaatcaggacgcagcggcatagcccttgtagcaaccggactagccaaactcgcagaagccgaaggtaaaggcgtattcgacgaagcaaaaaaaaccgtagaagcactcaacggctacctcgacaaacacaaagacgaagtagacaaatcatcggcagactccatgatcacaaacctgctcaaacacatcgccaaagcccaagaactgtacaaaaactcctcggccctccgcgcccaaggagcccaaatcgacaccgcattctcctcatactactggctctacaaagccggagtcaccccggaaaccttcccaacagtctcccaattcctcttcgaactaggcaaacaaccccgcggaaccaaaaaaatgaaaaaagcacttctatcaacccccatgaaatggggcaaaaaactttacgaactcttcgcagacgattccttccagcagaaccgcatctacatgcaccccgccgtcctcaccgccggccgaatatccgaaatgggagtatgcttcggcaccatccccgtagccaaccctgacgacgcggccctaggctcaggacataccaaatccatactaaacctacgcacatcaacagaagccaacaacccgtgcgccaaaaccatcgtcaaactcttcgaaatacaaaaaaaaggcttcgtaataaaagacatggacatcgtcgcctccgaacacctactacaccagagcctcgttggcaaacagtcccccttccaaaacgcatacaatgtcaaaggcaacgccacatccgctaacataatctga

SEQ ID NO: 8033 - RNA, 1449 nt, synthetic construct
  misc_feature 1..1449: note = derived and/or modified CDS sequence (opt11) from CCHFV(K128_76)__KX013455.1__N
  source 1..1449: mol_type = other RNA
atggaaaacaaaatcgaagtcaacaacaaagacgaaatgaacaagtggtttgaagagttcaagaaaggcaacgggctcgtcgacaccttcaccaactcctactcattctgcgaatcagtcccctccctagatcgcttcgtcttccaaatggccagcgccaccgacgacgcccaaaaagactccatctacgcctcagccttagtagaagccacaaaattctgcgcccccatatacgaatgcgcatgggtaagctcaacaggcatcgtaaagaaaggactagaatggttcgagaaaaacgccggaacaataaaaagctgggacgaatcctacacggagctgaaagtggaagtacccaaaatagaacaactggccaactaccagcaagcagccctcaaatggcgaaaagacattggcttccgcgtaaacgccaacactgccgcactctcacacaaagtcctcgccgagtacaaagtcccaggcgaaatcgtaatgtcagtaaaagaaatgctctcagacatgatcaggagaagaaacctgatcctaaaccgcggcggagacgaaaacccacgaggacccgtcagcagagagcacgtcgagtggtgccgcgagttcgtgaaaggcaaatacatcatggccttcaatccaccctggggagacatcaacaaatccggccgatcaggaatcgccctcgtagcgacaggcctagccaaactagccgaaaccgaaggcaaaggcgtcttcgacgaagccaagaaaacagtcgaagcactaaacggatacctcgataaacacaaggacgaagtcgacaaggccagcgcagacaacatgataaccaacctcctcaaacacatcgcaaaagcccaagaactatacaagaactcctcagcgctcagagcacaaggagcccaaatagacacagccttctcctcctactactggctctacaaagccggggtaacacccgaaaccttccccacagtcagccaattcctcttcgaactaggaaaacaaccccgaggaaccaagaaaatgaagaaagcactcctctccaccccgatgaaatggggcaagaaactatacgaacttttcgcggacgactctttccaacagaacagaatatacatgcaccccgccgtgctaacagccggccgcatctcagaaatgggcgtatgcttcggaaccataccagtcgccaaccccgacgacgccgcccaaggttccggccacaccaaatccatcctcaacctacgaacaaacacagagacaaacaacccatgcgcaaaaacaatagtaaaattgttcgaaatccaaaagacaggtttcaacatacaggacatggacatagtcgcctccgaacacctactccaccaaagcctagtaggaaaacaaagccccttccaaaacgcgtacaacgtaaagggaaacgccaccagcgccaacatcatctaa

SEQ ID NO: 8034 - RNA, 1449 nt, synthetic construct
  misc_feature 1..1449: note = derived and/or modified CDS sequence (opt11) from CCHFV(K168_125)__KX013461.1__N
  source 1..1449: mol_type = other RNA
atggagaacaaaatagaagtgaacaacaaagacgagatgaacaaatggttcgaagaattcaaaaaagggaacggactcgtagacacattcaccaactcgtactccttctgcgaatcagtcccgaacctcgacagattcgtattccaaatggcaagcgcaaccgacgacgcacaaaaagactcaatctatgcaagcgccctagtcgaagcaacaaaattttgcgccccaatatacgaatgcgcctgggtatcctccaccgggatcgtcaaaaaaggcctagaatggttcgagaaaaacgctggaaccatcaaatcatgggacgagtcatacacggaactcaaagtcgaagtcccaaaaatcgaacaactcgccaactaccaacaggccgccctgaaatggcggaaagacataggcttccgcgtcaacgcaaacacagccgccctctcacacaaagtcctggccgagtacaaagtccccggcgacatcgtcatgtccgtcaaagagatgctctccgacatgatccggcgccgtaacctcatcctaaaccgaggcggagacgaaaacccacgaggccccgttagccgagaacacgtcgaatggtgcagagaattcgtaaaaggcaaatacataatggccttcaaccccccctggggcgacatcaacaaatccggacgaagcggaatcgccctcgtcgccactggactcgccaaactcgccgaaaccgaaggaaaaggcgtcttcgacgaagccaaaaagacagtcgaagccctcaacggatacctcgacaaacacaaggacgaagttgacaaagcgagcgcagacaacatgattaccaacctcctcaaacacatcgccaaagcacaagaactctacaaaaactcctccgccctccgcgcacaaggtgcccaaatcgacaccgcattctcatcctactactggctatacaaagcgggtgtcacctcagaaacgttccccaccgtctcccaattcctcttcgagctcggaaaacaacctaggggcaccaaaaaaatgaagaaagcactactttccacccccatgaaatggggcaaaaaactctacgaactattcgccgacgactccttccaacaaaaccgcatctacatgcacccagccgtgcttacggccggccgaataagtgaaatgggagtctgcttcggaacaatacccgtcgccaaccccgacgacgcagcccaaggatcaggacacacaaaaagcatcctaaacctaagaacaaacaccgagaccaataacccctgcgccaaaaccatagtcaaactattcgaaatccaaaaaaccggattcaacatccaagacatggacatcgtagcctcagaacacctcctccatcaaagcctcgtcggaaaacagagcccattccagaatgcgtacaacgtgaagggcaacgcaacgtcagccaacatcatctaa

SEQ ID NO: 8035 - RNA, 1449 nt, synthetic construct
  misc_feature 1..1449: note = derived and/or modified CDS sequence (opt11) from CCHFV(K168_40)__KX013458.1__N
  source 1..1449: mol_type = other RNA
atggaaaacaaaatcgaagtcaacaacaaagacgaaatgaacaaatggttcgaagagttcaaaaaaggaaacggactcgtagacacattcaccaactcatactcattctgcgaatccgtaccaaacctagaccgattcgtcttccaaatggcaagcgccaccgacgacgcacaaaaagactcaatctacgcctcagccctcgtcgaggccaccaaattctgcgcgcccatatacgaatgcgcctgggtcagctccaccggcatcgtaaaaaaaggcctcgaatggttcgaaaaaaacgccggcacaatcaaatcctgggacgaaagctacacagaactgaaggtagaagtacccaaaatcgaacaactcgccaactaccaacaagctgcactgaaatggcgcaaagacataggcttcagagtgaacgccaacaccgccgccctttcccacaaagtcctagcagaatacaaggtaccaggcgatatcgtcatgtcagtcaaagaaatgctatccgacatgatcagacgccgcaatctaatcctaaaccgcggcggggacgaaaacccccgaggcccagtaagccgagaacacgtagagtggtgccgagaatttgtcaaaggaaactacataatggcattcaacccaccatggggcgacatcaacaaatcaggcagaagcggcatagcccttgtagccaccggcctagcaaaactcgcagaaaccgaaggcaaaggcgtattcgacgaagccaaaaaaacagtcgaagcccttaacggctacctagacaagcacaaagacgaagtcgacaaagcgagtgcagacaatatgatcaccaacctcctgaaacatatcgccaaagcccaagaactctacaaaaacagctcagccctacgggcccaaggcgcccaaatcgacacagccttctccagttattattggctatacaaagccggcgtaaccagcgaaaccttcccaaccgtcagccaattcctattcgaactcggcaaacaaccccgaggcacaaaaaaaatgaaaaaagcactactatcaacacccatgaaatggggaaaaaagctctacgaactattcgcagacgactccttccaacaaaaccgaatctacatgcaccctgccgtactcaccgccggccgaatctccgaaatgggagtctgcttcggcaccatccccgtcgcaaatccagacgacgccgcacaaggaagcggccacaccaaatcaatcctcaatctccgtaccaatacggaaaccaataacccgtgcgcaaaaaccatcgtcaaactattcgaaatacaaaaaaccggcttcaacatccaagacatggacatcgtagcatccgaacacttactccaccaatccctcgtaggcaaacaaagcccattccaaaacgcctacaacgtcaaaggcaacgccacaagcgcaaacataatctaa

SEQ ID NO: 8036 - RNA, 1449 nt, synthetic construct
  misc_feature 1..1449: note = derived and/or modified CDS sequence (opt11) from CCHFV(K323_27)__KX013473.1__N
  source 1..1449: mol_type = other RNA
atggaaaacaaaatcgaagtcaactccaaagacgaaatgaacaaatggttcgaagagttcaagaaaggcaacggcctcatggacacattcacaaactcctactccttctgcgaaaacgtacccaacctagacaaattcgtcttccaaatggcaagcgccaccgacgacgcccaaaaagactccatctacgcatcagccctcgtcgaagccacgaaattttgcgcgcccatctacgaatgcgcctgggtatcatccaccggtatcgtcaagaaaggcctagaatggttcgagaaaaactcaggcaccatcaaatcatgggacgaaaactacgcagaactcaaagtcgacgtccccaaaatcgaacaactagccaactaccaacaagccgccctcaaatggcgcaaagacatcggattccgagtcaacgccaacacagccgcgctctcaaacaaagtcctagcagaatacaaagtccccggcgagatagtcatgtccgtaaaagaaatgctctccgacatgatccgccgacgaaacctcatcctcaaccgaggcggcgacgaaaacccacgaggacctgtcagccgagaacacgtagaatggtgccgcgagttcgtaaagggaaaatacatcatggccttcaatcccccatggggagacatcaacaaaagcggccgatccggcatcgcactcgtagccaccggcctggcgaaactagcagaaacagaaggcaaaggcgtcttcgacgaagcaaagaagacggtagaagccctcaacggctacctcgataaacacagagacgaagtcgacaaagcaagcgcagactccatgatcacaaacctactgaaacacatagccaaagcccaggaactatacaaaaacagctccgccctccgagcccaaggcgcccagatagacacaccattcagcagcttctactggctctacaaagccggcgtaacaccagaaaccttcccaaccatcagccaattcctattcgaactcggcaaacaaccaaggggcaccaaaaagatgaagaaagcactcctaagcacacccatgaaatggggaaagaaactatatgaactgttcgccgacgactccttccaacaaaaccgcatctacatgcacccagccgtactcaccgccggacgaatcagcgaaatgggcgtgtgcttcggcacgatccccgtggcaaaccccgacgacgccgcccagggctcaggccacaccaaaagcattctaaacctccgcacatccacggaaaccaacaacccatgcgcaaaaaccatcgtcaaactcttcgaaatacaaaagaccggcttcaacatccaagacatggacatcgtagcctccgaacacctcctgcaccagtccctagtaggcaaacagagcccattccaaaacgccttcaacgtcaaaggcaatgccacgtccgcgaacataatctaa

SEQ ID NO: 8037 - RNA, 1449 nt, synthetic construct
  misc_feature 1..1449: note = derived and/or modified CDS sequence (opt11) from CCHFV(Min)__KX013482.1__N
  source 1..1449: mol_type = other RNA
atggaaaataaaattgaagtcaactcaaaagacgagatgaacaaatggtttgaagaattcaagaaaggcaacggcctcatggacacgttcacgaactcctactccttctgcgaaaacgtcccaaacctcgacaaattcgtattccaaatggccagcgcaacggacgacgcacaaaaagactcaatctacgcctcagcactcgtagaagccacaaaattctgcgccccaatctacgaatgcgcatgggtatccagcacaggcatcgtcaaaaaaggcctagaatggttcgaaaaaaacagcggcaccatcaaatcatgggacgaaaactacgccgaactcaaagtcgacgtacccaaaatcgaacaactagccaactaccagcaagccgccctcaaatggcggaaggacataggcttccgcgtcaacgccaacacagcagccctatccaacaaagtcctcgccgaatacaaagtaccaggagagatcgtcatgtcagtcaaagaaatgctatccgacatgatccggcggcgcaacctcatactaaaccgcggcggcgacgaaaacccccgcggccccgtctcacgcgaacacgtcgaatggtgccgcgaattcgtcaaaggaaaatacataatggcattcaacccgccatggggcgacattaacaaactcggccgaagcgggatcgcactagttgccaccggactcgccaagctagccgaaacagaaggcaaaggcgtcttcgacgaggccaaaaaaacagtcgaagcactaaacggctacctcgacaaacaccgcgacgaggtcgacaaagcatccgccgactccatgatcacaaatctcctaaaacacatcgctaaagcccaagaactatacaaaaattcctcagcactacgagcacagggcgcccagatcgacacccccttctcctccttctactggctctacaaagccggcgtcaccccagaaaccttcccaaccataagccaattcctcttcgaactaggcaaacaacccagaggcacaaaaaaaatgaaaaaagccctcctatccacccccatgaaatggggcaaaaaactgtacgaactattcgccgacgactcattccaacagaaccgcatctacatgcaccccgcagtcctcacagccggccgcatatcagaaatgggcgtatgcttcggcacaatccccgtagcaaacccagacgacgccgcccaaggcagcggccacaccaaatcaatcctcaacctcagaacctcaaccgagaccaacaacccctgcgcaaaaaccatagtaaaactcttcgaaatccaaaaaacaggcttcaacatacaagacatggacatcgtggcttccgaacacctcctccaccaaagcctagtaggcaaacaatccccattccaaaacgcatacaacgtcaaaggcaacgcaacctccgctaacatcatataa

SEQ ID NO: 8038 - RNA, 1449 nt, synthetic construct
  misc_feature 1..1449: note = derived and/or modified CDS sequence (opt11) from CCHFV(Saf)__KX013488.1__N
  source 1..1449: mol_type = other RNA
atggaaaacaaaatcgaagtcaactccaaagacgaaatgaacaagtggttcgaagagttcaagaaaggaaacggcctcatggacaccttcacaaactcatactcattctgcgaaaacgtcccaaacctcgacaaattcgtcttccaaatggcctccgccacagacgacgcgcaaaaagactccatctacgcctctgccctagtcgaggccacaaaattctgcgctccaatctacgaatgcgcatgggtaagctccaccggcatcgtgaagaaaggcctagaatggtttgagaaaaacagcggaaccatcaaatcatgggacgaaaactacgcggaattaaaagtagacgtccccaaaattgaacaactcgcaaactaccaacaagcggccctcaaatggcgcaaagacatcggcttccgcgtaaacgccaacacagccgccctctcaaacaaagtcctcgccgaatacaaagtacccggcgaaatcgtcatgtcagtcaaagaaatgctatccgacatgatcagacgcagaaacctaatcctgaaccgcggcggagacgaaaaccccaggggacctgtatccagagaacacgtcgaatggtgccgcgagttcgtaaaaggcaaatatataatggcattcaacccgccctggggcgacatcaacaaaagcggccgatccggaatcgccctcgtggccacaggcctagcaaaactagccgaaacagaaggaaaaggggtattcgacgaagccaagaaaacagtcgaagcgttaaacggctacctagacaaacaccgcgacgaagtcgacaaagcaagcgcagacagcatgatcaccaacctactaaaacacatagcgaaagcccaggagctatacaaaaactcctccgccctccgcgcccaaggagcccagatcgacaccccattcagctcattttactggctctacaaagccggcgtaacccccgaaacatttcccaccataagccaattccttttcgaactcggaaaacaaccacgcggcaccaagaaaatgaagaaagcgctcctcagcacacccatgaaatggggaaagaaactctacgaactcttcgccgacgattcattccaacaaaaccgaatctacatgcacccggccgtcctcacagccggaagaatctcagaaatgggggtctgcttcggaacaatacccgtagcagacccagacgacgccgcacaaggctcgggccacacaaaaagcatacttaacctcagaaccagcacagaaaccaacaacccatgcgcacgcacgatcgtcaaactattcgaaatccagaaaacgggctttaacatccaagacatggacatcgtagcctccgaacacctactccaccaaagcctggtcggcaaacaaagcccattccaaaacgcgtataacgtcaaaggcaacgccaccagcgcaaacatcatctag

SEQ ID NO: 8039 - RNA, 1449 nt, synthetic construct
  misc_feature 1..1449: note = derived and/or modified CDS sequence (opt11) from CCHFV(UCCR4459)__KY484031.1__N
  source 1..1449: mol_type = other RNA
atggaaaacaaaatcgaagtcaacaacaaagacgaaatgaacaaatggttcgaagagttcaaaaagggcaacggactcgtcgacaccttcaccaactcctattcattctgcgaaagcgtcccgaacctcgaccgattcgtcttccaaatggcctcagccaccgacgacgcacaaaaagactcgatctacgcctcagccttagtagaagccaccaaattctgcgccccaatatacgaatgcgcctgggtcagctccacaggcatcgtaaagaaaggcctcgaatggttcgagaaaaacgcgggcacaatcaaaagctgggacgaaagctacaccgaactcaaagtagaagtcccaaaaatcgaacaactagcaggctaccaacaagccgccctgaaatggagaaaagacataggcttccgagtgaacgccaacaccgccgccctctcacacaaagtcctcgccgaatacaaagtacccggcgaaatagtcatgtcagtcaaagaaatgctctccgacatgatcagacgaagaaacctcatcctaaaccgcggaggagacgaaaatccccgtggaccagtatcccgagaacacgtagagtggtgtcgcgagttcgtaaaaggaaaatacataatggcattcaacccgccctggggcgacatcaacaaacttggccgcagcggaatagccctcgtcgccaccgggctcgccaaactcgccgaaaccgaaggaaagggagtattcgacgaagccaaaaagaccgtggaagcactaaacggctacctcgataaacacaaagacgaagtcgataaagcatccgcagataacatgatcaccaacctcctcaaacacatagccaaggcccaagaactctacaaaaacagctccgccctccgagcccaaggggcacaaatcgacaccgccttctcgtcatactactggctctacaaagctggagtgacccccgaaacattccccaccgtatcccaattcctattcgaactcggaaaacaaccccgaggcacaaagaaaatgaagaaagcactcctaagcacgcccatgaaatggggcaagaaactctacgaactcttcgcagacgactcctttcaacaaaatcgaatctacatgcacccagccgtcctaacagcaggccgaatatcagaaatgggcgtatgcttcggaaccatcccagtagcaaacccagacgacgccgcacaaggatccggccacaccaaatccatcctcaatctacgaaccaacacagaaaccaacaacccatgcgccaaaacaatcgtaaaactattcgaaatccaaaagacgggcttcaacatacaagacatggacatcgtagcaagcgaacacctcctccaccaaagcctcgtcgggaaacaatcacccttccaaaacgcctacaacgtaaaaggaaacgccacatcagccaacatcatctaa

SEQ ID NO: 8040 - RNA, 1449 nt, synthetic construct
  misc_feature 1..1449: note = derived and/or modified CDS sequence (opt11) from CCHFV(YL16070)__KY354080.1__N
  source 1..1449: mol_type = other RNA
atggaaaacaaaatcgaagtcaacaacaaagacgaaatgaacaagtggttcgaagagttcaagaaaggcaacgggctcgtcgacacattcaccaattcctactccttctgcgaatcggtcccaaacctggacagattcgtcttccaaatggccagcgccacggacgacgcccaaaaagactcaatctatgcctccgccctagtcgaagccacgaaattctgcgcccccatctacgaatgcgcgtgggtatcaagcactggcatagtgaagaaaggcctagaatggttcgagaaaaacgccgggacaataaaatcctgggacgaatcatacacagaactaaaagtcgaagtaccaaagatcgaacaactggccgactatcaacaagcagccctgaaatggcgcaaggacataggcttccgcgtgaacgcaaacaccacagccctctctcacaaagtcctcgccgaatacaaagtaccaggcgaaatcgtcatgtccgtcaaagaaatgctatccgacatgatccgccgcagaaacctgatcctcaacagaggcggagacgaaaacccacgcggcccagtcagcagggagcacgtcgagtggtgccgcgagttcgtaaaaggcaaatacatcatggccttcaatcctccctggggtgatataaataaaagcgggcgaagcgggatagcgctcgtggccacaggcctagccaaactcgccgaaacagaaggcaaaggggtcttcgacgaagctaagaaaacagtcgaagccctgaacggctacctaaacaaacacaaggacgaagtcgacaaagccagcgcagactcaatgatcaccaacctactaaaacacatcgcaaaagcacaagaactctacaaaaacagttcagccctacgcgcccaaggcgcccaaatcgacacagccttctccagctactactggctctacaaagcaggagtaaccccagaaaccttcccgaccgtatcacaattcctcttcgagctaggcaaacaaccacgaggcacaaagaaaatgaagaaagccctactaagcacacccctaaaatggggcaaacgactatatgaactcttcgcagacgactcctttcaacaaaaccgcatatacatgcaccccgccgtcctcaccgccggacgaatcagtgagatgggcgtctgtttcggaaccataccagtagccaaccccgacgacgccgcccaaggctcaggccacaccaaaagcatactaaacctcagaaccaacaccgaaaccaacaacccatgcgcaaaaaccatcgtaaaactcttcgagattcagaaaaccggcttcaacatccaagacatggacatagtggcctccgaacacctactacaccaatccctagtcggcaaacaaagccccttccaaaacgcatacaacgtaaagggcaacgcaacaagcgcaaacataatataa

SEQ ID NO: 8041 - RNA, 1449 nt, synthetic construct
  misc_feature 1..1449: note = derived and/or modified CDS sequence (opt11) from CCHFV(66019)__AJ010648.1__N
  source 1..1449: mol_type = other RNA
atggaaaacaaaatagaagtgaacaacaaagacgaaatgaaccgctggttcgaagaattcaaaaaaggtaacgggctagtagacaccttcaccaactcgtactcgttctgcgaatcagtccccaacctagacaggttcgtcttccagatggcaagcgcgaccgacgacgcacaaaaagacagcatctacgcctccgccctagtcgaagccacaaaattctgcgcacccatctacgaatgcgcctgggtcagcagcacaggcatcgtaaaaaaaggcctagaatggttcgaaaaaaacgcaggcaccataaagtcctgggacgagtcatacacagaactaaaagtagaagtccccaaaatagaacaactcgcttcataccaacaagccgcgctcaaatggagaaaagacataggattccgagtgaacgccaacacagcagccctctcacacaaagtcctcgcagaatacaaagtcccaggcgaaatcgtcatgtccgtgaaagaaatgctatccgacatgataagaaggcgcaacctcatcctaaaccgtggaggagacgaaaacccccgaggacccgtaagccgcgaacacgtagagtggtgccgagaattcgtcaaaggaaaatacatcatggccttcaaccccccatggggcgacatcaacaaatcaggaaggagcggaatagcactcgtggcaaccggactagccaaactcgcagaaacagaaggaaaaggagtcttcgacgaagccaaaaaaacagtcgaagccctcaacgggtacctggacaagcacaaagacgaggtcgacaaagccagtgccgacaacatgacaaccaacctcctgaaacacatagctaaagcgcaggaactatacaaaaacagcagcgccctacgggcacaaggcgcacagatcgacacagcattcagcagctactactggctctacaaagcgggcgtaacccccgaaaccttcccaaccgtcagccaattcctattcgaactcggcaaacaaccacgaggcacaaaaaaaatgaaaaaagcgctcctgtccacccccatgaaatggggcaaaaaactctacgaactcttcgccgatgactcgttccaacaaaaccgaatctacatgcacccagcagtactaaccgccgggcggataagcgaaatgggcgtctgctttggaaccatccccgtcgccgaccccgacgacgccgcccaaggctcaggacacacaaaaagcatcctcaacctcagaacaaacaccgaaacaaacaacccctgcgcaaaaacaatcgtaaaactgttcgaaatacagaaaaccggcttcaacatccaagacatggacatagtcgcatcagagcacctcctccaccaaagcctcgttgggaaacaaagcccattccaaaacgcatacaacgtcaaaggcaacgcaaccagtgccaacataatctag

SEQ ID NO: 8042 - RNA, 1449 nt, synthetic construct
  misc_feature 1..1449: note = derived and/or modified CDS sequence (opt11) from CCHFV(8402)__AJ010649.1__N
  source 1..1449: mol_type = other RNA
atggaaaacaaaatcgaagtaaacaacaaagacgaaatgaacaagtggttcgaagagttcaagaaaggcaacgggctcgtagacaccttcacaaactcatactccttctgcgaatctgtcccaaacctggaaagattcgtcttccaaatggccagcgccaccgacgacgcccaaaaagactcaatctacgcctccgccctagtagaagccacgaaattctgcgcaccaatatacgaatgcgcctgggtcagctccaccgggatcgtcaagaaaggcctcgaatggttcgaaaagaacgccggaaccataaaatcctgggacgaatcatacacggaactaaaagtcgaagtacccaaaatcgaacaactggccaactaccagcaggcggccctaaaatggcgaaaagacataggattccgcgtcaacgccaacacagccgccctctcgcacaaagtcctcgcagaatacaaagtcccaggcgaaatcgtcatgtcagtcaaagaaatgctctccgacatgatccgccgacgaaacctcatactcaacaggggcggagacgaaaacccacgaggccccgtaagccgcgaacacgtcgaatggtgccgcgagttcgtaaaaggcaaatacataatggcattcaacccgccctggggagatatcaacaaaagcggccgaagcggaatcgcacttgtcgcaacgggcctagccaaactcgccgaaacagaaggcaaaggagtattcgacgaagccaagaaaaccgtagaagcactcaacggatacctggacaagcacaaagacgaagtcgacaaagcaagcgcagacaacatgatcacaaacctcttcaaacacatagcgaaagcacaagaactctataaaaacctgtccgccctaggcgcacaaggagcacaaatcgacacagcattctcaagctactactggctctacaaagccggcgtaacgccagaaacattccccacagtaagccaattcttgttcgaacttggcaaacagccccgaggcacgaaaaagatgaagaaagcactcctgtccacaccaatgaaatggggaaagaaactctacgaactcttcgccgacgactccttccaacaaaaccgcatatacatgcaccccgccgtcctgacggcagggagaataagcgaaatgggagtatgctttggaaccatacccgtagcgaaccccgacgacgccgcgcaaggatcaggccacaccaaaagcatcctaaacctccgcaccaacacagaaaccaacaacccctgcgcgaaaaccatagtcaaactattcgaaatccagaaaaccggattcaacatacaagacatggacatagtcgccagcgaacacctcctccaccaaagcctagtcggcaaacaaagcccattccaaaatgcctacaacgtaaaaggcaacgcaaccagcgcaaacataatctaa

SEQ ID NO: 8043 - RNA, 1449 nt, synthetic construct
  misc_feature 1..1449: note = derived and/or modified CDS sequence (opt11) from CCHFV(Bul/HU517)__AY277676.2__N
  source 1..1449: mol_type = other RNA
atggaaaacaaaatagaagtaaactcaaaagacgaaatgaacaaatggttcgaagagttcaagaaaggcaacggcctcatggacaccttcacgaactcatactcattctgcgaaaacgtccccaacctagataaattcgtgttccaaatggccagcgcaaccgacgacgcacaaaaagactccatctacgccagcgccctcgtcgaagccacaaaattctgcgcccccatatacgaatgcgcctgggtcagctcaaccggaatcgtaaagaaaggcctagaatggttcgagaaaaactccggggccataaaatcatgggacgaaaactacgtcgaacttaaagtcgacgtacccaaaatagaacaactagccaactaccaacaagccgccctaaaatggcgaaaagacataggcttccgcgtcaacgcgaacaccgccgccctctccaacaaagtactagcagaatacaaagtccccggcgaaatcgtcatgtcggtcaaagaaatgctcagcgacatgatcagaagacgaaacctcatcctaaaccgcggcagcgacgaaaacccgcgcggacccgtctcacacgaacacgtagagtggtgtcgcgagttcgtcaaaggaaaatacatcatggccttcaatcccccatggggtgacatcaacaagtcaggccgcagcggcatcgccctcgtcgccaccggcctagccaagctcgccgaaacagaaggaaaaggagtcttcgacgaagccaagaaaacggtcgaagccctaaacggctacctagacaaacaccgagacgaagtcgacaaagccagcgccgactccatgataaccaacctcctcaaacacatcgcaaaagcacaagaactctacaaaaacagctcggccctccgcgcccaaggggcccaaatcgacaccccattctccagcttctactggctctacaaagcgggcgtcacacccgaaaccttccccacaatatcacagttcctcttcgaactaggaaaacagcctcgcggaaccaagaaaatgaagaaagcactactaagcacccccatgaaatggggaaagaaactctatgaactgtttgccgacgactccttccaacaaaaccgcatctacatgcacccagcagtgctcaccgccggccgaataagcgaaatgggcgtatgcttcggaacaatacccgtcgccaaccccgacgacgccgcccaaggcagcggccacacaaaatctattcttaaccttcgaacatccacagaaaccaacaacccctgcgcaaaaaccatagtgaaactatttgaaatccagaaaacaggctttaacatacaagacatggacatagtcgcctcagaacacctattacaccaatccctagtcggcaaacaaagccccttccaaaacgcatacaacgtcaaaggcaacgcaacaagcgccaacatcatataa

SEQ ID NO: 8044 - RNA, 1449 nt, synthetic construct
  misc_feature 1..1449: note = derived and/or modified CDS sequence (opt11) from CCHFV(V46/13)__KR011837.1__N
  source 1..1449: mol_type = other RNA
atggaaaataaaatcgaagtcaactctaaagacgaaatgaacaaatggttcgaagaattcaagaaaggaaacggcctaatggacaccttcacaaactcgtactccttctgcgaaaacgtccccaacctagacaaattcgtcttccaaatggccagcgcaacagatgacgcacaaaaagactccatctacgcctccgccctcgtagaagccaccaagttctgcgcccccatctacgaatgcgcatgggtcagctccacgggcatcgtaaaaaaaggactagaatggttcgaaaaaaacagcggcaccatcaaaagctgggacgaaaactacgccgaactcaaagtagacgttcccaaaatcgaacaactagccaactaccaacaagccgccctcaaatggcgaaaagacataggcttccgcgtcaatgcaaacaccgccgcactctcaaacaaagtcctcgccgaatacaaagtccccggcgaaatcgtaatgagcgtaaaagaaatgctctccgacatgatccgccgccgcaacctaatactaaacagaggctccgacgaaaacccccggggcccggtcagccgcgagcacgtagaatggtgccgagaattcgtcaaaggcaaatacataatggcattcaacccaccctggggcgacataaacaaaagcggaagatccggcatagccctcgtcgcaaccggtctcgccaaactcgccgaaaccgaaggcaaaggagtattcgacgaagccaaaaaagcggtagaagcactaaacggatacttagacaagcacagggacgaagtcgtaaaagcctccgccgacagcatgatcaccaacctgctcaaacacatagccaaagcacaggaactctacaaaaattcatccgccctcagagcccaaggggcccaaatcgacaccccattctcgtccttctactggctctacaaagcaggcgtaaccccagaaacattccccaccataagccagttcctatttgaactcggcaaacaaccgaggggcacgaaaaaaatgaaaaaagctctcctatcaacgcccatgaaatggggaaaaaaactatacgaacttttcgccgacgactccttccaacaaaacagaatctacatgcaccccgcagtactcacagccggccgcatcagcgagatgggcgtatgcttcggaactatccccgtcgctaacccagacgacgcagcccaaggcagcggccacacaaaaagcatccttaacctccgcacctccaccgaaaccaacaacccctgcgccaaaacaatcgtcaaactcttcgaaatccaaaaaaccgggttcaacatccaagacatggacatagtggcatccgaacacctcctccaccagagcctagtcggaaaacaatccccattccagaacgcatacaacgtcaaaggaaacgcaaccagcgccaacataatctaa

SEQ ID NO: 8045 - RNA, 1449 nt, synthetic construct
  misc_feature 1..1449: note = derived and/or modified CDS sequence (opt11) from CCHFV(1231-CR/TI-2015)__KU161587.1__N
  source 1..1449: mol_type = other RNA
atggaaaacaaaatcgaagtaaactccaaagacgaaatgaacaaatggttcgaagagttcaagaaaggcaacggcctgatggacaccttcacaaactcatactccttctgcgaaaacgtccccaaccttgacaaattcgtattccaaatggcaagcgccaccgacgacgcgcaaaaagactccatttacgcatcggccctggtcgaagccacgaaattctgcgcacccatatacgaatgcgcatgggtatcatcaaccgggatagtaaagaaaggcctagaatggttcgagaaaaacagcgggaccatcaaatcctgggacgaaaactacgccgaactaaaagtcgacgtccccaaaatcgaacaactcgccaactaccagcaggcggccctaaaatggcgaaaagacataggcttccgcgtcaacgcaaacacagcggccctcagcaacaaagtgctagccgaatacaaagtccccggcgagatagtcatgagcgttaaagaaatgctctccgacatgatacgccgcagaaacctcatcctcaaccgcggcggagacgaaaacccacgcggccccgtaagccgagaacacgtagaatggtgccgcgagttcgtaaaaggaaaatacataatggccttcaacccaccctggggagacatcaacaaatcaggcagaagcggaatcgcccttgtagcaaccggcttagccaaactcgcagaaaccgaaggaaaaggagtcttcgacgaagccaagaaaacagtcgaagcactaaacggctacttagacaaacaccgagacgaagtcgacaaagcatccgcagactccatgatcaccaacctccttaaacacatcgcaaaagcacaagaactatacaaaaactcatccgccctacgagcccaaggagcccaaatagacacccccttcagctccttctactggctttacaaagcaggcgtcaccccggaaaccttccccaccatctcccaattcctcttcgaactcggaaaacaaccccgaggaaccaagaaaatgaagaaagccctcctcagcacgcccatgaaatggggcaagaaactctacgaactcttcgcagacgactcattccaacaaaaccgcatctacatgcaccccgcagtactaaccgccggacgaatatcagaaatgggcgtctgcttcggcaccatccctgtcgccaaccccgacgacgccgcacagggaagcggccacacaaaaagcatactcaacctcaggacatcaaccgaaaccaacaacccctgcgccaaaacaatcgtaaaactattcgaaatacagaaaacaggcttcaacatacaagacatggatatcgtagccagcgaacacctactgcaccaatcactcgtcggcaaacaaagccccttccaaaacgcctacaacgtcaaaggaaacgccacctccgccaacatcatatag

SEQ ID NO: 8046 - RNA, 1449 nt, synthetic construct
  misc_feature 1..1449: note = derived and/or modified CDS sequence (opt11) from CCHFV(AP92)__U04958.1__N
  source 1..1449: mol_type = other RNA
atggaaaacaaaatagaggtcaactccaaagacgacctaaacaaatggttcgaagagttcaagaaaggaaacggcctcgtcgacacgttcactaactcatactccttctgcgaaaacgtccccaacctagaccgattcgtctaccaaatggcaagcgccaccgacgacgcgcaaaaagactccatctacgcctccgcactcgtagaagccacaaaatactgcgcccccatctacgaatgcgcatgggtcagctcaaccggaatcgtaaagaaaggactcgaatggttcgagaaaaacacctccaccatcaaatcctgggatgaaagctacaccgaactcaaagtggacataccaaaaatagaacaactctcaagctaccaacaagcggccctgaaatggcgaaaagacataggcttccgcataaacgccaacaccacagcactcagcaacaaagttctcgcagaatacaaagtccccggagaaatcctagtccccgtcaaagaaatgttatccgacatgatccgccgccgtaacatcatcctaaacagaggctcagacgagaatccacgcggccctgtcagccacgaacacatcgaatggtgccgcgagttcatcaaaggtaaatacatcatggcctttaacccaccctggggcgacatcaacaaatccggacggtcaggcatagccctcgtagccaccggcctcgccaaactcgcagaaaccgaaggcaaaggagtattcgaagaagccaaaaagaccgtagaagccctgaaggactacctagacaaacaccgcgacgaagtcgacaaaacatccgccgacaacatggtcacctcactcctcaaacacatcgcaaaagcccaagaactctacaaaaactcaagcgccctccgcgcccaaggcgcccaaatcgacacccccttcagctccttctactggctctacaaagccggcgtcacccccgaaaccttccccaccgtcagccaattcctattcgaactaggcaaacaaccacgcggcacaaagaaaatgaagaaagcactcctcagcacccccatgaaatggggcaagaaacactatgaactcttcgcagacgactccttccaacaaaaccgtatctacatgcaccccgccgtcctaaccgcaggccgcatctccgaaatgggcgtctgcttcggcacaatacccgtcgcaaatccagacgatgcagcccaaggctctggccacaccaaaagcatcctcaacctccgaaccaacaccgaatccaacaacccctgcgcacgaacaatcgtcaaactcttcgaaattcaaaagacaggcttcgacatcaaagacatggacatcgtcgcctcagaacacctactgcaccaatccctagtaggaaaacaatccccgttccaaaacgcatacaacgtcaaaggaaacgcaacttcagcaaacataatctaa

SEQ ID NO: 8047 - RNA, 1449 nt, synthetic construct
  misc_feature 1..1449: note = derived and/or modified CDS sequence (opt11) from CCHFV(C68031)__M86625.1__N
  source 1..1449: mol_type = other RNA
atggaaaacaaaatagaagtaaacaacaaagacgaaatgaacaaatggttcgaagagttcaagaaaggaaacgggctcgtcgacaccttcaccaatccatactccttctgcgaatcggtacccaacctagaaaggttcgtattccaaatggcctccgccaccgacgacgcccaaaaagacagcatctacgcctccgcactcgtcgaagccaccaaattctgcgcaccaatctacgaatgcgcatgggtaagctcaacaggcatagtaaagaaaggcctggaatggttcgagaaaaacgccggcaccatcaaatcatgggacgaaagctacatcgaactcaaagtagaagtccctaaaatcgaacaactcgccaactaccaacaagcggcactgaaatggcgaaaagacatcggcttccgcgtaaacgcgaacacagcagcactatcacacaaagtcctagccgaatacaaagtcccaggagaaatcgtcatgagcgtaaaagaaatgctctccgacatgatacgacgacggaacctcatcctaaaccgaggcggagacgaaaacccacgcggccctgtcagcagggaacatgtcgaatggtgcagagagttcgtcaaaggaaaatacatcatggcattcaacccgccctggggcgacatcaacaaatcgggaagaagcggaatcgcactcgtagccaccggcctcgccaaactggccgaaacggaaggcaaaggcgtcttcgacgaagccaagaaaaccgtcgaagcactcaacggctacctcgacaaacacaaagacgaagtcgacaaggcctccgcagacaacatgatcaccaacctcctcaaacatatagcaaaagcccaagaactctacaaaaacagctcagccctccgagcccaaggagcccaaatcgacaccgccttcagctcatattactggctctacaaagcaggcgtcaccccagaaacattcccgacagtcagccaattcctcttcgaactaggcaaacaacccaggggaacgaagaaaatgaagaaagcactcctcagcacacccatgaaatggggaaagaaactctacgaactattcgccgacgactcgttccaacaaaaccgcatatacatgcacccagcagtcctaaccgccggacgcatcagcgaaatgggggtatgcttcggcacaatccccgtagcaaacccagacgacgccgcccaaggatccggccacaccaaatccatcctcaacctaaggacaaacacggaaacgaacaacccatgtgcaaaaacaatcgtaaaactcttcgaaatccaaaagacaggcttcaacatccaagacatggacatcgtggcaagcgaacacctcctccatcaaagcctcgtaggaaaacaaagcccattccaaaacgcatacaacgtcaaaggaaacgcaaccagcgccaacataatctaa

SEQ ID NO: 8048 - RNA, 1449 nt, synthetic construct
  misc_feature 1..1449: note = derived and/or modified CDS sequence (opt11) from CCHFV(1-CR/HU-2015)__KU161586.1__N
  source 1..1449: mol_type = other RNA
atggaaaacaaaatcgaagtaaactccaaagacgaaatgaacaaatggttcgaggaattcaaaaaaggaaacggcctaatggacactttcaccaacagctactcattctgcgaaaacgtccccaacctcgacaagttcgtctaccagatggcctcagccaccgacgacgcacaaaaagactccatctacgcatcagcactagtcgaagccacaaaattctgcgcccccatctacgaatgcgcctgggtatcatccaccgggatagtgaaaaaaggcctcgaatggttcgaaaaaaactcaggaacaatcaagtcctgggacgaaaactacgcggaactcaaagtagacgtacccaaaatcgaacaactcgcaaactaccagcaagccgccctcaaatggcgcaaggacatcggcttccgcgtcaacgcaaatacagccgccctctccaacaaagtcctcgcagaatacaaagtaccaggagaaatagtcatgtccgtcaaagaaatgctctccgacatgatccgccgcagaaacctcatcctaaaccgcggcggcgacgaaaacccccgtggcccagtatcccgtgaacacgtcgaatggtgccgagaattcgtcaaaggcaaatacataatggccttcaaccccccatggggggacatcaacaagtccgggcgatccggcatcgccctcgttgccacaggcctagccaaacttgcagaaaccgaaggcaaaggagtctttgacgaagccaaaaaaaccgttgaagccctcaacggctacctcgacaaacaccgcgacgaagtcgacaaagcctcggcagactcaatgacaacaaacctcctcaaacacatcgccaaagcgcaagaactatacaaaaactccagcgccctccgcgcccaaggagcccaaatagacacccccttcagctccttctactggctctacaaggcaggcgtcacccccgaaaccttccccaccatctcccagttcctcttcgaactaggaaaacaacccagaggcaccaaaaaaatgaaaaaagccctcctctccacacccatgaaatggggaaaaaaactctacgaactgttcgccgacgactcattccaacaaaaccgcatctacatgcaccccgcagtcctcaccgccggccgcataagcgaaatgggcgtttgcttcggcaccatccccgtagccaaccccgacgacgccgcgcaaggaagcggccacacaaaatccatactcaacctacgcacctccacagagacgaataacccatgcgccaaaacgatagtaaaactgttcgagatccagaaaacaggcttcaacatccaagacatggacattgtagcatccgaacacctacttcaccaaagcctcgtcggcaaacaatcaccattccaaaacgcctacaacgtgaaaggcaacgccacctccgcaaacataatatga

SEQ ID NO: 8049 - RNA, 1449 nt, synthetic construct
  misc_feature 1..1449: note = derived and/or modified CDS sequence (opt11) from CCHFV(36-ST-2014)__KR814838.1__N
  source 1..1449: mol_type = other RNA
atggaaaacaaaatagaagtcaacagcaaagacgaaatgaacaaatggttcgaagagttcaagaaaggcaacggcctcatggacaccttcaccaactcctactccttctgcgaaaacgtaccgaacctagacaaattcgtattccaaatggccagcgcgaccgacgacgcgcaaaaagactccatatacgcctcagccctcgtagaagccaccaaattctgcgccccaatctacgaatgcgcgtgggtctcctccaccggcatagtcaagaaaggactcgaatggttcgaaaagaacaccggcaccataaaatcatgggacgacaactacgccgaactcaaagtagacgtaccaaaaatcgaacaactcgccaactaccaacaggcggccctaaaatggcgcaaagacataggattccgcgtcaacgccaacaccgccgcgctaagcaacaaagtcctggccgaatacaaagtcccaggcgaaatcgtaatgtcggtcaaagaaatgctctccgacatgatcagacgccgcaacctcatcctcaacagaggcggagacggaaacccacgcggacccgtcagccacgaacacgtagaatggtgccgcgagttcgtcaaaggaaaatacatcatggccttcaacccaccatggggcgacatcaacaaatctggaaggagcggcatcgcactcgtcgccacaggactagccaagctcgcagaaacggaaggaaaaggagtcttcgatgaagccaagcgaacagtagaagccctaaacggatatctggacaagcaccgagatgaagtcgacaaagccagcgcagacagcatgataaccaacctcctaaaacacatcgcaaaagcccaagaactctacaagaacagctcagccctacgagcccaaggagcacaaatcgacaccccattcagctcattctactggctctacaaagcaggcgtcacacccgaaacattcccaaccatcagccaattcctattcgaactcgggaaacaacccagaggaaccaaaaagatgaaaaaggccctcctcagcacccccatgaaatggggcaagaagctatacgaactattcgccgacgacagcttccaacaaaaccgcatatacatgcacccggccgtactaacagccggccgaatcagcgaaatgggagtctgcttcggcaccataccggtagccaaccccgacgacgccgcccagggctccggccacacaaaaagcatactcaacctccgcacctcaaccgaaacaaacaacccctgcgctaaaacaatagtgaaactgttcgaaatccagaaaacaggcttcaacatccaagacatggacatcgtggccagcgaacacctcctacaccaaagcctcgtcggtaaacagtcacccttccaaaacgcatacaacgtcaaaggcaacgcaacctccgccaacataatctaa

SEQ ID NO: 8050 - RNA, 1449 nt, synthetic construct
  misc_feature 1..1449: note = derived and/or modified CDS sequence (opt11) from CCHFV(37-ST-2009)__KR814835.1__N
  source 1..1449: mol_type = other RNA
atggaaaacaaaatagtcgtaaacagcaaagacgaaatgaacaaatggttcgaagaattcaaaaaagtaaacgggctcgtcgacaccttcacaaactcctactcattctgcgaaaacgtacccaacctggacaaattcgtcttccaaatggcgagcgcaaccgacgacgcacaaaaagactccatctacgcctctgccctcgtagaagcaacaaaattctgcgcacccatatacgaatgcgcctgggtcagctccaccggaatcgtaaaaaaaggcctagaatggttcgaaaaaaacgccggaaccatcaaatcctgggacgaatcatacacggaactgaaagtcgacgtccccaaaattgaacaactcgcctcgtatcagcaagccgccctaaaatggcgaaaagacatcggcttccgcgtcaacgccaacaccgccgccctatccagcaaagtactgtccgagtacaaagtcccgggcgaagtcgtcatgccagtcaaggaaatgctatcagacatgatccgccgccgaaacctcatcctgaaccgaggctccgacgaaaacccacgcggacccgtatcgcgggagcacgtagagtggtgccgcgaattcgtaaaaggtaaatacatcatggcattcaaccccccctggggagacatcaataaatcaggccgcagcgggatcgcacttgtcgccacgggcctagccaaactcgccgaaaccgaaggcaaagggatcttcgaagaagccagaaaaacagtcgatgctctaaaagactacctcgaccgacacaaagaagaagtcgacaaaacaaacgcagacaacatggtaaccaacctcttcaaacacatcgcaaaagcacaagagctctacaaaaacagctctgccctgcgcgcgcaaggagcccaaatcgacacaccattctcgagcttctactggctctacaaagccggcgtcacccccgaaacctttccgaccgtaagccaattccttttcgaactaggcaaacaaccccgcggcacacgcaagatgaaaaaagcactcctctcaacacccatgaaatggggcaagaaactctacgaactgttcgccgacgactcgttccagcaaaaccgtatctacatgcaccccgccgtactcacagccggacgagtgagcgagatgggcgtctgcttcggaacaatacccgtcgacaacccagacgacgccgcccaaggatcaggccataccaaaagcatactaaacctaagaacctcagccgaaaccaacaacccatgcgcacgcactatcgtcaaactattcgagatccagaaagccggcttcaacatccaagaaatggacatcgtcgcctccgaacacctactacaccaaagcctagtaggaaaacaatcacccttccagaacgcatacaacgtcaaaggcaacgccaccagtgccaacatcatctaa

SEQ ID NO: 8051 - RNA, 1449 nt, synthetic construct
  misc_feature 1..1449: note = derived and/or modified CDS sequence (opt11) from CCHFV(59-TK-2012)__KR814833.1__N
  source 1..1449: mol_type = other RNA
atggaaaacaaaatcgtcgtaaactccaaagacgaaatgaacaaatggttcgaagaattcaaaaaagtcaacggactggtcgacaccttcacgaactcctactcattctgcgaaaacgtcccaaacctcgacaaattcgtgttccaaatggccagcgccacagacgacgcacaaaaagactccatatacgcctcagccctcgtagaagcaacgaaattctgcgcacccatctacgaatgcgcctgggtcagctccaccggcatcgtgaaaaaaggtctagaatggttcgaaaaaaacacgggcaccatcaaaagctgggacgaatcatacaccgaactgaaagtagacgtacccaaaatagaacaactcgcctcgtaccaacaagccgccctcaaatggcggaaagacatcggattccgcgtcaacgccaacacagccgcgctatcatcaaaagtcctgagcgaatacaaggttccaggcgaaatagtcatgcccgtaaaagagatgctatccgacatgataagaagaagaaacctaatcctcaaccgtggcagcgacgaaaacccccgcggccccgtctcgagagaacacgtcgaatggtgccgcgagttcgtcaaaggaaaatacataatggccttcaatccaccctggggagacatcaacaaaagcggacggagcggcatagcgctagtagcaaccggcctggccaaactcgccgaaaccgaaggaaaagggatcttcgaagaagcccgcaaaacagtagacgccctcaaagactacctagacagacacaaagaagaggtagacaaaacaaacgcagacaatatggtaacaaacctattcaaacacatagccaaagcacaagaactctacaaaaactcatcagccctccgcgcacaaggcgcacaaatcgacaccccattcagcagcttttactggctctacaaagccggcgtcaccccagaaaccttcccaaccgtttcccaattcctcttcgaactcggcaaacaacccagaggcacccgcaaaatgaagaaagcactactgagcacacccatgaaatggggcaaaaaactgtacgaactcttcgcagatgactcattccaacaaaaccgcatctacatgcacccagccgtcctgaccgccgggcgaatctccgaaatgggggtatgcttcggcacgatccccgtagacaaccccgacgacgcagcacaaggatccggccacacaaaatccatactcaatctccgcacctccgccgaaaccaacaacccttgcgccaaaaccatcgtcaaactcttcgaaatacaaaaagccggcttcaacatacaagagatggacatagtcgccagcgaacacctcctacaccaatccctcgtaggcaaacaatccccattccaaaacgcctacaacgtcaaaggcaacgccacaagcgccaacataatctaa

SEQ ID NO: 8052 - RNA, 1449 nt, synthetic construct
  misc_feature 1..1449: note = derived and/or modified CDS sequence (opt11) from CCHFV(73-ST-2013)__KR814836.1__N
  source 1..1449: mol_type = other RNA
atggaaaacaaaatcgaggtaaacaataaagacgaaatgaacaaatggttcgaagaattcaagaaaggcaacggactcgtcgacacattcacaaactcctactcattctgcgaatccgttccaaacctggacaaattcgtgttccaaatggcaagcgcaaccgacgacgcacaaaaggactcaatctacgcctccgcactcgtagaagccacaaaattctgcgctcccatatacgaatgcgcctgggtcagctccaccggcatagtcaaaaaaggcctcgaatggttcgaaaaaaacgcgggaaccataaaatcctgggacgaaagctatacagaactcaaagtcgacgtcccaaagatcgaacagctcgccaactaccaacaagcagcactaaaatggcgcaaagacatcggattccgcgtaaacgccaacaccgccgccctctccaacaaagtcctcgccgaatacaaggtccccggcgagatcgtaatgtccgtcaaagagatgctcagtgacatgatccgacgccggaaccaaatcctaaaccgaggcggcgacgagaacccccgcggacccgtatccagggaacacgtcgactggtgccgagagttcgtcaaagggaaatacataatggccttcaacccaccctggggcgacatcaataagtccggccgatccggaatcgccctagtagccaccggcctagccaaactcgccgagaccgaaggcaaaggcgtcttcgacgaagccaaaaaaaccgtagaggccctcaacggctacctcgacaaacacaaagacgaggtcgacagagcttcagccgactcaatgatcacaaacctcctcaaacacatagcgaaagcccaagaattatacaaaaactcatcagccctacgcgcacaaggcgcccaaatcgacaccgccttcagttcctactactggctctataaagcaggcgtcacacccgaaacgttccccacagtcagccaattcctcttcgaactcggcaaacaacccagaggcaccaaaaaaatgaaaaaagcgctcctcagcacccccatgaaatggggtaaaaaactatacgaactcttcgcagacgactcgttccagcaaaaccgcatatacatgcaccccgccgtcctcacggccggccgcatctcagaaatgggcgtatgcttcggaacaatacccgtagcaaacccagacgacgcagcccaaggctccggacacaccaaaagcatcctcaacctccgcaccaacaccgaaaccaacaacccctgcgccagaaccatagtaaaactcttcgagatccaaaaaaccggcttcaacatccaagacatggacatagtagcctcagaacacctcctccaccaaagcctcgtcggcaaacaatccccattccaaaacgcctacaacgtaaaaggcaacgccaccagcgccaacataatctaa

SEQ ID NO: 8053 - RNA, 1449 nt, synthetic construct
  misc_feature 1..1449: note = derived and/or modified CDS sequence (opt11) from CCHFV(75-ST-2010)__KR814845.1__N
  source 1..1449: mol_type = other RNA
atggagaacaaaatcgaagtcaactcaaaagacgaaatgaacaaatggttcgaggaattcaaaaaaggcaacggcctcatggacaccttcacaaactcatactccttctgcgaaaacgtccccaacctagacaagttcgtcttccaaatggccagcgccaccgacgacgcccaaaaagacagcatatacgcatcagcactagtcgaagcaacaaaattctgtgcccccatctacgaatgcgcctgggtatcctcgaccggcatagtaaaaaaaggcctcgagtggttcgaaaaaaacagcgggaccatcaaatcctgggacgaaaactacgccgaactcaaagtcgacgtccccaagatcgagcaactcgccaactaccaacaagcagctctcaaatggaggaaagacatcggcttccgcgtcaacgcaaacaccgcagccctcagcaacaaagtccttgcagaatacaaagtacccggagaaatcgtcatgtctgtaaaagaaatgctcagcgacatgatccgacgccgcaacctcatcctcaaccgaggctccgacgaaaacccacgaggcccagtctcccgcgaacatgtcgaatggtgccgagaattcgtcaaaggtaaatacatcatggccttcaaccccccatggggcgacatcaacaaatcaggcagatccggaatcgccctagtcgccaccggacttgcaaaactagccgaaaccgaaggcaaaggcgtcttcgacgaagcaaaaaaaaccgtggaagcgctaaacggttacctagacaaacaccgcgacgaagtagacaaggcatccgccgacagcatgatcaccaacctactaaaacacatagccaaagcccaagaactctacaaaaactcatcagcactgcgcgcccaaggcgcccaaatcgacacacccttctcctccttctactggctctacaaagccggcgtcactccagaaaccttcccaaccatcagccaattcctcttcgagctgggcaaacaaccccgaggcaccaaaaaaatgaaaaaagcactcctcagcaccccaatgaaatggggcaaaaaactctacgaactcttcgcagacgactccttccaacaaaatcgcatctacatgcacccagcagtcctcactgccggccgcatcagcgagatgggcgtatgcttcggaacaatcccagtcgctaaccccgatgacgccgcccaaggcagcggacacacaaagtctatcctcaacctccgaaccagcaccgagaccaacaacccctgtgccaaaacaatcgtcaaactcttcgaaatccaaaaaacaggcttcaacatccaagacatggacatcgtagcaagcgagcacctcctccaccaatcactcgtaggaaaacaaagccccttccaaaacgcctacaacgttaaaggcaacgccacctccgccaacataatctaa

SEQ ID NO: 8054 - RNA, 1449 nt, synthetic construct
  misc_feature 1..1449: note = derived and/or modified CDS sequence (opt11) from CCHFV(CHH)__KU707898.1__N
  source 1..1449: mol_type = other RNA
atggaaaacaaaatcgaagtaaactccaaagacgaaatgaacaaatggttcgaagagttcaagaaaggcaacgggctagtagacacattcaccaactcctactcattctgcgaaagcgtacccaacctagacagattcgtcttccaaatggcctccgccaccgacgacgcgcaaaaagactccatatacgcctccgctctagtcgaagccacaaaattctgcgcacccatctacgaatgcgcctgggcctcatccacaggcatcgtcaagaaaggcctcgaatggttcgagaaaaacgcaggcaccatcaaatcctgggacgaatcctacacagaactcaaagtggaagtccccaaaatcgaacaactaagcaactaccagcaagctgcactgaaatggcgaaaagacatcggattccgcgtcaacgccaacacagccgccctctcgaacaaagtcctggccgaatacaaagtaccaggagaaatcgtaatgtcagtcaaagaaatgctaagcgacatgatccgccgccgcaacctcatactcaacagaggcggagacgaaaaccccagagggcccgtctcacgagaacatgtagaatggtgccgcgagttcgtcaaagggaaatacatcatggcattcaacccaccctggggcgacatcaacaaatcaggacgctcaggcatagccctcgtcgccacaggactcgccaaactagccgaaacagaaggcaaaggcgtcttcgacgaggcaaagaaaaccgtcgaagccctcaacggctacctcgacaaacataaagacgaggtcgacaaagcctccgcggactcaatgataaccaacctcttaaaacacatcgccaaagcacaagaactctacaaaaacagctccgccctccgcgcccaaggagcccaaatcgacaccgtgttctcaagctactactggctctataaagcaggcgtcacacccgacacgttcccaaccgtatcccaattccttttcgaactaggaaagcaaccccgaggaaccaagaaaatgaagaaagcgctactctcaacccccatgaaatggggcaagaaactttacgaactgttcgccgacgacagcttccagcaaaaccgcatttacatgcaccccgccgtcctcaccgcgggccgaataagcgaaatgggcgtctgcttcggcaccatccccgtagccaaccccgacgacgcagccctcggctccggccacaccaaaagcatcctcaacctacgcaccaatacagagaccaacaacccatgcgccaaaaccatcgtaaaactcttcgaaatccagaaaaccggtttcaacatccaagacatggacatcgttgcctcagaacacctcctccaccaaagcctcgtcggcaaacagagccccttccagaacgcctacaacgtcaaaggaaacgcaacatcagccaacatcatctaa

SEQ ID NO: 8055 - RNA, 1449 nt, synthetic construct
  misc_feature 1..1449: note = derived and/or modified CDS sequence (opt11) from CCHFV(CJH)__KU707899.1__N
  source 1..1449: mol_type = other RNA
atggaaaacaaaatcgaagtcaaaaacaaacacgagaaaaacaaatggttcgaagagttcaagaaaggcaacggcctagtagacacattcaccaactcatacagcttctgcgaaaacgtaccaaacctcgaccgcttcgtattccaaatggcaggcgccaccgacgacgcgcaaaaagactcaatatacgcatcagcactcgtagaagccacaaaattctgtgcccccatatacgaatgcgcctgggcatcatccaccggcatagtcaagaaaggactcgaatggttcgagaaaaacgccggaacaatcaaaagctgggacgaaagttacacggaactcaaagtagaagtacccaaaatcgaacaactctccaactaccaacaagccgcactcaaatggagaaaagacatcggattccgaggcaacgcaaacacagccgccctatccaacaaagtcctagccgaatacaaagtccccggcgaaatcgtcatgagcgttaaagaaatgctcagcgacatgatccgccgcagaaacctcatcctcaaccgcggcggagacgaaaacccccgcggccccgtctcccgcgaacacgtcgaatggtgccgagagttcgtaaaaggaaaatacatcatggccttcaatcccccatggggcgacatcaacaaatcgggacgctcaggaatcgccctcgtggccaccggactagcgaaactggcggaaaccgaaggaaaaggagttttcgacgaagccaagaaaaccgtagaagccctcaacggatacctagacaaacacaaagacgaagtcgacaaagcatccgcagacagcatgatcaccaacctcctcaaacacatagccaaagcccaagagctttacaaaaactcatccgccctccgcgcccaaggagcgcaaatcgacaccgtcttctcctcctactactggctctacaaagcaggagtaaccccggaaaccttcccaacagtaagccaattcctcttcgaactcggcaaacaacccagaggaacaaagaaaatgaagaaagcgctcctcagcacacctatgaaatggggcaagaaactctacgagctgttcgcagacgactcattccaacaaaaccgcatctatatgcaccccgcagtactcacagcaggacgcatcagcgaaatgggcgtctgcttcggcaccataccagtagccaacccagacgacgcggcgttgggctccggccacaccaaatcaatcctaaacctccgaaccaacaccgaaaccaacaacccatgcgcgaaaacaatcgtaaaactcttcgaaatccagaaaacaggcttcaacatccaagacatggacatcgtagcctccgaacacctcctccaccaaagcctcgtcggcaaacaaagtcccttccaaaacgcctacaacgtcaaaggcaacgccacctcagccaacataatatag

SEQ ID NO: 8056 - RNA, 1449 nt, synthetic construct
  misc_feature 1..1449: note = derived and/or modified CDS sequence (opt11) from CCHFV(CLT/TI05146)__DQ227496.1__N
  source 1..1449: mol_type = other RNA
atggaaaataaaatcgaagtaaataacaaagacgaaatgaataaatggttcgaagagttcaaaaaaggcaacggcctcgtagacacgttcaccaactcatactccttctgcgaatcggtccccaacctggaccgattcgtcttccaaatggcctccgccacagacgacgcccaaaaagactccatctacgcctcagccctagtagaagcaacaaaattctgcgcccccatatacgaatgcgcctgggtaagctccaccgggattgtaaaaaaaggcctagaatggttcgaaaagaacgccggcaccataaaatcatgggacgagtcatataccgaactaaaagtcgaagtcccgaaaatcgaacaactcgccgactaccaacaagccgcactgaaatggagaaaagacataggcttccgagtcaacgccaacaccacagcactctcccacaaagtcctagccgaatacaaagtcccaggcgaaatagtgatgtcagtaaaagaaatgctctccgacatgatacgccggcgcaacctcatcctgaaccggggcggagacgaaaacccgcgcggacctgtatcccgggaacacgtcgaatggtgccgcgaattcgtaaaagggaaatacatcatggccttcaacccaccatggggcgacataaacaaatccggacgctccggcatagccctcgtagcaaccggcctagccaaactcgcagaaacagaaggaaaaggggtcttcgacgaagccaaaaaaacagtcgaagccctcaatggatacctcaacaaacacaaagacgaagtagacaaagcctccgccgactcaatgatcaccaacctcctaaagcacatcgccaaagcccaagaactctacaaaaactccagcgctctcagagcccaaggagcacaaatcgacaccgcgttcagctcatactactggctctacaaagccggagtaacccccgaaacgttcccgaccgtatcccaattcctcttcgaactaggcaagcagccccgggggaccaaaaagatgaaaaaagccctactcagcaccccactgaaatggggaaaaaaactctacgaacttttcgccgacgactccttccaacaaaaccgcatatacatgcaccccgcagtcctaaccgcaggacgcataagcgaaatgggagtatgcttcggaacaatccccgtcgccaaccccgacgacgccgcccagggaagcgggcacacaaaaagcatattaaacctacgcacaaacaccgaaaccaacaacccgtgcgccaaaacaatcgtgaaactcttcgaaatccaaaaaaccggattcaacatacaagacatggacatcgtcgccagcgaacacctcctccaccaatcgctagtcgggaaacaatcccccttccaaaacgcctacaacgtcaaaggcaacgcaacctccgcaaacataatctaa

SEQ ID NO: 8057 - RNA, 1449 nt, synthetic construct
  misc_feature 1..1449: note = derived and/or modified CDS sequence (opt11) from CCHFV(CYT/TI05099)__DQ227495.1__N
  source 1..1449: mol_type = other RNA
atggaaaacaaaatcgaagtaaacaacaaagacgaaatgaacaaatggttcgaagagttcaagaaaggcaacggactcgtagacaccttcacaaactcctacagcttctgcgaatccgtaccaaacctagaccggttcgtattccaaatggcctccgccaccgacgacgcacaaaaagactccatctacgcatccgccctcgtcgaagcaacaaaattctgcgcacccatatacgaatgcgcgtgggtcagctcaacaggcatcgtcaagaaaggactcgaatggttcgagaaaaacgccggaaccataaaatcatgggacgaatcatacacagaactaaaagttgaagtccccaaaatcgagcaactagcagactaccaacaagcagctctcaaatggagaaaagacattggcttccgcgtaaacgcaaacaccaccgccctctcacacaaagtcctagccgaatacaaagtgcccggcgaaatcgtcatgagcgtcaaagaaatgctatccgacatgatacgacgccgcaacctgatcctcaaccgcggcggggacgagaacccccgcggccccgtgagccgagagcacgtcgaatggtgccgagagttcgtaaaaggaaaatatatcatggcattcaacccaccctggggagacatcaacaaatcaggcagaagcggaatcgcactcgtcgcaacaggcctggccaaactagcagaaaccgaaggaaaaggcgtcttcgacgaagcaaagaaaacagtcgaagcactcaacggctacctaaataaacacaaagacgaagtcgacaaagctagcgcagactccatgatcaccaacctcctaaaacacatagccaaagcccaagaactctacaaaaactcatcagcactaagagcccaaggcgcacaaatcgacacagccttctcaagctactactggctctacaaagcaggcgtcacccccgaaacattcccaaccgtcagccaattcctattcgaactaggcaaacaaccacgcggcacaaagaaaatgaagaaagcactactctccacaccactcaaatggggaaagaaactatacgaactattcgccgacgactccttccagcaaaaccgcatatacatgcaccccgcagtcctcaccgccggacgtataagcgaaatgggcgtctgcttcggaaccatcccagtcgcaaaccccgatgacgcagctcagggatccggccacaccaaaagcatccccaacctccgcacaaataccgagaccaacaacccctgcgccaaaacaatcgtaaaactcttcgaaatccagaaaaccgggttcaacatacaagacatggacatagtcgcatcggaacacctcttacaccaaagcctagtcggcaaacaaagcccattccaaaacgcctacaacgtcaaaggcaacgccacgagcgcaaacataatctag

SEQ ID NO: 8058 - RNA, 1449 nt, synthetic construct
  misc_feature 1..1449: note = derived and/or modified CDS sequence (opt11) from CCHFV(Dubai 616)__JN108025.1__N
  source 1..1449: mol_type = other RNA
atggaaaataaaatcgaagtcaacaacaaagacgaaatgaacaaatggttcgaagagttcaagaaaggaaacggactcgtcgacactttcaccaactcctacagcttttgcgaatccgtacccaacctcgacagattcgtctttcaaatggccggcgcgaccgacgacgcccaaaaagactccatctacgcatccgccctagtcgaagcaaccaaattctgcgcacccatctacgaatgcgcgtgggtgagctcgaccggcatcgtcaagaaaggcctcgaatggttcgagaaaaacgccggtaccataaaatcctgggacgaatcatacacggaactcaaagtagaagtacccaaaatcgaacaactggccaattaccaacaagcggccctcaaatggcgcaaagacataggattccgtgtaaacgccaacacagccgccctctcccacaaagtcctcgcagaatacaaagtcccaggcgaaatagtcatgtccgtcaaagaaatgctaagcgacatgatccgacgccgaaacctgatacttaacagaggaggcgacgaaaacccccgcggcccagtaagccgagaacacgtcgaatggtgccgagaatttgtcaaaggcaaatacatcatggccttcaacccgccctggggcgacatcaacaaaagcggcagaagcggcatcgcactcgtagcaacaggactcgccaaactcgcagaaaccgaaggaaaaggagtcttcgacgaagccaagaaaaccgtcgaagccctcaacggctacctggacaaacacaaggacgaagtcgacaaagccagcgccgacaacatgatcacaaacctactcaaacacatcgccaaagcacaagaactctacaaaaacagctcagccttgcgagcacaaggcgcccaaatcgacacagccttctcgagctactactggctatacaaagcaggcgtcacccccgaaacatttcccaccgtatcacaattcctcttcgaactcggcaaacaaccccggggcaccaagaaaatgaagaaagccctactgtccacccccatgaaatggggaaagaaactgtacgaactctttgccgacgactcattccaacaaaaccgcatctacatgcaccccgcagtcctcacggccggccgaatcagtgaaatgggagtctgcttcgggaccataccagtcgccaacccagacgacgctgcacaaggatccggccacacaaaaagcatactcaacctcagaaccaacactgaaacaaacaacccgtgcgccaaaacaatcgtcaaactcttcgaaatccagaaaaccggatttaacatccaagacatggacatcgtcgccagcgaacacctactacaccaatccctcgtcggaaaacaaagccccttccaaaacgcctacaacgtgaaaggcaacgccaccagcgccaacatcatataa

SEQ ID NO: 8059 - RNA, 1449 nt, synthetic construct
  misc_feature 1..1449: note = derived and/or modified CDS sequence (opt11) from CCHFV(GRH)__KU707900.1__N
  source 1..1449: mol_type = other RNA
atggaaaacaaaatcgaagtcaactccaaagacgagatgaacaaatggttcgaagagttcaagaaaggaaacggattagtcgacaccttcacgaacagctactcattctgcgaatccgtcccaaacctcgaccgcttcgtattccagatggccagcgcaacagacgacgcgcaaaaagacagcatctacgcatcagccctagtcgaagcaaccaaattctgcgcccccatctacgaatgcgcgtgggcatcctcaaccggaatcgtaaagaaaggcctcgaatggttcgagaaaaacgccggcactatcaaatcatgggacgaatcatacaccgaactcaaagtagaagtacccaaaatagaacaactcagcaactaccaacaagccgcactaaaatggagaaaagacatcggcttccgcgtcaacgccaacacagccgccctgtccaacaaagtcctcgcggaatacaaagtcccaggcgaaatcgtcatgtccgtcaaagaaatgctaagcgacatgatcagacgccgaaacctaatactgaaccgcggcggcgacgaaaacccccgcggccccgtctcacgagaacacgtcgaatggtgccgcgagttcgtcaaaggcatgtacatcatggccttcaacccaccctggggcgacataaacaaatcaggacgcagcggaatcgcgctcgtcgccacaggactagcaaaactagccgaaaccgaagggaaaggagtcttcgacgaagccaagaaaacagtagaagccctcaacggatacctcgacaaacacaaagacgaagtagacaaagccagcgcagactcaatgataaccaacctcctaaaacacatcgccaaagcgcaggaactctacaagaactcctcagccctacgagcccaaggagcccaaatcgacacagtcttcagcagttactactggctttacaaagcaggcgtaacccccgacacattccccacagtctcccagttcctattcgaactaggcaagcagccccgaggcaccaaaaagatgaagaaagcgctcctcagcacacccatgaaatggggcaagaaactatacgaactcttcgccgacgactccttccaacaaaaccgcatctacatgcaccccgccgtcctaacagccggacgcatatccgaaatgggcgtatgtttcgggaccatcccagtagccaacccagacgacgccgccctcggatccggccacaccaaaagcatactcaacctccgcaccaacaccgaaacaaacaacccctgcgcaaaaacaatcgtaaaactattcgagatccagaaaaccggattcaacatacaagacatggacatcgtcgccagcgaacacctactacaccaaagcctagtcggcaaacaatcccccttccaaaacgcatacaacgtcaaaggcaacgcaacaagcgcaaacatcatctaa

SEQ ID NO: 8060 - RNA, 1449 nt, synthetic construct
  misc_feature 1..1449: note = derived and/or modified CDS sequence (opt11) from CCHFV(Iran-Gilan69)__KJ027521.1__N
  source 1..1449: mol_type = other RNA
atggaaaacaaaatcgaagttaactccaaagacgaaatgaacaaatggttcgaagaattcaaaaaaggcaacgggctcatggacaccttcaccaactcatacagcttctgcgaaaacgtccccaacctcgacaaattcgtgttccagatggcaagcgccaccgacgacgcccaaaaagactccatctacgcctccgccctcgtcgaagccaccaaattctgcgcacccatatacgaatgcgcgtgggtatccagcacaggcatcgtcaaaaaaggcctagaatggttcgaaaaaaacagcggcacaataaaatcatgggacgaaaactacgccgaactaaaagtcgacgtacccaaaatcgaacaactggcctcctaccaacaagccgcactcaaatggcgaaaagacatcggtttccgcgtcaacgccaacacagccgccctctccaacaaggtactagcagaatacaaagtcccaggagagatcgtcatgtcagtcaaagaaatgcttagcgacatgatccgacgaagaaacctcatcctgaaccgcggaggcgacgaaaacccccgcggccctgtaagccgagaacacgtcgaatggtgccgcgagttcgtcaaaggaaaatatatcatggccttcaacccaccctggggcgacataaacaagtcaggaagaagcggaatagccctcgtcgccacaggactagcaaagctcgccgaaaccgaaggcaaaggagtcttcgacgaagcaaaaaaaacagtcgaagccctcaacggatacctcgacaaacaccgcgacgaagtagacaaagcgtccgccgactccatgatcaccaacctactaaaacacatcgccaaagcacaagaactctacaaaaattcctcagcactccgcgcccaaggcgcacaaatcgacacccccttctcctcattctactggctctacaaggcgggcgtcacgccagaaacattccccacaatatcccaattcctatttgaacttggcaaacagccccgaggaaccaaaaaaatgaaaaaagccctcctaagcacaccaatgaaatggggcaaaaaactatatgagttattcgccgacgactcgttccagcaaaaccgcatctacatgcaccccgctgtgctcacagccggccgaatcagcgaaatgggcgtatgcttcggaaccatccccgtcgccaatcccgacgacgcggcccaaggctcaggccacaccaaaagcatcctcaacctacggacatccacagaaacaaacaacccatgcgccaaaaccatcgtaaaactcttcgaaatccaaaaaacaggcttcaacatacaggacatggacatcgtagcctccgagcacctcctacaccaatcactcgtcggcaaacagtcccctttccaaaacgcctacaacgtcaaaggcaacgccacgtccgccaacatcatctaa

SEQ ID NO: 8061 - RNA, 1449 nt, synthetic construct
  misc_feature 1..1449: note = derived and/or modified CDS sequence (opt11) from CCHFV(Iran-Isfahan78)__KJ027522.1__N
  source 1..1449: mol_type = other RNA
atggaaaacaaaatagaagtaaactccaaagacgaaatgaacaaatggttcgaagaattcaaaaaaggcaacggactaatggacacattcaccaattcttactccttctgcgaaaacgtcccaaacctcgacaaattcgtcttccaaatggcatccgccaccgatgacgcacaaaaagactcaatctacgcctccgcactagtagaggccaccaaattctgcgcgccaatctacgaatgcgcatgggtaagctcaacaggcatcgtcaaaaaaggcctggaatggttcgagaaaaacagcggaacaataaaatcctgggacgaaaactacgcagaactcaaagtcgacgtccccaaaatagaacaactagcaaactaccaacaggccgcactaaaatggcgaaaagacatcggcttccgcgtcaacgccaacacagccgccctctccaacaaagtcctcgccgaatacaaagtccccggcgaaatcgtaatgtccgtcaaagagatgctatccgacatgatccgccgccgcaacctaatactaaacagaggcggagacgaaaacccccgcggacccgtctcacgcgaacacgtcgaatggtgccgtgaattcgtaaaaggcaaatacataatggccttcaaccccccctggggcgacatcaacaaaagcggccgttccggaatagccctggtcgcaaccggcctcgctaagctagcagaaaccgaaggcaaaggcgtattcgacgaagccaaaaaaacagtagaagcccttaacggctacctagacaaacaccgcgacgaagtagacaaagccagcgccgactccatgataaccaacctcctaaaacacatcgcaaaagcccaagaactatacaaaaacagctcagccctaagagcacaaggagcccaaatcgacactccattctccagcttctactggctatacaaagcaggcgtaacccccgagaccttcccaacagtctcccaattcctcttcgaactcggaaagcaaccccgaggtacgaaaaaaatgaagaaagccctcctcagtacacccatgaaatggggaaaaaaactctacgaactattcgccgacgactccttccaacaaaaccgcatatacatgcacccagcagtactcaccgccggaagaataagcgaaatgggcgtatgcttcggcaccatcccagtcgccaaccccgacgacgccgcacaaggctcaggacacacaaaatccatcctaaacctccgcacatccactgaaaccaacaacccctgcgcaaaaaccatagtcaaactcttcgagatccaaaaaaccggattcaacatacaagacatggacatcgtcgcctccgaacacctcctgcatcaatccctcgtcggaaaacaatcaccattccaaaacgcatacaacgtcaagggcaacgccacatcagccaacatcatctaa

SEQ ID NO: 8062 - RNA, 1449 nt, synthetic construct
  misc_feature 1..1449: note = derived and/or modified CDS sequence (opt11) from CCHFV(Iran-KhRazavi72)__KJ485700.1__N
  source 1..1449: mol_type = other RNA
atggaaaataaaatagaagtaaaaaacaaacacgaaaagaacaaatggttcgaagagttcaaaaaaggcaacgggttagtagacacattcccaaatagctacagcttctgcgaaaacgtccccaacctcgaccgcttcgtattccaaatggccggagcaaccgatgacgcacaaaaagactccatctacgcctccgccctggtagaggccaccaaattctgcgcacccatctacgagtgcgcatgggcgagctcaacaggcatcgtgaaaaaaggcctggagtggttcgaaaaaaacgcaggcaccatcaaatcatgggacgaatcatacaccgagctcaaagtcgaagtccccaaaatagaacaactaagcaactaccaacaagcggcactaaaatggcgaaaagacataggattcagaggcaacgccaacacggccgcactgtcaaacaaagtcctcgccgaatacaaagtccccggcgaaatcgtaatgtccgtaaaagaaatgctctctgacatgatacgccgccgcaacctaatccttaaccgcggcggcgacgaaaacccgcgcggccccgtatcccgtgaacacgtcgaatggtgccgcgaattcataaaaggaaaatacatcatggcgttcaacccaccctggggcgacataaacaaatccggacgaagcgggatcgccctcgtagccaccggcctagccaagctagccgaaaccgaaggaaagggcgtattcgacgaggccaaaaaaaccgtcgaggcactcaacggatacctagacaaacacaaagacgaagtagacaaagcgagcgcagactccatgatcacaaacctcctaaaacacatagccaaagcccaagaactctacaaaaactccagcgccctccgcgcccaaggagcccagatcgacaccgtgttcagctcatactactggctatacaaagcgggagtcacaccggaaaccttcccaaccgtaagccaattcctattcgaactaggaaaacaaccccgcggaaccaaaaaaatgaaaaaagccctcctatccacccccatgaaatggggaaaaaaactctacgaactattcgccgacgacagcttccaacaaaacagaatctacatgcaccccgccgtactaaccgccggacgtatcagcgaaatgggagtctgcttcggcaccataccagtcgccaaccccgacgacgcagcactcggatccggacacactaaaagcatcctcaacctccgcacgaacaccgaaaccaacaacccatgcgccaaaaccatcgtcaaacttttcgaaatccagaaaaccggcttcaacatccaagatatggacatcgtagccagcgagcacctcctacaccaaagcctcgtaggcaaacaaagcccgttccaaaacgcctacaacgtaaaaggcaacgcaaccagcgccaacataatctaa

SEQ ID NO: 8063 - RNA, 1449 nt, synthetic construct
  misc_feature 1..1449: note = derived and/or modified CDS sequence (opt11) from CCHFV(Iran-Zahedan19)__KJ676542.1__N
  source 1..1449: mol_type = other RNA
atggaaaacaaaatagaagtaaacaacaaagacgagatgaacaaatggttcgaagaattcaaaaaaggcaacggcctcgtagacaccttcacaaactcctactccttctgcgaaagcgtccccaacctagaccgctttgtcttccaaatggcaggggcaaccgacgacgcccaaaaagactcaatctacgccagcgcactagtcgaggccaccaaattctgcgccccaatctacgaatgcgcttgggtcagctccaccggcatcgtaaaaaagggcctagaatggttcgaaaaaaacgccggcacgatcaaaagctgggacgaatcctacacagaactaaaagtcgaagtacccaaaatcgaacaactcgccaactaccaacaagccgcactaaaatggcgcaaagacatcggcttccgagtaaacgccaacacggccgccctgtcacacaaagtactggcagagtacaaggtcccaggcgaaatcgtaatgtcagtaaaagaaatgctatcagacatgatcagacgacgaaacctaatcctaaaccgaggaggcgacgagaacccgcgaggcccagtctccagggaacatgtcgaatggtgccgagaattcgtcaaaggaaaatacatcatggccttcaaccccccctggggagacatcaacaaaagcggccgcagcggaatcgccctaatcgccacaggccttgcaaaactcgcagaaacagaaggcaaaggcgtcttcgacgaagccaaaaaaaccgtagaagccctcaacggctacctcgacaaacacaaagacgaagtagacaaagccagcgcagacaatatgatcacaaacttgctaaaacacatagccaaagcccaagaactctacaaaaacagctccgcactccgagcacaaggagcacaaatcgatacagccttctcgtcatactactggctctacaaagccggcgtcaccccagaaacattcccgaccgtcagccaattcctcttcgaacttggcaaacaaccccgcggcaccaagaaaatgaaaaaagcactactatccacgcccatgcgctggggaaaaaaactatacgaactcttcgctgacgacagcttccaacaaaaccgcatatacatgcaccccgccgtcctaacagcaggccgcataagcgaaatgggcgtctgcttcggcacgatcccagtcgccaaccccgacgacgccgcacaaggctccggccacacaaaaagtatactaaacctccggacgaacaccgaaacgaacaacccctgcgccaaaacgatcgtgaaactattcgaaatccaaaaaactggcttcaacatccaagacatggacatcgtagccagcgaacacctcctgcaccaaagcctcgtcggtaagcaatccccattccaaaacgcctacaacgtcaagggcaacgcaacatccgccaacataatctaa

SEQ ID NO: 8064 - RNA, 1449 nt, synthetic construct
  misc_feature 1..1449: note = derived and/or modified CDS sequence (opt11) from CCHFV(NIV 112143)__JN572089.1__N
  source 1..1449: mol_type = other RNA
atggaaaacaaaatagaagtaaacaataaagacgagatgaacaaatggttcgaagagttcaagaaaggtaacggactcgtagacacattcacaaactcgtactcattctgcgaatcagtcccaaacctcgaccgattcgtattccaaatggcctccgcgaccgacgacgcacaaaaagacagcatatacgcctccgccctcgtcgaagccacgaaattctgcgcacccatttacgaatgcgcctgggtcagctcgaccggaatagtgaagaaaggcctcgaatggttcgagaaaaacgcagggaccatcaaaagctgggacgaaagctacacagaactaaaagtcgaagtccccaaaatagaacaactagccaactaccaacaagcggccctcaaatggagaaaagacataggattcagagtaaacgccaacacagccgcactctcgcacaaggtcctcgcagagtacaaagtccccggcgagatcgtgatgtcagtcaaagaaatgctatcagacatgatcaggcgtagaaacctaatattaaaccgaggcggggacgaaaacccgcgcggacccgtttccagggaacacgtcgaatggtgccgcgagttcgtaaaaggaaaatacatcatggccttcaacccaccctggggcgacatcaacaaatcaggccgcagcggaatcgcactcatagccaccggcctggccaaactcgccgaaacagaaggcaaaggagtcttcgacgaagccaagaaaacagtagaagcactaaacgggtacttggacaaacacaaagacgaagtcgacaaagcatcagcagacaacatgatcacaaacctcctaaaacacatagcaaaagcccaagagctctacaaaaacagctcggccctacgcgcacaaggagcccaaatcgacacagccttctcaagctattactggctatacaaagcgggcgtcacccccgaaacattccccacagtcagccagttcctcttcgaactagggaaacaaccaagaggcacgaaaaagatgaagaaagccctcctgagcacgcccatgcgctggggaaagaaactatacgaactcttcgccgacgactcattccaacaaaaccggatttacatgcaccccgccgtacttacggccggccgcatcagcgagatgggcgtttgtttcggaaccataccagtcgccaacccagacgacgcagcacaaggctcaggacacaccaaaagcatactcaacctccgaaccaataccgagaccaacaacccctgcgctaaaacaatcgtgaaactgttcgaaatccagaaaaccggcttcaacatacaagacatggacatcgtagcatcagagcacctcctccaccaaagcctagtaggaaaacaaagccccttccaaaacgcgtacaacgtaaaaggcaacgccacgagcgccaacataatctaa

SEQ ID NO: 8065 - RNA, 1449 nt, synthetic construct
  misc_feature 1..1449: note = derived and/or modified CDS sequence (opt11) from CCHFV(NIVA 118595)__JN572088.1__N
  source 1..1449: mol_type = other RNA
atggaaaacaaaatcgaagtaaacaacaaagacgaaatgaacaaatggttcgaagagttcaagaaaggcaacggcctagtagacaccttcaccaactcatactccttctgcgaatcagtcccaaacctcgaccgcttcgtgttccagatggcgagcgcgaccgacgacgcccaaaaagacagcatatacgccagtgccctggtcgaagcaacaaaattctgcgcacccatctacgaatgcgcgtgggtaagcagcaccggaatcgtcaagaaaggactcgaatggttcgagaaaaacgcaggcaccataaaatcatgggacgaaagctacacagaactcaaagtcgaagtcccaaaaatcgaacaactcgccaactaccaacaagcagccttaaaatggagaaaagacatcggattccgagtcaacgcaaacacagcagccctcagccacaaagtcctcgcagaatacaaggtccccggcgaaatagtcatgtccgtcaaagaaatgctcagcgacatgatacgtcgaaggaacctaatcctaaaccgcggaggcgacgaaaacccacgcggccccgtatcccgcgaacacgtagagtggtgccgcgagttcgtcaaaggaaaatacatcatggccttcaatcccccatggggagacatcaacaaatcaggacgctccggcattgccctcgtagcaacgggcctcgcaaaactcgccgaaacagaagggaaaggcgtcttcgacgaagccaagaaaacagtcgaagccctcaacggctacctagacaaacacaaagacgaagtagacaaagccagcgcagacaacatgataacaaacctcctcaaacacatcgccaaagcccaagaactctacaaaaactccagcgccctccgcgcccaaggcgcccaaatagacactgcattctcatcatactactggctctacaaagcaggcgtaaccccagaaacattccccaccgtctcccaattcctgttcgaactaggaaaacaaccacgcggcaccaagaaaatgaagaaagccctcctctccacccccatgcgctggggcaagaaactgtacgaactcttcgcagacgactccttccaacaaaaccggatctacatgcaccccgccgtcctcaccgccggacgcatctcagaaatgggagtatgcttcggaacaatacccgtagccaacccagacgacgccgcccaaggaagcggccacaccaaaagcatcctcaacctaagaaccaacaccgaaacaaacaacccctgtgcaaaaacaatcgtcaaactcttcgaaatccagaaaaccggcttcaacatacaagacatggacattgtggcatcagaacacctactacaccaatcgctcgtcggcaaacaatcccccttccaaaacgcctacaacgtgaaaggaaacgcgacgtcagccaacatcatctaa

SEQ ID NO: 8066 - RNA, 1449 nt, synthetic construct
  misc_feature 1..1449: note = derived and/or modified CDS sequence (opt11) from CCHFV(SPU 130/89)__KJ682821.1__N
  source 1..1449: mol_type = other RNA
atggaaaacaaaatcgaagtcaacaacaaagacgaaatgaacaaatggttcgaagagttcaagaaaggcaacggccttgtcgacacctttacgaactcatactccttctgcgaaagcgttcccaacctcgacaaattcgtcttccaaatggcatccgcaaccgatgacgcacaaaaagactcaatatacgccagcgccctcgtagaggcaaccaaattctgcgcacccatctacgagtgcgcgtgggtcagctccaccggcatcgtcaaaagaggcctagaatggttcgaaaaaaacgctggcacaatcaaatcctgggacgaatcctacaccgaactaaaagtagacgtcccaaaaatcgaacagctcgcgaactaccaacaagccgcacttaaatggcgaaaagacataggcttccgcgtaaacgccaacacagcagcactctcaaacaaagtcctcgccgaatacaaggtcccaggcgaaatcgtaatgtccgtcaaagaaatgctcagtgacatgatccggcgaaggaaccagatactaaacaggggcggcgacgaaaacccgcgcggacccgtctcccgcgaacacgtcgactggtgcagagaattcgtcaaaggcaagtacatcatggcctttaacccaccctggggcgacatcaataaatccggccgcagcggaatcgcactagtagccaccggcctggccaaactagcggaaacagaaggcaaaggggtcttcgacgaggccaaaaaaaccgtcgaagccctcaacggatacctagacaaacacaaagacgaagtcgaccgcgcgtcagccgacagcatgatcacaaacctcctcaaacacatcgccaaagcccaagaactatacaagaacagctcagccctgcgcgcacaaggagcccaaatcgacaccgccttctcaagttactactggctctacaaagcaggcgtcacccccgaaacattccccacagtgagccaatttctcttcgaactaggaaaacaaccccgcggtacaaaaaaaatgaaaaaagcactcctatcaacccccatgaaatggggcaaaaaactctacgaattattcgcagacgactccttccaacaaaatcgaatctacatgcaccccgccgtcctcaccgcaggacgaatcagcgaaatgggcgtatgcttcggcacaatccccgtagccaaccccgacgacgcagcacaaggcagcggccacacaaaaagcatccttaacctaaggaccaacaccgaaaccaacaacccctgcgcacgcacaatcgtcaaactattcgaaatccaaaaaaccggcttcaacatacaagacatggacatcgtcgccagcgaacacctactacaccagagcctagtcgggaaacagagcccattccaaaacgcctacaacgtaaaaggaaacgccacctcggcaaacatcgtctaa

SEQ ID NO: 8067 - RNA, 1449 nt, synthetic construct
  misc_feature 1..1449: note = derived and/or modified CDS sequence (opt11) from CCHFV(SPU 18/88)__KJ682818.1__N
  source 1..1449: mol_type = other RNA
atggaaaacaaaatagaagtcaacaacaaagacgagatgaacaaatggttcgaagagttcaagaaaggcaacgggctcgtagacacattcaccaactcctacagcttctgcgaatcggtccccaacctcgacaaattcgtcttccaaatggccagcgccaccgacgacgcccaaaaagactcaatatacgcctcagcactggtcgaagcaacaaaattctgcgcacccatatacgaatgcgcatgggtatcatccaccggcatagtaaaacggggcctagaatggttcgagaaaaacgcaggaaccataaaatcctgggacgaatcctacacagaattaaaagtagacgtccccaaaatcgaacaactagccaactaccaacaagcagccctcaaatggagaaaggacatcggcttccgcgtaaatgccaacaccgccgcactcagcaataaagtcctagccgaatacaaagtaccaggcgaaatcgtcatgtccgttaaagaaatgctatccgacatgatcagacgccgaaaccaaatcctgaaccgaggaggagacgaaaacccccgcggcccagtatcacgcgaacacgtcgactggtgccgtgagttcgtaaaaggcaaatacataatggccttcaacccaccctggggcgacatcaacaaatcgggccgctcaggaatagccctcgtggcaaccggactcgccaaactagccgaaacagaaggcaaaggcgtctttgacgaagcaaagaaaacagtcgaagctctaaacggctacctggacaaacacaaagacgaggtcgatagagcaagcgcagacagcatggtcaccaatctgctaaaacacatagccaaagcgcaagaactctacaaaaactcaagcgccctccgcgcccaaggggcccaaatcgacacagccttctcaagctactactggctatacaaagcaggcgtcacacccgaaacgttccccacggtaagccaattcctattcgaactaggcaaacaaccgcggggaacaaagaaaatgaagaaagcactcctcagcacacccatgaaatggggaaagaaactctacgaactcttcgccgacgactcattccaacaaaaccgcatctacatgcacccagccgtgctaaccgccggccgaatctccgagatgggcgtctgcttcggcaccatccccgtagccaaccccgacgacgctgcccaaggctccggacacaccaaaagcatcctaaacctccgcaccaacacagaaaccaacaacccctgcgctcgcaccatcgtaaaactcttcgaaatacagaaaacagggttcaacatccaagacatggacatagtagccagcgaacaccttctccaccaatccctagtaggcaaacaaagcccattccaaaacgcatacaacgtaaaaggcaacgccacgagcgcaaacataatctaa

SEQ ID NO: 8068 - RNA, 1449 nt, synthetic construct
  misc_feature 1..1449: note = derived and/or modified CDS sequence (opt11) from CCHFV(SPU 187/90)__KJ682823.1__N
  source 1..1449: mol_type = other RNA
atggagaacaaaatagaagtcaacaacaaagacgaaatgaacaaatggttcgaagagttcaaaaagggcaacggcctagtcgacaccttcaccaactcgtactccttctgcgaatccgtaccaaacctcgacaaattcgtcttccaaatggcctcagccaccgacgacgcgcaaaaagactcgatctacgcctcagcactcgtcgaagcaacgaaattctgcgcccccatctacgagtgcgcctgggtaagtagcacaggaatcgtcaaaagaggactggaatggttcgagaaaaacgcgggcaccataaaaagctgggacgaatcctataccgaactcaaagtcgacgtacccaaaatcgaacaactcgccaactaccaacaagcggccctcaaatggcgcaaagacataggcttccgagtcaacgccaacacagcagcactatccaacaaggtcctcgcagaatacaaagtccccggcgaaatcgtgatgtcagtcaaggaaatgctctcagacatgatacggcgccgcaaccaaatcctcaaccggggcggcgacgaaaacccacgaggacccgtcagcagagaacacgtcgactggtgccgcgagttcgtcaaaggcaaatacatcatggcattcaatcccccatggggagacatcaacaaatcgggccgctccggcatcgccctagtggcaaccggactcgccaaactagccgagaccgaaggcaaaggcgttttcgacgaagccaaaaagacagtcgaagcactaaacggctacctggacaaacacaaggacgaagtagaccgcgcaagcgccgacagcatgataaccaacctcctcaaacatatcgcaaaagcgcaagaactctacaaaaacagctcagccctacgcgcgcaaggcgcacaaatcgacaccgcattcagctcatactactggctatacaaagccggcgtcacccccgaaaccttccccaccgtatcccaattcctattcgaactcggcaaacaacccagaggaaccaagaaaatgaagaaagcactcctaagcacgcccatgaaatggggcaagaaactctacgaactcttcgccgacgactcattccaacaaaaccgaatatacatgcaccccgcagtactcaccgccggccgcatatcagaaatgggagtttgcttcggaaccatacccgtagccaaccccgacgacgcagcccaaggcagcggccacaccaaatcaatcctcaacctccaaaccaacactgaaacaaacaacccatgcgcacgcacaatagtaaaactattcgaaatccagaaaactggattcaacatccaagacatggacatcgtcgcatcagagcacctcctacaccaaagcctggtcgggaaacaaagccccttccaaaacgcctacaacgtcaaaggcaacgcaacaagcgcaaacataatctaa

SEQ ID NO: 8069 - RNA, 1449 nt, synthetic construct
  misc_feature 1..1449: note = derived and/or modified CDS sequence (opt11) from CCHFV(SPU 383/87)__KJ682816.1__N
  source 1..1449: mol_type = other RNA
atggaaaacaaaatcgaagtaaacaacaaagacgaaatgaacaaatggttcgaagaattcaaaaaaggcaacggcctagtcgacaccttcactaactcatactcattctgcgaatccgtaccaaacctcgacaaattcgtcttccaaatggccggcgcaaccgacgacgcccagaaagactccatctacgcaagtgcactggtcgaagcaaccaagttctgcgccccaatctacgaatgcgcctgggtcagctctaccggcatcgtcaaacgcggactggaatggttcgaaaaaaacgccggcaccataaaatcatgggacgaaagctacaccgaactaaaagtcgacgtacccaaaatcgaacaattagccaactaccaacaagcagcactcaaatggcgaaaagacataggcttccgcgtcaacgccaacaccgccgctctcagcaacaaggtactagccgaatacaaagtccccggagaaatcgtcatgtccgtaaaagaaatgctctcagacatgataagacgcaggaaccagatcctaaaccgaggcggagacgaaaacccacgcggacccgtaagccgcgaacacgtagactggtgccgagaattcgtcaaaggcaaatacataatggcattcaatcccccctggggcgacatcaacaaatccggccgcagcggcatagccctagtagcaaccggactcgcaaagctcgccgaaacagaaggcaagggcgtcttcgacgaagccaaaaaaacagtcgaagcactcaacggatacctagacaaacacaaagacgaagtcgaccgcgcctccgccgacagcatgatcaccaacctcctcaaacacatcgccaaagcacaagaattatacaaaaacagctcagcactcagagcacaaggagcccagatcgatacggccttctcgagctactactggctgtacaaagcgggagtgacacccgaaacattccccaccgtatcacaattcctattcgagctcggcaaacaaccccgcggcaccaagaaaatgaaaaaagcgctcctgtccactcccatgaaatggggaaaaaaactctacgaactcttcgccgacgacagcttccaacaaaacagaatctacatgcaccccgcagtcctaaccgccggccgaataagcgaaatgggcgtctgcttcggcacaatacccgtcgccaaccccgacgacgccgcccaaggctctgggcataccaaaagcatccttaacctacgcacgaacaccgaaacctcaaacccatgcgcacgtaccatcgtcaaactattcgaaatccagaaaaccggattcaacatacaagacatggacatcgtagcaagcgaacacctactccaccaaagccttgtcggcaaacaaagcccgttccaaaacgcatacaacgtaaaaggcaacgccaccagcgcaaacatcgtataa

SEQ ID NO: 8070 - RNA, 1449 nt, synthetic construct
  misc_feature 1..1449: note = derived and/or modified CDS sequence (opt11) from CCHFV(SPU 383/87)__KJ682816.1__N
  source 1..1449: mol_type = other RNA
atggaaaacaaaatcgaggtaaacaacaaagacgaaatgaacaaatggttcgaagagttcaagaaaggaaacggcctagtcgacaccttcaccaactcctacagcttctgtgaatccgtcccaaacctcgacaaattcgtcttccaaatggccggagcaaccgacgatgcccaaaaagactcaatctacgcctcagccctagtagaagcaacaaaattctgcgcacccatctacgaatgcgcctgggtaagcagcacaggcatcgtcaaaagaggactcgaatggttcgagaaaaacgcggggaccataaaatcctgggacgaatcatacaccgaactcaaagtggacgtccccaaaatcgaacaactagcaaactaccaacaagcagccctcaaatggcgaaaagacataggcttccgcgtaaacgccaacacagccgccctctccaacaaagtcctggcagaatacaaagtcccaggcgaaatcgtcatgtccgtcaaagaaatgctcagcgacatgatccgccgacgaaaccaaatactaaaccgcggcggcgacgaaaacccccgcggcccagtctcccgagaacacgtcgactggtgccgagagttcgtcaaagggaaatacatcatggcattcaacccgccctggggcgacatcaacaaatcaggccgaagcggtatcgccctcgtcgccaccggcctcgccaaactagcagaaaccgaaggcaaaggggtctttgacgaagccaagaaaacagtagaagccctcaacgggtacttagacaaacacaaagacgaagtcgaccgcgcctccgcagactctatgataacaaacctcctcaaacacatcgccaaagcccaagagctatacaaaaacagctcagccctacgcgcacaaggagcacaaatcgacaccgcatttagctcctactactggctatacaaagccggagtgacccccgaaaccttccccaccgtcagccaattcctattcgaacttgggaagcaaccacgaggcaccaaaaagatgaagaaagcactcctaagcaccccaatgaaatggggcaagaagctatacgaactcttcgccgacgactcattccaacaaaaccgcatctacatgcaccccgcagtcctcaccgccggccggatcagcgaaatgggggtctgcttcggcaccatccccgtcgcaaaccccgacgacgcagcccaaggctcaggccacacaaaatcaatactcaacctacgcaccaacaccgagaccagcaatccatgcgcccgaaccatcgtcaaacttttcgaaatccaaaagacgggcttcaacatccaagacatggacatagtagcctccgaacacctcctgcaccaatccctagtaggcaaacaaagccccttccaaaacgcatacaacgtcaaaggaaacgcaacaagcgcaaacatcatctaa

SEQ ID NO: 8071 - RNA, 1449 nt, synthetic construct
  misc_feature 1..1449: note = derived and/or modified CDS sequence (opt11) from CCHFV(SPU 431/85)__KJ682815.1__N
  source 1..1449: mol_type = other RNA
atggagaacaaaatcgaagtcaacaacaaagacgaaatgaacaaatggttcgaagagttcaagaaaggaaacggcctagtagacaccttcacaaactcgtactccttctgcgaatcggtaccgaacctcgacaaattcgtgttccaaatggcaagcgcaaccgatgacgcacaaaaagactccatctacgcctcagccctcgtcgaagccacaaaattttgcgcccccgtatacgaatgcgcatgggtaagctctaccggaatcgtgaaacgaggcctggaatggttcgagaaaaacgcgggaactatcaaatcctgggacgaatcctacacggaactaaaagtcgacgtacccaaaatcgaacaactcgccaactaccagcaagccgccctaaaatggcgtaaagacatcggcttcagagtaaacgcaaacacagccgccctcagcaacaaagtcctcgccgaatataaagtcccaggcgaaatcgtcatgtcggtaaaagaaatgctctcagacatgataagacgtaggaaccaaatcctaaacagaggcggggacgaaaacccacgcggacccgtcagcagagaacacgtcgactggtgccgcgagttcgtaaaaggaaaatacatcatggccttcaacccaccctggggcgacatcaacaaatccggcagatccggaatagccctagtggcaacaggcctcgccaaactagccgaaacagaaggaaagggagtgttcgacgaagccaagaaaacagtcgaagccctaaacggctacctagacaaacacaaggacgaagtcgaccgcgcgagcgcagactcgatgataacaaacctactcaaacatatagcaaaagcacaagagctctacaagaacagctcagccctgagagcgcaaggggcccagatcgacaccgcattctcaagctactactggctctataaagcaggagtcacaccagaaacgttcccaaccgtaagccaattcctattcgaactcggaaaacagcccagaggaaccaagaaaatgaagaaagccctcctaagtacgcccatgaaatggggcaagaaactctacgaactcttcgccgacgacacattccaacaaaaccgcatatacatgcacccggccgtactcaccgccggacgcatatcagagatgggagtatgcttcggaaccatccccgtcgccaaccctgacgacgcagcccaaggctcgggccacaccaaatccatactcaacctaagaaccaacaccgaaaccaacaacccctgcgcacgaaccatcgtaaaactgttcgaaatccagaaaaccggcttcaacatccaagacatggatatcgtagcatcagaacacctactgcaccaaagcctggtcggaaaacaaagcccattccagaacgcctacaacgtcaaaggcaacgcaacaagcgtcaacataatctaa

SEQ ID NO: 8072 - RNA, 1449 nt, synthetic construct
  misc_feature 1..1449: note = derived and/or modified CDS sequence (opt11) from CCHFV(SPU 45/88)__KJ682819.1__N
  source 1..1449: mol_type = other RNA
atggaaaacaaaatagaagtaaacaacaaagatgaaatgaacaaatggttcgaagaattcaagaaaggcaacggactagtcgacaccttcacaaactcgtactcattctgcgaatctgtccccaacctggacaaattcgtcttccaaatggccagcgcgaccgacgacgcccagaaagacagcatctacgcctcagccctcgtcgaggccacaaaattctgcgcacccatctacgagtgcgcctgggtcagctcgacaggtatcgtcaaaagaggcctcgaatggttcgaaaaaaacgcaggcacaataaaatcatgggacgaatcctacacagaactgaaagtcgacgtacccaaaatcgaacaactggccaactaccaacaagcagccttgaaatggcgcaaagacatcggcttccgagtcaacgcaaacacggccgccctctccaacaaagtcctagccgaatacaaagtacccggtgaaatcgtgatgtcagtcaaagaaatgctctccgacatgatacgacgccggaaccagatactaaacaggggcggagacgaaaacccccgaggacccgtaagccgagaacacgtcgactggtgccgagaatttgtcaaaggcaaatacatcatggccttcaacccaccctggggtgacatcaacaaatccggaaggtccggcatcgccctcgtcgccacgggcctggccaaactagcagaaacagaaggcaaaggcgtcttcgacgaagccaaaaaaaccgtagaagctctcaacggatacttagacaagcacaaagacgaagtcgaccgcgcatccgccgactccatgatcaccaacctcctcaaacacatcgcaaaagcccaagaactatacaaaaactcctctgccctccgcgctcaaggcgcccaaatagacaccgcattcagctcctactactggctatacaaagccggcgtcacccccgaaaccttcccaaccgtcagccagttcctcttcgaactaggcaagcaaccaaggggcacaaaaaaaatgaagaaagcactcctatccacacccatgaaatggggcaaaaaactatacgaactcttcgcagacgactctttccaacaaaaccgaatctacatgcaccccgccgtactcacagccggcagaatctccgaaatgggagtctgcttcggaaccataccagtagccaaccccgacgacgcggcccaaggatccggccacaccaaatccatactcaacctacgcaccaacaccgaaaccaacaacccgtgcgcaagaaccatcgtcaaactattcgaaatccaaaaaaccggattcaacatccaagacatggacatcgtggcctccgagcacctcctccaccaaagtctagtcggaaaacaaagcccattccagaacgcctacaacgtcaaaggcaacgccacgagcgccaacataatctaa

SEQ ID NO: 8073 - RNA, 1449 nt, synthetic construct
  misc_feature 1..1449: note = derived and/or modified CDS sequence (opt11) from CCHFV(SPU 48/90)__KJ682822.1__N
  source 1..1449: mol_type = other RNA
atggaaaacaaaatcgaagtcaacaacaaagacgaaatgaacaaatggttcgaagagttcaagaaaggaaacggactcgtcgacaccttcacaaactcgtactcattctgcgaatccgtcccaaacctagacaaattcgtattccaaatggcatccgctaccgacgacgcacaaaaagactcgatctacgcctcggccctagtcgaagcaacgaaattctgcgcgcccatctacgaatgcgcttgggtaagctccaccggcatcgtaaaaaggggcctcgaatggttcgagaaaaacgccggaaccatcaaatcctgggacgaatcctacacagaactcaaagtagacgtgccaaaaatcgaacaactcgccaactaccaacaagcagccctaaaatggcgaaaggacatcggcttccgcgtgaacgccaacaccgcagcactcagcaacaaggtcctcgccgaatacaaagtccctggcgaaatcgtcatgtcagtcaaagaaatgctcagcgacatgatacgccgcaggaatcaaatcctgaatcgcggcggggacgaaaacccccgaggccccgtaagcagagaacacgtagactggtgccgagagttcgtaaaagggaagtacatcatggcattcaacccaccctggggagacataaacaaatccggccggagcggaatcgcactcgtcgccaccggactagcaaaactcgccgaaaccgaagggaaaggcgtcttcgacgaagcaaagaaaacagtcgaagctctaaacggctacttagacaaacacaaagacgaagtagaccgcgcaagcgccgactccatgataacaaatctcttcaaacacatcgcgaaagcacaagaactctacaaaaacagctcagccctccgtgcccaaggcgcccaaatcgacacagccttctcgagctactactggctgtacaaagccggcgtcaccccagagacgttcccaaccgtcagtcaattcctattcgaactcggaaagcagccgaggggaacaaagaaaatgaagaaagcactactaagcaccccaatgaaatggggcaagaaactatacgaactcttcgccgacgactcatttcaacaaaaccgcatatacatgcaccccgcggtcctcaccgcgggaagaatcagcgaaatgggcgtctgcttcggcaccatccccgtcgcaaaccccgacgacgcagcccaaggctcaggacacacaaaaagcatcctcaacctacgaaccaacaccgagacgaataacccatgcgcccgcacaatcgtaaaactattcgagatccagaaaaccggcttcagcatccaagacatggacatagtcgccagcgaacacctactgcaccaatccctagtcggcaaacaatcacctttccaaaacgcatacaacgtcaaaggcaacgccacaagcgcgaacataatataa

SEQ ID NO: 8074 - RNA, 1449 nt, synthetic construct
  misc_feature 1..1449: note = derived and/or modified CDS sequence (opt11) from CCHFV(SPU 497/88)__KJ682820.1__N
  source 1..1449: mol_type = other RNA
atggaaaacaaaatagaagtcaacaacaaagacgaaatgaacaaatggttcgaagagttcaagaaaggaaacgggctcgtcgacacattcaccaactcatactccttctgcgaatcggtcccaaacctcgacaaattcgtattccaaatggcctccgccacagacgacgcacaaaaagactccatctacgcctcagccctcgtagaagccaccaaattctgcgcccccatctacgaatgcgcctgggtatccagcaccggaatcgtaaaaagaggcctagaatggttcgagaaaaacgccgggaccatcaaatcctgggacgaaagctacaccgaactcaaagtagacgttcccaaaatagaacaactagccaactaccaacaagccgccctaaaatggcgaaaagacatcggattccgcgtcaacgccaacaccgcagcgctcagcaacaaagtcctagccgaatacaaagtaccaggcgaaatcgtaatgagcgtcaaagaaatgctaagcgacatgatccgcagacgcaaccaaattctcaaccgcggaggagacgaaaacccccgagggcccgtcagccgcgaacacgtagactggtgtcgagagttcgtcaaaggcaaatacataatggcattcaacccgccatggggcgacatcaacaaaagtggccgatcgggcatcgcgctcgtcgcaacaggcctagccaaactagccgaaaccgaaggaaaaggagtcttcgacgaagcaaagaaaacggtcgaagccctcaacggatacctcgacaaacataaagacgaagtcgaccgggcctcagcagacagcatgatcaccaacctcctcaaacacatagcaaaagcccaggaactctacaaaaactcctccgccctccgcgcccaaggcgcccaaatcgacacagccttctcctcctactactggctctacaaagccggcgtcactccagaaacattccccaccgtaagccaattcctcttcgaactcggcaaacaaccccgaggcacaaagaaaatgaagaaagccctgctcagcacacccatgaaatggggcaagaaactctacgaactcttcgccgacgactccttccaacagaaccgcatctacatgcaccccgcagtgctcacagccggacgaatcagcgaaatgggcgtctgcttcggagccatccccgtagccaatcccgacgacgccgcccagggctccggccacaccaaaagcatactcaacctacgcacaaacaccgaaaccaacaacccctgcgcacgtaccatcgtcaaactattcgaaatccagaaaacaggattcaacatccaagacatggacatcgtagcatcggagcacttactgcaccaaagcctcgtcggaaaacaaagcccgttccaaaacgcctacaacgtgaaaggcaacgcaaccagtgccaacatcatctga

SEQ ID NO: 8075 - RNA, 1449 nt, synthetic construct
  misc_feature 1..1449: note = derived and/or modified CDS sequence (opt11) from CCHFV(SPU 556/87)__KJ682817.1__N
  source 1..1449: mol_type = other RNA
atggaaaacaaaatcgaagtaaacaacaaagacgaaatgaaccgatggttcgaagaattcaaaaaaggtaacggcctcgtagacacattcacaaactcatactccttctgcgaatccgtccccaacctcgaccgattcgtcttccagatggccggcgccaccgacgacgcccaaaaagactcaatttacgcctcggccctcgtcgaggcaacaaaattctgcgcgccaatctacgaatgcgcctgggtaagctccaccggaatcgtcaaaaaaggcctagagtggttcgaaaaaaacgccggcaccatcaaatcgtgggacgaaagctacaccgaactcaaagtcgacgtacccaaaatcgaacaactcgcaaactaccaacaggcagcccttaaatggcgaaaggacatcggattccgcgtaaacgccaacaccgcagccctctccaacaaagtattggccgagtacaaagtccccggagagatcgtcatgtccgtaaaagagatgctctccgacatgatacgacgccgcaaccaaatcttaaacagaggcggcgacgaaaacccaagaggcccggtaagccgcgaacacgtcgactggtgccgcgaattcgtaaaaggcaaatacatcatggcgttcaacccaccatggggcgacatcaacaaaagcggccggtccggcatagccctcgtggccaccggcctagccaagctcgcagaaaccgaaggcaaaggcgtcttcgacgaagcgaaaaaaacagtcgaagccctcaatggctacctagacaaacacaaagacgaagtagaccgcgccagcgccgactccatgataaccaacctccttaaacacatcgcaaaagcacaagaactctacaaaaacagctcagcactacgcgcgcaaggagcccaaatcgacaccgcattctccagctactactggctatacaaagccggcgtcacacccgaaaccttcccaaccgtcagccaattcctcttcgaactcggaaaacagccaaggggcacaaaaaaaatgaaaaaagccctactcagtaccccaatgaaatggggcaaaaaactatacgaactcttcgcagacgacagcttccaacaaaaccgcatctatatgcatcctgccgtactaacagccggccgaatatccgagatgggagtatgcttcggcaccatccccgtagccaacccagatgacgcagcccaaggctccggccacaccaagtcaattctaaacctccgcacaaacacggagaccaacaacccatgcgccaaaaccatagtcaaacttttcgaaatacaaaaaaccggctttaacatacaagacatggacatcgtcgcctcagaacacctcctacaccaaagcctagtaggcaaacagagcccattccaaaacgcatacaacgtcaaaggaaacgccacatccgccaacataatataa

SEQ ID NO: 8076 - RNA, 1449 nt, synthetic construct
  misc_feature 1..1449: note = derived and/or modified CDS sequence (opt11) from CCHFV(SPU 92/01)__KC880335.1__N
  source 1..1449: mol_type = other RNA
atggaaaacaaaatagaagtaaacaacaaagacgagatgaacaaatggttcgaagagttcaagaaaggaaacggcctcgtcgacacattcaccaacagctactcattctgcgaaagcgtaccgaaccttgacaaattcgtcttccaaatggcgagcgcgaccgacgacgcacaaaaagactcgatatacgcatcagccctcgtcgaagccaccaaattctgcgccccaatatacgagtgcgcatgggtaagcagcaccggaatcgtaaaaaggggactcgagtggttcgagaaaaacgcaggaacaatcaaatcctgggacgaatcgtacactgaactcaaagtagacgtgccaaaaatcgaacaactcgccaactaccaacaagcagccctaaaatggagaaaagacatcggcttccgcgtaaacgcaaacacagccgcactctcaaacaaagtcctagccgaatacaaagtcccaggcgaaatcgtcatgtcagtaaaggaaatgctttcagacatgatacgccggagaaaccagatcctcaacagaggcggcgacgaaaacccgcgcggcccagtaagcagggaacacgtcgactggtgccgcgagttcgtaaaaggcaaatacatcatggccttcaacccgccctggggagacatcaacaaaagcggcagaagcggcatcgccctagtagcaacaggacttgcaaaactcgcagaaacagaagggaaaggagtcttcgacgaagctaagaaaacggtagaagcactcaacggatacctagacaaacacaaagacgaagtcgaccgcgcgtccgcagactcgatgataaccaacctactcaaacacatagcaaaagcccaagaactatacaaaaacagctccgccctccgcgcgcaaggagcacagatcgacacagcgttctccagctactactggctctacaaagccggcgtaacccccgaaacattcccaacagtaagccagttcctcttcgaactcggaaaacaaccacggggcaccaaaaagatgaagaaagcactactaagcacacccatgaagtggggaaagaaactgtacgaactcttcgccgacgactccttccaacaaaaccgcatatacatgcacccggccgtcctcacggccgggcgcatatcagaaatgggagtatgcttcggaaccatacccgtggccaaccccgacgacgcagcccaaggctcgggccataccaaaagtatactcaacctccaaaccaacaccgaaaccaacaacccatgcgcacgcacaatagtcaaactcttcgaaatacagaaaacaggattcaacatacaagacatggacatcgtagcctcagaacacctactacaccagagcctagtcggaaaacaaagccccttccagaacgcctacaacgtaaaaggaaacgcgaccagcgttaacatcatctag

SEQ ID NO: 8077 - RNA, 1449 nt, synthetic construct
  misc_feature 1..1449: note = derived and/or modified CDS sequence (opt11) from CCHFV(SRR)__KU707901.1__N
  source 1..1449: mol_type = other RNA
atggaaaacaaaatagaagtcaacaacaaagacgaaatgaataaatggttcgaggagttcaaaaagggaaacggcctagtcgacacattcaccaatagctacagcttctgcgaatccgtccccaacctcgaccgcttcgtattccaaatggctggcgcaaccgacgacgcacaaaaggactccatatacgcctccgccctagtcgaggccacaaaattctgcgccccaatatacgaatgcgcgtgggtctcatccaccggcatagtcaagaaaggccttgagtggttcgaaaagaacgccggaacaatcaaaagctgggatgaatcctacaccgaactcaaagtggaagtacccaaaatcgaacaactggcgaactaccaacaagccgcactcaaatggcgcaaagacataggcttccgagtcaacgcaaacaccgccgcactctcacacaaagtcctcgccgaatacaaagtcccaggagaaatagtaatgtcggtaaaagaaatgctaagcgacatgatccgacgcagaaacctaatactcaaccgtggaggagacgaaaaccccagaggccccgtaagccgcgaacacgtggaatggtgcagagagttcgtcaaaggcaaatacatcatggcattcaacccaccctggggagacatcaacaaaagcggaagaagcggcatcgcactcgtggccaccggcctggcaaaactggccgaaacggaaggcaaaggagtcttcgatgaagcaaagaaaaccgtcgaggcactaaacggctacctagacaaacacaaagacgaagtcgacaaagccagcgccgacaacatgataaccaacctactaaaacacatagccaaagcccaagaactatacaaaaacagcagcgcactacgcgcacagggcgcgcaaatcgacaccgccttcagcagctactactggctctacaaggccggcgtcacccccgaaacattcccaacagtctctcaattcctcttcgaactcggtaaacaaccccgaggcacaaagaaaatgaagaaagcactactatctacaccaatgcgatggggcaagaaactctacgaactcttcgcggacgactccttccaacaaaatcgcatctatatgcacccggcggtactcaccgccggccgcatcagcgaaatgggagtctgcttcgggacaatccccgtcgccaaccccgatgacgcagctcaaggcagcggccacaccaaatccatcctaaacctacgaaccaacaccgaaaccaacaacccatgcgcaaaaaccatcgtaaaactcttcgaaatccagaaaaccggcttcaacatacaagacatggacatcgtagcatcggaacacctcctgcaccaatccctcgtcggaaaacaaagcccattccaaaacgcatacaacgtcaaaggcaacgccaccagcgccaacataatctaa

SEQ ID NO: 8078 - RNA, 1449 nt, synthetic construct
  misc_feature 1..1449: note = derived and/or modified CDS sequence (opt11) from CCHFV(STV/HU29223)__AF481802.1__N
  source 1..1449: mol_type = other RNA
atggaaaacaaaatagaagtaaactcaaaagacgaaatgaacaaatggttcgaagagttcaagaaagggaacgggctcatggataccttcacaaactcatactccttctgcgaaaacgtacccaacctcgacaaattcgtcttccaaatggccagcgccaccgacgacgcacaaaaagactcaatctacgcatcagccctagtcgaagccacgaaattctgcgcacccatatacgaatgcgcctgggtgagctccaccggcatagtaaagaaaggcctcgaatggttcgagaaaaacagcggcacaatcaaatcatgggacgaaaactacgcagaactcaaagtcgacgtgcccaaaatcgaacaattagccaactaccaacaagcagccctcaaatggcgcaaagacatcggattccgcgtgaacgccaacactgcagccctctccaacaaagtcctagccgagtacaaagtcccaggagaaatcgtgatgagcgtaaaagaaatgctctccgatatgatccgacgacgcaacctaatcctcaacagaggcggcgacgaaaacctacgcggacccgtcagccgagaacatgtcgagtggtgcagagagttcgtgaaaggaaagtacatcatggcattcaatcccccatggggagacatcaacaagtcgggccgcagcggaatcgcactggtcgcaaccggcctcgcaaagctcgccgaaaccgaagggaaaggcgtcttcgacgaagccaagaaaacagtagaagccctaaacggatacctagacaaacaccgagacgaagtagacaaagcctccgccgactcaatgatcaccaatctccttaaacacatcgcgaaagcccaagaactctataagaacagcagcgccctccgcgcccaaggagcacaaatcgacacaccattctcctcattctactggctctacaaagccggagtaaccccggaaacattccccaccataagccaattcctattcgaactcggcaaacaacccagaggcaccaagaaaatgaagaaagccctactcagcacacccatgaaatggggcaagaaactctacgaactattcgccgacgactccttccaacaaaaccgcatctacatgcaccctgccgtcctaacggcaggacgcatcagcgaaatgggcgtatgcttcggcaccatacccgtcgccaacccagacgacgccgcccaaggctcgggccacacaaaaagcatcctcaacctccgcacctcgacagaaactaacaacccgtgcgccaaaaccatcgtcaaactattcgaaatccagaaaaccggcttcaacatccaagacatggacatcgtcgcctcagaacacctcctccaccaaagcctcgtcggaaaacaaagccccttccaaaacgcgtacaacgtcaaaggcaacgccaccagtgccaatatcatctag

SEQ ID NO: 8079 - RNA, 1449 nt, synthetic construct
  misc_feature 1..1449: note = derived and/or modified CDS sequence (opt11) from CCHFV(TAJ/HU8966)__AY049083.2__N
  source 1..1449: mol_type = other RNA
atggaaaacaaaatagaagtcaataacaaagacgagatgaacaaatggtttgaagagttcaagaaaggaaacggcctagtcgacacattcacaaactcatattccttctgcgaatccgtccccaacctagaccgattcgttttccaaatggccagcgcaaccgacgacgcacaaaaagacagcatatacgcctcggccctcgtagaagccacaaaattctgcgcccccatctacgaatgcgcctgggtaagctcaaccgggatcgtcaagaaaggcctcgaatggttcgagaaaaacgccggcaccatcaaatcatgggacgaatcctacaccgaactaaaagtagaagtcccaaaaattgaacaactggccaactaccaacaagcagccctcaaatggcgaaaagacatagggttccgtgtaaacgcaaacaccgcagcactatcccacaaagtcctagccgaatacaaagtcccgggcgaaatagtaatgtccgtcaaagaaatgctaagcgacatgatccggagacgaaacctgatcctcaaccggggcggagacgaaaacccccgcggacccgtctccagagagcacgtcgaatggtgccgagagttcgtcaaaggaaaatacataatggcattcaaccctccctggggcgacatcaataaatccgggcgctccggcatagccctcgtagccacgggcctcgcaaagctagccgaaaccgaaggcaaaggcgtcttcgacgaagccaagaaaaccgtcgaagccctaaacggatacctcgacaaacacaaagacgaagtcgacaaagcctccgcagacaacatgataaccaacctcctgaaacacatcgccaaagcacaagaactctacaaaaacagctccgccctacgcgcccaaggagcccaaatcgacaccgcattctcctcatactactggctctacaaagcaggcgtcaccccagaaacgttccccaccgtatcccaattcctattcgaactaggcaaacagccccgaggcaccaagaaaatgaagaaagcgctcttatccacgcccatgaaatggggcaagaaactctacgaactcttcgccgacgactccttccaacaaaaccgcatctacatgcacccagcagtactcacagccggccgcataagcgaaatgggcgtctgcttcggcacaatcccagtcgccgaccctgacgacgccgcacaaggctccggccacacaaaaagcatactaaacctcagaacaaacaccgaaaccaacaacccgtgcgccaaaacgatagtaaaactattcgaaatacagaaaacaggcttcaacatccaagacatggacatcgtagccagcgaacacctcctgcaccaatcactcgtcggaaaacagagccccttccaaaacgcctacaacgtaaaaggaaacgccacgtcagcaaacatcatctaa

SEQ ID NO: 8080 - RNA, 1449 nt, synthetic construct
  misc_feature 1..1449: note = derived and/or modified CDS sequence (opt11) from CCHFV(TAJ/HU8975)__AY297692.2__N
  source 1..1449: mol_type = other RNA
atggaaaacaaaattgaagtaaacaacaaagatgaaatgaacaaatggttcgaagagttcaagaaaggcaacggactcgtggatacattcaccaactcatacagcttctgcgaatcagtccccaacctcgacaggttcgtattccaaatggcctccgccacagacgacgcccaaaaagactccatctacgcatcagccctcgtcgaagccaccaaattctgcgcccccatatacgaatgcgcatgggtcagctcaaccggcatcgtaaagaaaggcctagagtggttcgagaaaaacgccggaaccataaaatcctgggacgagtcatacatagaactaaaagtcgaagtccccaaaatcgaacaactagccaactaccagcaagcggccctcaaatggagaaaagacatcggatttcgagtgaacgccaacaccgccgctctatcccacaaagtcctagcagaatataaagtccccggagaaatagtcatgagcgtcaaagaaatgctctccgacatgatccgacgccggaacctaatactgaaccgaggcggagatgaaaacccacgcggacccgtgtccagagaacacgtcgaatggtgccgagagttcgtcaaaggaaaatacataatggcattcaacccaccctggggcgacatcaataaatccggccgaagcggcatcgccctagtagcaacaggactggccaaactcgccgaaacagaaggcaaaggcgtcttcgacgaggccaagaaaacagtcgaagccctaaacgggtatctagacaaacacaaagacgaggtagacaaagcctcagccgacaacatgatcaccaacctcctcaaacacatcgccaaagcccaagaactatacaaaaactcaagcgccctaagagcacaaggagcccaaatcgacaccgccttcagctcctactactggctatacaaagccggagtcacccccgaaacctttcccaccgttagccaattcctcttcgaactgggaaaacaaccccgcggtacaaagaaaatgaagaaagccctactctccacccccatgaaatggggaaagaaactatacgaactcttcgcagacgactccttccaacaaaaccgcatctacatgcaccccgccgtcctcaccgcgggccgaatcagcgaaatgggcgtctgcttcggcaccatcccagtggccaaccccgacgacgccgcacaaggatcgggccacaccaaatccatcctcaacctcagaaccaacaccgagaccaacaacccatgcgccaaaacaatcgtaaaactcttcgaaatccagaaaacaggcttcaacatccaagacatggacatcgtggcatccgaacacctcctgcaccaatccctggtcggcaaacaatcccccttccaaaacgcctacaacgtcaaaggcaacgccaccagcgccaacatcatctaa

SEQ ID NO: 8081 - RNA, 1449 nt, synthetic construct
  misc_feature 1..1449: note = derived and/or modified CDS sequence (opt11) from CCHFV(TAJ/HU8978)__AY297691.2__N
  source 1..1449: mol_type = other RNA
atggagaacaaaatcgaagtcaacaataaagacgaaatgaacaaatggttcgaagagttcaagaaaggcaacggcctcgtagacaccttcaccaactcctactccttctgcgaatccgtccccaacctcgaccgcttcgtattccaaatggccggcgcaaccgacgacgcccaaaaagacagcatctacgcctccgcactcgtagaggcaacaaaattctgcgccccaatctacgaatgcgcctgggtatcatccacaggcatagtcaagaaaggcctcgaatggttcgagaaaaacgcaggcacaatcaaatcatgggacgaatcctacaccgaactaaaagtcgaggtccccaaaatcgagcaactcgccaactaccaacaagccgccctaaaatggcgcaaagacataggattcagagtcaacgccaacacagccgcgctctcccacaaagtactcgcagaatacaaagtccccggagaaatcgtcatgagcgtcaaagaaatgctctccgacatgatacgtcggcgaaacctattcctcaacagaggaggcgatgagaacccccgaggccccgtcagcagggaacacgtagaatggtgccgcgagttcgtaaaaggaaaatacatcatggccttcaacccgccatggggagacatcaacaaaagcggacgctccggaatagccctcgtagccacaggactcgcaaaactcgccgaaaccgaaggcaaaggagtcttcgacgaagccaaaagaaccgtggaagcactcaacgggtatctagacaaacacaaagacgaagtagacaaagccagcgccgacaacatgataaccaacctactcaaacacatagcaaaggcgcaagagctctacaaaaactccagcgccctccgagcccaaggcgcacaaatagacacctcattctcatcctactactggctatacaaagccggccgaaccccagaaaccttccccacagtaagccaattcctcttcgaactcggaaaacaaccccgaggcacaaagaaaatgaagaaagccctactcagcaccccaatgaaatggggcaagaaactctacgaactattcgcagatgactcattccaacaaaaccgcatctacatgcacccagccgtcctcaccgccggccgcatctccgaaatgggagtctgcttcggcaccatccccgtcgccaacccagacgacgccgcccaagggagcggccacaccaaaagcatcctcaacctccgaaccaacacagagaccaacaacccctgcgcaaaaacgatcgtcaaactcttcgagatacagaaaaccggattcaacatacaagacatggacatcgtcgcgtccgaacacctcctccaccaaagcctcgtcggcaaacaaagccccttccaaaacgcctacaacgtcaaaggcaacgccacctccgccaacatcatctaa

SEQ ID NO: 8082 - RNA, 1449 nt, synthetic construct
  misc_feature 1..1449: note = derived and/or modified CDS sequence (opt11) from CCHFV(Uzbek/TI10145)__AF481799.1__N
  source 1..1449: mol_type = other RNA
atggaaaacaaaattgaagtcaacaacaaagatgaaatgaacaaatggttcgaagaattcaaaaaaggcaacggacttgtcgacacattcacaaactcatacagcttctgcgaatcagtacccaacctcgaccgcttcgtattccagatggcatccgcaacagacgacgcacaaaaagatagcatctacgcgagcgccctcgtcgaagccacaaaattctgcgcacccatatacgaatgcgcatgggtcagcagcaccggaatagtcaaaaaaggcctcgaatggttcgaaaagaacgccggcacaataaaatcctgggacgaaagctacacggagctaaaagtagaagtaccaaaaatcgaacaactggccgactaccaacaagccgccctaaaatggagaaaagacataggcttcagagtaaacgcgaacaccgcagcactcagccacaaagtcctagcggagtacaaggtaccaggcgaaatagtaatgagcgtaaaggaaatgctatccgacatgatcagacgacgcaacctcatcctcaaccgcggaggcgacgaaaacccccgaggccccgtcagccgcgagcacgtagaatggtgcagggaattcgtcaaaggcaaatacatcatggcattcaacccaccctggggcgacatcaacaaatccggccgatccgggatcgcactcgtcgccaccggcctggccaaactcgccgaaaccgagggcaaaggggtcttcgacgaggctaaaaaaaccgtcgaagcactcaacggctacctagacaaacacaaagacgaagtcgacaaagcaagcgccgataacatgatcaccaacctactaaaacacatcgctaaagcccaagagctctacaaaaactcctcagctctacgagcacaaggcgcccaaatcgacacggccttctcatcatactactggctatacaaagcaggcgtcacacccgaaacgttcccaacagtcagccaattcctcttcgaactcggcaaacaaccccgcggcaccaaaaaaatgaaaaaagccctcctcagcacacccatgaaatggggcaaaaagctttacgaactattcgcagacgactcattccaacaaaaccgaatctacatgcaccccgccgtcctcacagccggccgaatatcagaaatgggcgtctgcttcggaaccatccccgtcgccaaccccgacgacgccgcccagggctcaggccacaccaaatccatactcaacctccgaaccaacaccgaaaccaacaacccatgtgccaaaacaatcgtcaaactgttcgaaatccaaaaaaccggcttcaacatccaagacatggacatcgtggcaagcgaacacctcctccaccaaagcctagtcgggaaacaatcaccattccaaaacgcctacaacgtcaagggaaacgccacctccgcaaacatcatctaa

SEQ ID NO: 8083 - RNA, 1449 nt, synthetic construct
  misc_feature 1..1449: note = derived and/or modified CDS sequence (opt11) from CCHFV(ROS/TI28044)__AY277672.1__N
  source 1..1449: mol_type = other RNA
atggaaaataaaatcgaagtaaactccaaagacgaaatgaacaagtggttcgaggaattcaaaaaaggcaatggactaatggacacattcacaaactcatacagcttctgcgaaaacgtcccaaacctagacaagttcgtattccaaatggccagcgccacagacgacgcacaaaaagacagcatctacgcatcagccctagtggaagccaccaagttctgcgcccccatctacgaatgcgcatgggtcagcagcaccggaatagtaaaaaaaggtctagaatggttcgaaaaaaacagcggcactataaaaagctgggacgaaaactacgccgaactcaaagtcgacgtacccaaaatagaacaactcgccaactaccaacaagccgccctcaaatggagaaaagacataggattccgagtcaacgccaacaccgcagccctatccaacaaagtcctagcggaatacaaagtccctggcgaaatcgtcatgtccgtcaaagaaatgctcagcgacatgatacgccgaagaaatctgatcctcaatcgaggaggcgacgaaaatccccgcggacccgtcagtcgagaacacgtcgagtggtgccgcgaattcgtaaaaggaaaatacataatggcattcaacccaccctggggcgacatcaacaaacccggccgatcaggaatcgccctagtcgccaccggcctcgccaaactcgccgaaacagaaggcaaaggagtcttcgacgaagcgaaaaaaaccgtagaagccctcaacggctacctcgacaaacaccgagacgaagtagacaaagcgtccgcagactccatgatagcaaacctcctaaaacacatcgccaaagcccaagaactctacaagaatagctcagcactgcgagcccaaggagcacaaatagacaccccattctcatccttctactggctctacaaagccggcgtaacccccgagacattcccaacgataagccaattcctgttcgaacttggaaaacaaccccgaggcaccaaaaaaatgaaaaaagcgttactctcaacacccatgaaatggggcaaaaaactctacgaactgttcgccgacgactccttccaacaaaaccgcatctacatgcaccccgcggtcctcaccgccggccgaatcagcgaaatgggcgtctgcttcggcaccatccccgtcgcgaaccccgacgacgcagcccaaggaagcggccacaccaaaagcatcctaaacctccgcaccagcaccgaaaccaacaacccctgcgccaaaaccatagtaaaactcttcgaaatccaaaaaacgggtttcaacatccaagacatggacatcgtcgccagcgaacacctgctccaccaaagcctcgtcggaaaacaatcccccttccaaaacgcatacaacgtcaaaggcaacgccacgagcgccaacatcatctaa

SEQ ID NO: 8084 - RNA, 1449 nt, synthetic construct
  misc_feature 1..1449: note = derived and/or modified CDS sequence (opt11) from CCHFV(7001)__AF415236.1__N
  source 1..1449: mol_type = other RNA
atggaaaacaaaatcgaagtgaacaacaaagacgaaatgaacaaatggttcgaagagttcaagaaaggaaacggcctcgtcgacaccttcacaaactcctactccttctgcgaatccgtccccaacctagaccgcttcgtcttccagatggcctccgcaacagacgacgcacaaaaagactcgatctacgcctcagccctagtcgaagcaaccaaattctgcgcccccatctacgaatgcgcctgggtatcatcaaccggaatagtaaaacgcggcctagaatggttcgagaaaaacgccggtacaatcaaatcatgggacgaatcctacacggaactgaaagtcgaagtccccaaaatcgaacaactggccgactaccaacaagcagccctcaaatggcgcaaagacatcggattccgcgtcaacgccaacacaacggccctcagccacaaagtcctcgccgaatacaaagtcccaggcgaaatagtaatgagcgtcaaagaaatgttatccgacatgatccgccgccgtaacctcatcctcaaccgaggcggcgacgaaagcccccgcggccccgtctcccgcgaacacgtcgaatggtgccgagagttcgtcaaaggaaaatacataatggcatttaacccaccctggggcgacatcaacaaatcaggccgaagcggcatcgccctagtcgcaaccggcctagctaaactcgccgaaacagaaggaaaaggggtcttcgacgaagccaagaaaacagtcgaagccctcaacggatacctcaacaaacacaaagacgaagtcgacaaagcctcagccgactccatgatcaccaacctcctcaaacacatcgccaaagcgcaagaactatacaaaaactcatccgccctaagagcccaaggcgcacaaatcgacaccgcattctctagctactactggctctacaaagccggagtaaccccggaaacattccccaccgtctcccaattcctcttcgaacttggaaaacagccccgaggaacgaagaaaatgaagaaagccctcctctcaaccccattaaaatggggcaagaaactctacgaactcttcgcagacgacagcttccaacagaaccgaatctacatgcacccagcagtgcttacagccggccgcatctccgaaatgggtgtatgcttcggcaccatccccgtcgccaacccagacgacgcagcccaaggctccggacacaccaaatcaatcctaaacctacgcaccaacaccgaaaccaacaacccatgccccaaaacaatcgtcaaactattcgaaatccagaaaaccggcttcaacatccaagacatggacatcgtagccagcgaacacctcctacaccagagcctcgttggaaaacaaagcccattccaaaacgcctacaacgtcaaaggcaacgcaaccagcgccaacatcatatag

SEQ ID NO: 8085 - RNA, 1449 nt, synthetic construct
  misc_feature 1..1449: note = derived and/or modified CDS sequence (opt11) from CCHFV(79121M18)__GU477494.1__N
  source 1..1449: mol_type = other RNA
atggaaaacaaaatagaggtcaataacaaagacgagatgaacaaatggttcgaggagttcaaaaagggcaacggcctcgtagacaccttcacaaactcctactccttctgcgaatccgtaccaaacctcgaccgcttcgtgttccaaatggcctccgcaaccgacgacgcacaaaaagactccatctacgcaagcgccctcgtagaagcgaccaaattctgcgccccgatatacgaatgcgcctgggtcagcagcaccggcatagtgaaacgaggacttgaatggttcgagaaaaacgcaggcaccatcaagagctgggacgaatcatacaccgaacttaaagtagaagtaccgaaaatagaacaactcgccgactaccaacaggcagccctaaaatggagaaaagacatagggttcagagtaaacgccaacacaaccgccctcagccacaaagtcctcgccgaatacaaagtaccaggagaaatcgtcatgagcgtaaaagaaatgctctcagacatgatacgacgacgaaacctcatcctgaaccgcggcggcgacgaatcaccccgcggccccgtcagcagagaacacgtcgaatggtgccgcgagttcgtaaaaggcaaatacatcatggccttcaacccaccctggggagacatcaacaaaagcgggcgaagcggaatcgccctcgtcgccaccggactagccaaactggccgaaactgaaggaaaaggagtattcgacgaagccaagaaaacagtggaagccctgaacgggtacctgaacaagcacaaagacgaagtcgacaaagcctccgcagactccatgatcacaaacctcctcaaacacatagcaaaagcccaagaactctacaaaaacagctcagcactccgagcccagggcgcacaaatcgacaccgccttctcaagctactactggctatacaaagcaggagtcacccccgaaacattcccaacagttagccaattcctcttcgaactaggcaaacaaccccgcggaacaaagaaaatgaagaaagcactcctaagcaccccacttaaatggggaaagaaactatacgaactcttcgccgacgacagcttccaacaaaacagaatctatatgcaccccgcagtgctcacagccggccgtatatcagaaatgggagtctgcttcggcaccataccagtcgcaaaccccgacgacgccgcacaaggcagcggccacaccaaatccatcctcaaccttcgcaccaacacagaaactaacaacccctgcgctaaaacaatagtcaaactcttcgaaatccagaaaaccggattcaacatccaagacatggacatagtcgcaagcgaacacctccttcaccaaagcctagtaggcaaacaaagtcccttccaaaacgcatacaacgtcaaaggaaacgccacctccgccaacatcatctaa

SEQ ID NO: 8086 - RNA, 1449 nt, synthetic construct
  misc_feature 1..1449: note = derived and/or modified CDS sequence (opt11) from CCHFV(AP92)__DQ211638.1__N
  source 1..1449: mol_type = other RNA
atggaaaacaaaatagaagtcaatagcaaagacgaccttaacaaatggttcgaagaattcaaaaaaggtaacgggctagtagacacatttaccaatagctacagcttctgcgaaaatgtccctaacctagacagattcgtctaccaaatggcctcagccaccgacgacgcgcaaaaagacagcatctacgcctccgcacttgtagaagccaccaaatactgtgccccaatatacgaatgcgcctgggtatcatccaccggaatcgtcaaaaaaggtctcgaatggttcgaaaagaatacatccacaatcaaaagctgggacgagagctacaccgagctaaaagtagacatccccaaaatcgaacaactctccagctaccaacaagccgctctcaaatggcgcaaagacatcggcttccgcatcaacgcaaacaccacagctctctccaacaaagtcctagccgaatacaaagtccccggcgaaatcctagtccccgtaaaagaaatgctctctgacatgatccgcagaagaaacataatactaaaccgaggctccgatgaaaacccccggggcccggtctcacacgagcacatcgaatggtgccgcgaattcatcaaaggcaaatacataatggcattcaaccccccctggggagacataaacaaatcaggacgatccggcatcgccctcgtcgccacaggcctcgccaaactcgcagagaccgaaggaaaaggagtattcgaagaagcaaaaaaaaccgtcgaagccctaaaagactacctcgacaaacacagagacgaagtcgacaaaacatcagcggacaacatggtaaccagcctactcaaacacatcgccaaagcccaagaactctacaaaaactcatccgcactacgagcacaaggcgcccaaatcgacacccctttcagctccttctactggctctacaaagcaggagtcacccccgaaaccttccccacagtctcccaattcctcttcgaactcggaaaacagccccgaggcaccaaaaaaatgaaaaaagccctcctatcgacccccatgaaatggggaaaaaagctctacgaactcttcgccgacgactccttccaacaaaaccgcatctacatgcaccccgcggtactcacagccggacgcatctccgaaatgggcgtctgcttcggaaccatacccgtcgccaaccccgacgacgccgcgcagggctcaggccacaccaaatccatcctcaacctacgcaccaacaccgagtcaaacaacccctgcgcccgtacaatagtcaaactcttcgaaatccagaaaaccggcttcgacatcaaagacatggacatcgtcgcctcagaacacctcctccaccaaagcctcgtcggcaaacaaagccccttccaaaacgcctacaacgtcaaaggcaacgccacctccgccaacatcatataa

SEQ ID NO: 8087 - RNA, 1449 nt, synthetic construct
  misc_feature 1..1449: note = derived and/or modified CDS sequence (opt11) from CCHFV(ArD15786)__DQ211640.1__N
  source 1..1449: mol_type = other RNA
atggaaaacaaaatagaagtcaacaacaaagacgaactaaacaaatggttcgaagagttcaagaaaggcaacgggctcgtggacacattcacaaacagctactccttctgcgaaaacgtcccaaacctcgacagattcgtcttccaaatggcaggcgccaccgacgacgcccaaaaagactccatctacgccagcgccctagtagaagccaccaaatactgcgcccccatctacgaatgcgcctgggtcagcagcaccggcatagtgaaacgaggcctcgaatggttcgagaaaaacacagggaccataaaatcctgggacgaaagctacacagaactaaaagtagacgtccccaaaatcgaacaactagcaaactaccaacaggccgccctaaaatggcgtaaggacataggattccgcgtaaacgcaaacacagccgcactctccaacaaagtcctgagcgaatacaaagtacccggagaaatcgtaatgtcggtaaaagaaatgttaagcgacatgatacgccgacgcaacctgatcctcaaccgcgggggcgacgaaaacccacgaggaccagtttcaaaagaacacatagaatggtgcagggagttcgtgaaaggcaaatacataatggcgttcaacccaccctggggagacgtaaacaaatccggcagaagcggaatagcgctagtagccacaggcctcgcaaaactcgccgaaaccgaaggcaaaggggtcttcgaagaagccaaaaagaccgtagaagccctaaaagaataccttgacaaacacaaagacgaggtcgacaaagcatcagccgacagcatggtaacaaacctcctaaaacatataacaaaagcacaagaactctacaaaaacagcagcgcactcagagcccaaggagcacaaatcgacacccccttcagcagcttctactggctatataaagcaggcgtaaccccggaaaccttcccaaccgtcagtcaattcctattcgaactcggaaaacagccgcgcgggacgaagaaaatgaagaaagccctcctctccacccccatgaaatggggaaagaaactctacgaactcttcgcagatgactcattccaacaaaaccgcatctacatgcacccggccgtactcaccgccggccgcatcagcgaaatgggcgtctgcttcggcaccatcccggtcgccaaccccgacgacgcagcacaaggaagcggccacacaaaaagcatactcaacctccgcaccaactccgaaaccaacaacccctgcgcaaaaaccatcgtaaaactattcgaagtgcagaaaaccggcttcaacatccaagacatggacatagtagcctcagaacacctcctgcaccagagcctagtaggaaaacagagcccattccaaaacgcctacaacgtaaaaggcaacgcaacgtcggccaacataatctag

SEQ ID NO: 8088 - RNA, 1449 nt, synthetic construct
  misc_feature 1..1449: note = derived and/or modified CDS sequence (opt11) from CCHFV(ArD39554)__DQ211641.1__N
  source 1..1449: mol_type = other RNA
atggaaaacaaaatcgaagtcaacaacaaagacgaaatgaacaaatggttcgaagagttcaagaaaggcaacggcctagtagacaccttcacgaactcctacagcttctgcgaatccgtcccaaacctcgacaaattcgtcttccaaatggccagcgccaccgacgacgcgcaaaaagacagcatctatgcttccgccctcgtcgaagccaccaaattctgcgcacccatctacgaatgcgcctgggtaagcagcacaggaatcgtaaaaagaggcctagaatggttcgagaaaaacgccggcaccatcaaatcctgggacgaatcctacaccgaattaaaagtcgacgtcccaaaaatcgaacaactcgccaactaccaacaagcagccctaaaatggagaaaagacataggattccgagtaaacgccaacaccgccgcactatccaacaaagtcctggccgaatacaaagtcccaggcgaaatcgtaatgagcgtaaaagaaatgctttcggacatgatacggcgacgcaaccaaatcctcaaccgcggcggcgacgaaaacccacgaggaccagtctcgcgggaacacgtcgactggtgccgagagttcgtaaaaggaaaatacatcatggccttcaacccaccctggggcgacatcaataagtcaggccgaagcgggatagccctagtcgccactggcctagccaaactcgcagaaaccgaagggaaaggagtcttcgacgaagcaaagaaaacagtcgaagccctcaacggctacctcgacaaacacaaagacgaagtagacaaagcctccgccgactccatgatcaccaacctactcaaacacatagccaaagcacaagaactctacaaaaactcaagcgcactccgcgcccaaggagcccaaattgacacagcattctcaagctactactggctgtataaagccggagtcacccccgagaccttcccgaccgtcagccaattcctattcgaactcggcaaacaaccccgaggcaccaagaagatgaagaaagcactcctaacaacccccatgaaatggggcaagaaactttacgaactcttcgccgacgactccttccaacaaaaccgcatctacatgcaccccgccgtcctcaccgctggccgcataagcgaaatgggcgtctgcttcggaacaatccccgtcgccaaccccgacgacgcggcccaaggcagcggacacaccaaatccatactcaacctcaggacaaacaccgagaccaataacccatgcgcacgcacaatcgtcaaactcttcgagatccaaaagacaggattcaacatccaagacatggacatcgtcgcctccgagcacctactccaccaatccctagtcgggaaacaaagcccgttccaaaacgcctacaacgtcaaaggcaacgccaccagcgccaacataatttag

SEQ ID NO: 8089 - RNA, 1449 nt, synthetic construct
  misc_feature 1..1449: note = derived and/or modified CDS sequence (opt11) from CCHFV(BT958)__EF123122.1__N
  source 1..1449: mol_type = other RNA
atggaaaacaaaatcgaagtcaacaacaaagacgagatgaacaggtggttcgaagagttcaagaaagaaaacggccttgtcgacacattcacaaacagccactcattctgcgaatcagtccccaacctagacaaattcgtcttccaaatggcaagcgcgaccgacgacgcccaaaaagactccatatacgcagccgccctagtagaagcaaccaaattctgcgcgccaatatacgaatgcgcctgggtctcatcgaccggaatcgtaaagaaaggcctggaatggttcgagaaaaacgccggcacaataaaatcgtgggacgaatcatacacagaactcaaagtcgaagtcccaaaaatcgaacaactaagcaactaccaacaagccgccctaaaatggcgaaaagacataggcttcagagtaaacgcgaacaccgcaaccctctcacacaaagtcctcgccgaatacaaagtcccaggcgaaatcgtgatgtccgtcaaagaaatgctatccgacatgatacgccgacgaaacctcatcctaaaccgaggcggagacgaaaacccccgcggccccgtatcccgcgaacacgtcgaatggtgcagagagttcgtcaaaggcaaatacataatggcatttaacccaccatggggagacatcaacaaatccggccgatcgggaatcgccctagtagcaaccggactcgcaaagctcgccgaagccgaagggaaaggcgtcttcgacgaagccaagaaaacagtcgaagcactgaacgggtacctagacaaacacaaagacgaagtcgataaatcatccgccgactccatgataacaaacctactgaaacatatcgccaaagcccaagaactctatcgcaacagctccgccctccgcgcacagggcgcccagatcgacaccgcattttccagttactactggctctacaaagcaggcgtcaccccagaaacattcccaactgtctcccaattcctcttcgaactaggcaaacaaccccgcggcacgaaaaagatgaagaaggccctcctatccacacccatgaaatggggcaagaaactctacgaactatttgccgacgactcattccaacaaaaccgcatctacatgcacccggccgtactcacagccggacgcataagcgaaatgggcgtctgcttcggcaccatacccgtcgctaaccccgacgacgcggcactaggctccggccacacaaaatccatcctaaacctccgcacctcaaccgaagccaacaacccctgcgcaaaaaccatcgtaaaactgttcgaaatccagaagaaaggcttcgtcataaaagacatggacatcgtcgccagcgaacacctcctgcaccaatccttagtcggaaaacaaagcccgttccagaacgcatacaacgtcaaaggcaacgccacctccgccaacataatctag

SEQ ID NO: 8090 - RNA, 1449 nt, synthetic construct
  misc_feature 1..1449: note = derived and/or modified CDS sequence (opt11) from CCHFV(C-68031)__DQ211642.1__N
  source 1..1449: mol_type = other RNA
atggaaaacaaaatagaagtcaacaacaaagacgaaatgaacaaatggttcgaagaattcaaaaaagggaacggcctcgtagacaccttcaccaactcgtactcattctgcgaatccgtgcccaacctggaaaggttcgtattccaaatggccagcgcaaccgacgacgcacaaaaagactcaatttacgccagcgccctagtagaggccacaaaattctgcgccccgatatacgagtgcgcatgggtaagttcgaccgggatcgtcaaaaaagggctcgaatggttcgagaaaaacgccggaacaataaaatcatgggacgaatcctacatagaactgaaagtagaagtacccaagatcgaacaactggccaactaccaacaagcagccctaaaatggcgaaaagacataggattccgcgtaaacgcaaacacggccgcactatcgcacaaagtcttagccgaatacaaagtccccggcgaaatcgtaatgtccgtcaaagaaatgctctcggacatgatcagacgccggaacctaatcctgaacagaggaggcgacgaaaacccaagaggccccgtcagcagagaacacgtcgaatggtgccgagagttcgtaaaaggaaaatatatcatggcattcaacccaccctggggcgacataaacaaatccggcagatccggcatagccctagtggcaaccggactcgccaaactcgcagaaacggaagggaaaggcgtcttcgacgaggccaaaaaaacggtagaagccctcaacggctacctagacaaacacaaagacgaagtcgacaaagcaagcgcagacaacatgataacaaacctactcaaacacatcgcgaaagcccaagaactctataaaaacagctccgccctacgcgcgcagggagcacaaatcgacaccgcattctccagctactactggctctacaaagcgggcgtaaccccagaaacattcccaaccgtcagccaattcctattcgaactaggcaaacaaccgcgaggcaccaaaaaaatgaaaaaagcactcctgagcacgcccatgaaatggggcaaaaaactatacgaactattcgcggacgacagcttccaacaaaaccgaatctacatgcacccagccgtcctcacagccggacgaatcagcgaaatgggggtctgcttcgggaccatccccgtagccaacccagacgacgccgcccaaggttcaggccacaccaaaagcatcctcaacctacgaaccaacacagaaacaaacaacccatgcgcgaaaaccatcgtcaaactgttcgagatccaaaaaaccggcttcaacatacaagacatggacatcgtagcctcagaacacctcctccaccaaagcctagtaggaaaacaatcccccttccagaacgcatacaacgtcaaaggcaacgcaacaagcgccaacataatctaa

SEQ ID NO: 8091 - RNA, 1449 nt, synthetic construct
  misc_feature 1..1449: note = derived and/or modified CDS sequence (opt11) from CCHFV(China)__AF354296.1__N
  source 1..1449: mol_type = other RNA
atggaaaacaagatagaagtcaacaacaaagacgaaatgaacaaatggttcgaagagttcaaaaaaggaaacggactagtagacaccttcacaaactcatacagcttctgcgaatccgtccccaacctagaacgcttcgtcttccaaatggcatcagcaaccgacgacgcacagaaagacagcatctacgcatccgccctagtcgaagccaccaaattctgcgcacccatatacgagtgcgcctgggtcagttccaccggcatcgtcaaaaagggactcgaatggttcgaaaaaaacgcaggcaccataaaaagctgggacgaatcatacaccgaactaaaagtcgaagtccccaaaatagagcaactagccaattaccagcaagccgccctaaaatggcgcaaagacataggcttccgcgtgaacgcaaacaccgccgccctcagccacaaagtactcgccgaatacaaagtccccggcgagatcgtaatgtccgtcaaagaaatgctatcagacatgatccgccgccgaaacctcatcctcaactccggcggcgacgaaaacccccgcggccccgtatcccgagagcacgtcgagtggtgccgagaattcgtcaaaggaaaatacataatggcattcaaccccccatggggtgacataaataaatccggccgatccggcatcgccctcgtagcaacaggcctcgccaaactcgcagaaacaggcggaaaaggcgtcttcgacgaagccaaaaaaacagtcgaagccctgaacggatacctagacaaacacaaagacgaggtcgacaaagccagcgcagacaacatgatcacaaacctcctaaaacacatagccaaagcacaagaactctacaaaaactcaagtgccttacgagcccaaggagcccaaatagacacagcattctccagctactactggctctacaaagcaggagccacacccgagaccttcccaacagtctcccaattcctattcgaactcggcaaacagccaagaggcaccaaaaaaatgaaaaaagcactcctaagcacacccatgaaatggggcaaaaaattatacgagctcttcgccgacgactcctttcaacagaacagaatctacatgcaccccgccgtcctcaccgccggccgcatctcagaaatgggagtctgcttcggcaccatccccgtagcaaaccccgacgacgcggcacagggatcgggccacaccaaaagcatactcaacctccgcaccaataccgagaccaacaacccctgcgccaaaaccatagtccgcctcttcgaaatacaaaaaaccggattcaacatccaagacatggacatcgtcgcctccgaacacctactccaccaatcactcgtaggaaaacaatccccgttccaaaacgcctacaacgtaaaaggcaacgccacaagcgccaacatcatctag

SEQ ID NO: 8092 - RNA, 1449 nt, synthetic construct
  misc_feature 1..1449: note = derived and/or modified CDS sequence (opt11) from CCHFV(China)__AF358784.1__N
  source 1..1449: mol_type = other RNA
atggaaaacaaaatagaagtcaacaacaaggacgaaatgaacaaatggttcgaagaattcaaaaaaggcaacggcctagtcgacaccttcaccaactcctactccttctgcgagtcagtgcccaacctagaccgattcgtattccaaatggcctcagcaacagacgacgcacaaaaagactcaatctacgcatccgccctcgtcgaagcaaccaaattctgcgcaccaatctacgaatgcgcgtgggtcagctccacaggcatcgtaaagcgaggcctagagtggttcgagaaaaacgcaggcaccatcaaatcctgggacgaatcatacaccgaactgaaagtcgaagtccccaaaatagaacaattcgcggactaccaacaggcagccctcaaatggcgcaaagacataggcttccgcgtaaacgcaaacaccaccgccctctcgcacaaggtactcgccgaatacaaagtccccggagaaatcgtaatgagcgtaaaagaaatgctcagcgacatgattcgcagacgcaacctaatcctcaaccgaggcggagacgagtccccccgaggccccgtaagcagagaacacgtcgaatggtgcagagaattcgtcaaaggcaaatacatcatggcattcaaccccccatggggcgacatcaacaaatccggcaggtcaggcatcgccctcgtcgcaaccggactagccaaactcgccgaaacagaggggaaaggcgtcttcgacgaggcgaaaaaaaccgtagaagccctcaacggctacctcaacaaacacaaggacgaagtcgacaaagcgtccgcagactcaatgataaccaacctcctcaaacacatcgccaaagcccaagaactatataaaaacagcagcgccctacgtgcccaaggcgcccaaatcgacaccgccttcagcagctactactggctgtacaaagcaggcgtcaccccagaaacgttccccaccgtaagccagttcctctttgagctcggcaaacaaccacgcggaacaaaaaaaatgaaaaaagccctcctatccacacccctaaaatggggaaaaaaactctacgagctattcgccgacgactcgttccaacaaaaccggatatacatgcaccccgccgtcctcaccgcaggcagaatcagcgaaatgggcgtttgcttcggcaccatccccgtagccaaccccgacgacgccgcacaaggctccggacacactaaaagcatactcaacctacgaacgaacacagagaccaacaatccatgcgcaaaaaccatcgtgaaactattcgaaatccaaaaaaccggcttcaacatacaggacatggacatcgtagcctccgaacacctactacaccaatccctcgtaggaaaacaaagtccgttccaaaacgcatacaacgtcaaaggcaatgcaacatccgccaacataatatag

SEQ ID NO: 8093 - RNA, 1449 nt, synthetic construct
  misc_feature 1..1449: note = derived and/or modified CDS sequence (opt11) from CCHFV(China)__AF362080.1__N
  source 1..1449: mol_type = other RNA
atggaaaacaaaatcgaagtaaataacaaagacgagatgaacaaatggttcgaagagttcaaaaagggcaacggcctagtcgacaccttcacaaacagctactcattctgcgaatcagtccccaacctcgaacgcttcgtcttccaaatggcaagcgcaaccgacgacgcccaaaaagactcaatctacgcatccgccttagtcgaagcaaccaaattctgcgcacccatctacgaatgcgcatgggtatcctcaaccggaatagtcaaaaagggactggaatggttcgagaaaaacgccggcacaatcaaatcgtgggacgaatcctacaccgaactgaaagtagaagtacccaaaatcgaacaactcaccaattaccaacaagcggcactaaaatggcgcaaagacatcggcttccgtgtcaacgccaacaccgcggcactatcccacaaagtcctagccgaatacaaagtaccgggcgaaatcgtcatgagcgtcaaagaaatgctcagcgacatgatacgcagacgcaacctcatcctcaaccgaggcggagacgaaaacccacgcggccccgtatcacgcgaacacgtagaatggtgccgcgagttcgtcaaaggaacctacatcatggccttcaaccctccctggggcgacatcaacaaatccggccgctccggaatcgccctagtcgcaacaggcctcgccaaactcgccgaaaccgaaggcaaaggcgtatttgacgaagcgaagaaaacagtcgaagccttgaacggatacctcgacaaacacaaagacgaagtagacaaagccagcgcagacaacatgatcaccaacctcctaaaacacatagccaaagcccaagaactctacaaaaactcctctgccctacgcgcacaaggagcccaaatcgacacagcgttctccagctactactggctatacaaagccggcgtcaccccggaaaccttccccaccgtaagccagttcctcttcgaactcggcaaacaaccacgcggcaccaagaaaatgaagaaagctctactatcaacgcccatgaaatggggcaagaaactctacgaactattcgccgacgacagcttccaacaaaacagaatatacatgcaccccgcagtcctcaccgccggccgcatctcagagatgggcgtatgcttcggcacaatacccgtagccaaccccgacgacgccgcacagggctcaggacatactaaaagcatactcaacctccgcaccaacaccgaaaccaacaacccctgcgccaaaacaatcgtaaaactcttcgaaatccagaaaaccggcttcaacatccaagacatggacatagtcgcgtcagagcacctcctgcaccaaagcctcgtcggcaaacaatcccccttccaaaacgcgtacaacgtcaaaggaaacgctacaagcgccaacatcatatga

SEQ ID NO: 8094 - RNA, 1449 nt, synthetic construct
  misc_feature 1..1449: note = derived and/or modified CDS sequence (opt11) from CCHFV(China)__AY029157.1__N
  source 1..1449: mol_type = other RNA
atggaaaacaaaatagaagtaaacaacaaagacgaaatgaacaaatggttcgaggagttcaagaaaggcaacggcctggtcgacacattcacaaactcctactcgttctgcgaaagcgtccccaacttagaacgcttcgtcttccaaatggcaagcgccacagacgacgcacaaaaagacagcatctacgccagcgcgctcgtagaagccaccaaattctgcgcccccatatacgaatgcgcctgggtatcaagcacaggcatcgtcaagaaaggactcgaatggttcgagaaaaacgccggaaccataaaaagctgggacgaaagctacaccgaactgaaagtcgaagtccccaaaatcgaacaactcgccaactaccaacaggccgcgctcaaatggcgaaaagacatcggtttcagagtcaacgccaacaccgccgcactcagccacaaagtcctagcagaatataaagtcccaggagaaatcgtcatgagcgtaaaagaaatgctcagcgacatgatccgacggcgaaacctcatcctcaaccgcggtggagacgaaaacccccgcggcccagtaagccgagaacacgtcgagtggtgccgagagttcgtcaaaggcaaatacatcatggcattcaatcccccatggggagacatcaacaaaagcggcagaagcggaatagccttagtcgcgaccggcctcgccaaactagcagaaaccgaaggcaaaggagtcttcgacgaagcaaagaaaaccgtcgaagcgctcaacggctacctagacaaacacaaagatgaagtcgacaaagcctcagccgacaacatgatcaccaacctcctcaaacacatcgcgaaagcacaagaactatacaaaaactccagcgccctccgcgcacaaggcgcacaaattgacacagccttcagcagctactactggctatacaaagcaggagtcacgccagaaaccttccccaccgtcagccaattcctcttcgaactcggcaaacaaccccgcggaaccaagaaaatgaagaaagcactcctctcaacaccgatgaaatggggcaagaaactctacgaactcttcgccgacgacagcttccaacaaaaccgaatctacatgcatcccgcggtcctcaccgccggccgaatatcagaaatgggcgtctgcttcggaacaatcccagtagctaaccctgacgacgcagcacaaggctccgggcacaccaaaagcatactaaacctccgcacaaacaccgagaccaacaacccctgcgcaaaaacaatcgtgaaactattcgaaatacagaaaacaggcttcaacatacaagacatggacatagtcgccagcgagcaccttctgcaccaaagcctagtcggaaaacaaagccccttccaaaacgcctataacgtaaaaggaaacgccacatccgccaacatcatctaa

SEQ ID NO: 8095 - RNA, 1449 nt, synthetic construct
  misc_feature 1..1449: note = derived and/or modified CDS sequence (opt11) from CCHFV(DAK 8194)__U88411.1__N
  source 1..1449: mol_type = other RNA
atggaaaacaaaatcgaagtcaacaacaaagacgaactcaacaaatggttcgaagagttcaagaaaggcaacggcctcgtcgacacattcaccaactcctactcattctgcgaaaacatgcccaacctagaccgattcgtcttccaaatggccggcgccacagacgacgcccaaaaagactcgatctacgcctcagccctcgtagaggcaaccaaatactgcgccccgatctacgaatgcgcctgggtcagctccaccggaattgtcaaaagaggcctcgaatggttcgagaaaaacacaggaacaatcaaatcatgggacgaatcttacaccgaactcaaagtagacgtccctaaaatcgaacaactcgccaactaccagcaagccgccctcaaatggcgcaaagacatcggcttcagagtcaacgcaaacaccgccgccctatccaacaaagtcctctccgagtacaaagtccccggcgaaatcgtcatgagcgtcaaagaaatgctctcagacatgatccgacgccgcaacctaatcctgaaccgcggcggcgacgaaaacccccgaggacccgtcagcaaagaacacatcgaatggtgccgcgagttcgtaaaaggcaaatacatcatggccttcaaccctccatggggcgacgtcaacaaaagcggccgcagcggaatcgccctagtcgcaaccggcctcgcaaaactcgctgaaacagaaggaaaaggtgtcttcgaagaagccaagaaaaccgtcgaagccctaaaagaatacctagacaaacataaagacgaagtcgacaaagcatcagccgactcaatggtcacaaacctactcaaacacataacaaaagcacaagaactatacaaaaactcaagcgcactccgagcccagggcgcccagatcgacaccccattcagctcattctactggctctacaaagccggcgtgaccccagagacattccccaccgtcagccaattcctcttcgaacttggcaaacaaccacgaggcaccaagaaaatgaagaaagccctcctctctacgccaatgaaatgggggaagaaactatacgaactcttcgccgatgactcattccaacaaaaccgcatatacatgcatccagcagttctaacagccggccgcatatccgagatgggcgtctgcttcgggaccatacccgtcgccgaccccgacgacgcagcacaaggctccggccacaccaaatccatcctcaacctacgaacatcctccgaaaccaacaacccctgcgccaaaaccatagtaaaactattcgaagtccagaaaacaggattcaacatccaagacatggacatcgtagccagcgagcatctcctccaccaatccctcgtcggaaaacaatcccccttccaaaacgcctacaacgtaaaaggcaacgcaacaagcgcaaacatcatctaa

SEQ ID NO: 8096 - RNA, 1449 nt, synthetic construct
  misc_feature 1..1449: note = derived and/or modified CDS sequence (opt11) from CCHFV(Drosdov)__U88412.1__N
  source 1..1449: mol_type = other RNA
atggaaaacaaaatcgaagtcaactccaaagacgaaatgaacaaatggttcgaagaatttaagaaagaaaacggactcatggacaccttcacaaactcctactcattctgcgaaaacgtccccaacctcgacaaattcgtcttccaaatggcaagcgcaaccgacgacgcccaaaaagactcaatctacgcaagcgccttagtagaagcaaccaaattctgcgcacccatctacgaatgcgcatgggtcagctccaccggcatcgtgaagaaaggcctcgaatggttcgagaaaaacagcggcacgataaaatcatgggatgaaaactacacagaactcaaagtcgacgtgcccaagatcgaacaactagccaactaccaacaagcggccctcaagtggcgaaaagacataggattccgcgtaaacgccaacacagcagccctctcaaacaaagtcctagcagaatacaaagtccccggcgaaatcgtcatgagcgtcaaagaaatgctctctgacatgatccgacgacgaaaccttatactaaaccgcggcggcgacgagaacccccgcggccccgtctcccgagaacacgtcgaatggtgcagagagttcgtcaagggcaagtacatcatggctttcaacccaccctggggcgacatcaataaatccggccgcagcgggatcgccttggtcgccacaggactggccaaactcgctgaaaccgaaggcaaaggcgtcttcgacgaagccaagaaaaccgtcgaagccctcaacggctacctcgacaaacaccgggatgaagtagacaaagcctccgccgacagcatgataaccaaccttctcaaacacatcgcaaaagcccaagaactgtacaaaaacagctcagccctacgagcacaaggcgcccaaatcgacacacccttctccagcttctactggctctacaaggccggcgtcacccccgaaaccttccccacaatatcccaattcctcttcgaacttggcaaacaaccccgaggaacaaagaaaatgaagaaagccctactcagcaccccaatgaaatggggcaagaaactctacgaactcttcgccgacgactcattccaacaaaatcgaatatacatgcacccggccgtcctcaccgccggaagaatcagcgaaatgggagtctgcttcggaaccatcccagtcgcaaaccccgacgacgcagcccaaggctcgggccacaccaaaagcatactcaacctccgcacatcaaccgaaacaaacaacccctgcgccaaaaccatcgtcaaactgttcgaaatccaaaagacaggcttcaacatacaagacatggacatcgtcgcctcagaacacctactccaccaatctctagtcggtaaacaatcccccttccaaaacgcctacaacgtaaaaggcaacgccaccagcgcaaacatcatctga

SEQ ID NO: 8097 - RNA, 1449 nt, synthetic construct
  misc_feature 1..1449: note = derived and/or modified CDS sequence (opt11) from CCHFV(Eskisehir23-2012)__KR092376.1__N
  source 1..1449: mol_type = other RNA
atggaaaacaaaatcgaggtcaactcaaaagacgaaatgaacaaatggttcgaagaatttaaaaagggaaacggcctcatggacacattcacgaacagctactccttctgcgaaaacgtaccaaacctcgacaaatttgtattccaaatggccagcgccacagacgacgcacaaaaagactccatctacgcgtccgcactcgtcgaagccaccaaattctgcgcaccaatctatgaatgcgcctgggtctcctcaaccggtatcgttaaaaagggactagaatggttcgagaaaaacaccggcaccatcaagagctgggacgaaaactacgcggaactcaaagtcgacgtcccaaaaatcgaacaactagccaactaccaacaagccgccctcaaatggcgcaaagacatcggcttccgagtcaacgctaacaccgcagccctttccaacaaagtcctagccgaatataaagtcccaggcgaaatcgtaatgagcgtaaaagaaatgctatccgacatgatcagacgacgaaacctaatcctaaaccggggaggaggcgaaaacccgcgagggcccgtaagccgagaacacgtggaatggtgccgcgagttcgtcaagggaaaatacataatggccttcaacccaccctggggagacatcaacaagtcaggccgttccggaatagcactcgtagcaaccggactcgcaaaactcgcggaaaccgaaggcaaaggagtattcgacgaagccaaaagaaccgtcgaagctctcaacggatacctcgacaaacaccgagacgaagtcgacaaagcatccgccgattcaatgatcacaaacctcctcaaacacatcgccaaagcccaagaactatacaaaaactcttcagccctccgcgcccaaggcgcccaaatagacacccccttcagctccttctactggctctacaaagccggcgtaacccccgaaacattcccaacaatatcccaattcctcttcgaactcggcaaacaaccccgcggcacgaaaaagatgaagaaagccctcctctccacacccatgaaatggggcaagaaactctacgaactcttcgccgacgacagctttcaacaaaaccgcatctacatgcatcccgccgttctaaccgcgggccgcatctccgaaatgggcgtctgcttcggaacgatccccgtagccaaccccgacgacgccgcacaaggcagcggacacaccaaatccatactaaacctccgaacatcaaccgaaaccaacaacccatgcgcgaaaaccatcgtaaaactattcgaaatccagaaaaccggcttcaacatccaagacatggacatagtggcctccgaacacctcctccaccaaagcctagtcgggaaacaatctccattccaaaacgcctataacgtaaaagggaacgcaacaagcgccaacataatatga

SEQ ID NO: 8098 - RNA, 1449 nt, synthetic construct
  misc_feature 1..1449: note = derived and/or modified CDS sequence (opt11) from CCHFV(Hodzha)__AY223475.1__N
  source 1..1449: mol_type = other RNA
atggaaaacaaaatcgaagtcaacaacaaagacgagatgaacaaatggttcgaagagttcaagaaaggcaacggcctagtcgacacattcaccaactcatactcattctgcgaaagcgtccccaacctcgaccgctttgtcttccaaatggccagcgcaacagacgacgcccaaaaagacagcatctacgcctcagcactcgttgaagcaacaaaattctgcgccccaatctacgaatgcgcatgggtctcatcaaccggaatcgtgaagaaaggcctcgaatggttcgagaaaaacgccggaaccatcaaaagctgggacgaatcatacaccgaactcaaagtcgaagtacccaaaatcgaacaactcgcaaactatcagcaagccgccctaaaatggcgcaaagacatcgggttcagggtaaacgccaacaccgcagcactatcccacaaagtactatccgaatacaaagtccctggcgaaatcgtcatgtcggtcaaagaaatgctctccgacatgatccgccgccgcaacctcatcctcaaccgaggaggggacgaaaaccccagaggacccgtgagccgggaacacgtcgaatggtgccgcgagttcgtcaaaggaaaatacatcatggcctttaacccaccctggggagacataaacaaaagcggccgatcaggcatcgccctcgtagccacaggactagcgaaactcgcagaaacagaaggcaaaggagtcttcgacgaagccaagaaaaccgtagaagcactgaacggctacctcgataaacacaaagacgaagtcgacaaagcgtccgccgacaacatgaccaccaacctcctaaaacacatcgccaaagctcaagaactatacaaaaacagctcagccctaagagcccaaggcgcccaaatcgacacagccttctccagctactattggctgtacaaagcgggagtcacccccgaaacattccccaccgtaagccaattcctcttcgaactgggcaaacaaccccgcggaacaaagaaaatgaagaaagccctactctccacccccatgaaatggggaaagaaactatacgaactcttcgccgacgactccttccaacagaaccgcatatacatgcaccccgccgtactaaccgccggacgcatatctgagatgggagtttgcttcggaaccgtaccagtagcggaccccgacgacgccgcacaaggctccggccacaccaaaagcatcctaaacctccgcacaaacaccgaaaccaacaacccatgcgccaaaaccatagtcaaactattcgaaatccagaaaacaggcttcaacatccaagacatggacatcgtagccagcgagcacctcctccaccaaagcctagtcggaaaacaaagccccttccaaaacgcatacaacgttaaaggcaacgcaacctccgccaacataatctag

SEQ ID NO: 8099 - RNA, 1449 nt, synthetic construct
  misc_feature 1..1449: note = derived and/or modified CDS sequence (opt11) from CCHFV(Iran-52)__DQ446212.1__N
  source 1..1449: mol_type = other RNA
atggaaaacaaaatagaagtaaacagcaaagacgaaatgaacaaatggttcgaagagttcaagaaaggcaatgggctcgtcgacaccttcacaaactcctactcattctgcgaatctgtccccaacctagacagatttgtcttccagatggcaagcgccaccgacgacgcacaaaaagattccatctacgccagcgccctggtagaagccacaaaattctgcgcacccatctacgaatgcgcctgggcatcatcaaccggaatagtaaagaaaggactcgaatggttcgagaaaaacgccggcaccataaaatcctgggacgaatcatacaccgaactcaaagtcgaggtccccaaaatcgaacagctctccaactaccaacaagcagccctcaaatggaggaaagacatcggcttccgagtaaacgccaacaccgccgccctctcaaacaaagtactagccgagtacaaagtccccggcgagatagtcatgagcgtaaaagaaatgctctccgacatgatccgccgccggaacctgatcctcaaccgaggcggcgacgagaacccccgcggaccagtctcacgagaacacgtcgaatggtgccgagagttcgtaaaagggaaatacatcatggccttcaacccaccctggggagatataaacaaatcaggccgatcaggcatcgctctcgtagccaccggcctggccaaactcgcagaaaccgaagggaaaggagtcttcgacgaagcaaagaaaaccgtcgaagccctgaacggatacctcgacaaacacaaagacgaagtcgacaaagccagcgcagactcaatgataacaaacctcctcaagcacatagcgaaagcccaggaactctacaaaaacagctcagccctccgagcacaaggcgcccaaatcgacacagtattctcaagctactactggctctacaaagccggagtcacccccgacaccttccccaccgtatcccaattcctattcgaactcggcaaacaaccccgaggaacaaagaaaatgaagaaagcactcctcagcaccccaatgaaatggggcaagaaactctacgaactattcgccgacgactccttccaacaaaaccgcatctacatgcaccctgccgtcctcactgcaggccgcatcagcgaaatgggagtctgcttcgggaccatccccgtcgctaaccccgacgacgccgccctcggatcaggtcacaccaaatccatccttaacctacgaaccaacacggaaaccaacaacccatgcgcacgcaccatcgtcaaactgttcgaaatccagaaaaccggtttcaacatacaagatatggatatcgtagcctccgaacacctactacaccaaagcctcgtaggaaaacagagccccttccaaaacgcatacaacgtcaaaggcaacgccacctccgccaacataatctaa

SEQ ID NO: 8100 - RNA, 1449 nt, synthetic construct
  misc_feature 1..1449: note = derived and/or modified CDS sequence (opt11) from CCHFV(Iran-53)__DQ446213.1__N
  source 1..1449: mol_type = other RNA
atggaaaacaaaatagaagtcaactcaaaagacgaaatgaacaaatggttcgaagaattcaaaaagggaaacggcctagtagacaccttcacaaactcctactcattctgtgaatcagtccccaacctagaccggttcgtcttccaaatggcctccgccacagacgacgcccaaaaagacagcatctatgcctcagccctcgtagaagccactaaattctgcgcccccatctacgagtgcgcatgggccagctccaccggcatcgtaaaaaagggactagaatggttcgaaaaaaacgccggcaccatcaagtcctgggacgagtcatacaccgagctcaaagtggaagttcccaaaatcgagcaactcagcaactaccaacaagcagccctaaaatggcgcaaagacatcggcttccgagtcaacgccaacacggccgccctatcaaacaaagtcctcgccgaatacaaagtccccggagaaatcgtcatgtccgtcaaggagatgctctccgacatgatccgccgacgcaacctcatcttaaacaaaggaggagacgaaaacccacgcggcccagtcagccgagaacacgtcgaatggtgccgcgaattcgtgaaaggcaaatacatcatggcattcaacccaccttggggagacataaacaaatccggcagatcaggcatcgccctagtcgccaccggtctcgccaaactcgccgaaaccgaagggaaaggagtcttcgacgaagccaaaaaaaccgtcgaagccctcaacggctacctcgacaaacataaagacgaagtagacaaagcatccgccgactctatgataaccaacctactaaaacacatcgccaaagcacaggaactatacaaaaactcctccgccctccgagcacaaggcgcccaaatcgacaccgtcttctcatcctactactggctctacaaagccggcgtaacccccgacacgttccccaccgtctcccaattcctcttcgaactcggaaaacaaccacgcggcacaaaaaaaatgaaaaaagcacttctatccacacccatgaaatggggcaaaaaactatacgagctcttcgcagacgactcattccaacaaaaccgaatttacatgcaccccgccgtcctaaccgccggacgcattagcgagatgggcgtatgcttcggcaccatccccgtcgccaaccccgacgacgcagcactaggctcaggccacaccaaaagcatcctcaacctaagaaccaataccgaaaccaacaacccatgcgcacgcaccatagtcaaactcttcgaaatccaaaaaaccggatttaacatccaagacatggatatcgtagcctccgaacacctactacaccagagcctagtgggcaaacaaagccctttccaaaacgcctacaacgtcaagggcaacgccacgagcgcaaacatcatatga

SEQ ID NO: 8101 - RNA, 1449 nt, synthetic construct
  misc_feature 1..1449: note = derived and/or modified CDS sequence (opt11) from CCHFV(JD 206)__U88414.1__N
  source 1..1449: mol_type = other RNA
atggaaaacaaaatcgaagtcaactccaaagacgaaatgaacaaatggttcgaggagttcaagaaaggcaacggcctagtcgacacattcacaaacagctactcattctgcgaaaacgtcccaaacctagaccggttcgtcttccaaatggcaagtgcaaccgacgacgctcaaaaagactccatatacgcatcagccctcgtcgaagccaccaaattctgcgcgccaatatacgagtgcgcctgggcaagctcaaccgggatagtcaagaaaggcctggaatggttcgagaaaaacgccggaacaattaaaagctgggacgaatcatacaccgaactaaaagtagaagtacccaaaatcgaacaactcagcaactaccaacaagcagccctaaaatggcgaaaagacatcggattccgggtcaacgcaaacacagcagcactatccaacaaagtcctcgcagaatacaaagtcccaggcgagatagtgatgagcgtcaaagaaatgctatcagacatgatacggcgcagaaacctcatactaaaccgcggaggcgacgaaaacccacgaggaccagtcagcagggaacacgtagaatggtgccgagagttcgtcaaaggaatgtacatcatggccttcaacccaccatggggcgacatcaacaaatcaggccgatccggcatcgccctcgtcgccaccggcctcgccaaactggcggaaacagaaggcaagggcgtcttcgacgaagccaagaaaaccgtagaagccctcaacggctacttagacaaacacaaagacgaagtagacaaagcgagcgcagactcaatgatcaccaacctcctcaaacacatagcaaaagcccaagaactctacaaaaacagctcggcactccgcgcccaaggcgcgcaaatcgataccgtcttctccagctactactggctctacaaagcaggcgtgacacccgacaccttccccaccgtcagccaattcctcttcgaactcggcaagcaaccccgcggcaccaagaaaatgaaaaaggccctactatccacacccatgaaatggggaaagaaactatacgaactcttcgccgacgactcattccaacaaaaccgcatctacatgcacccagcagtcctcaccgccggccgaatcagcgaaatgggcgtctgcttcggaaccataccagtcgccaacccagacgacgccgccctagggtcaggacacaccaaaagcatcctcaacctccgaacaaacacagaaacaaacaacccatgcgccaaaaccatcgtgaaactattcgaaatccagaaaaccggcttcaacatccaagacatggacatcgtagcctcagaacacctcctacaccaaagcctagtcggaaaacaaagccccttccaaaacgcctacaacgtcaaaggaaacgccaccagcgcaaacatcatataa

SEQ ID NO: 8102 - RNA, 1449 nt, synthetic construct
  misc_feature 1..1449: note = derived and/or modified CDS sequence (opt11) from CCHFV(Kashmanov)__DQ211644.1__N
  source 1..1449: mol_type = other RNA
atggaaaacaaaatcgaagttaactcaaaagacgaaatgaacaaatggttcgaagaatttaagaaagaaaacggactcatggacacattcaccaactcctactcattctgcgaaaacgtaccaaacctagacaaattcgtcttccaaatggccagcgcaaccgacgacgcccaaaaagactccatctacgcaagcgcccttgtcgaagcaacaaaattctgcgccccaatatacgaatgcgcatgggtcagctcaaccggcatcgtcaagaaaggcctcgaatggttcgaaaagaacagcggcaccatcaaatcctgggacgaaaactacgccgaactcaaagtagacgtacccaaaatagaacaactcgccaactaccaacaagccgccctgaaatggcgaaaagacatcggcttccgtgtcaacgccaacacggccgcactatctaacaaagtcctcgccgaatacaaagtcccaggcgaaatcgtcatgtccgtaaaagaaatgctctcagacatgatccgtcgcaggaacctaatactaaatcgcggcggcgacgaaaacccgcgcggcccagtcagccgtgaacacgtcgaatggtgccgcgagttcgtcaaaggaaaatacatcatggccttcaacccaccctggggagacatcaacaaatcaggccgcagcggaatcgccctagtcgcaacgggcctagccaaactcgcagaaaccgaaggaaaaggcgtcttcgacgaagccaagaaaacagtagaagccctcaacggatacctcgacaaacaccgcgacgaagtcgacaaagcaagcgcagactcaatgatcacaaacctcctgaaacacatcgctaaagcccaagaactctacaaaaacagctccgcactacgtgcccaaggcgcacaaatcgacaccccattctccagcttctactggctctacaaagcaggcgtcaccccagaaacattcccaaccatcagccaattcctgttcgaactaggaaaacaaccaagaggaaccaagaaaatgaagaaagcactactatccacacccatgaaatggggcaagaaactctacgaactcttcgcagacgactccttccaacaaaacagaatctacatgcaccccgcagtcctaaccgccggacgcatcagcgaaatgggagtctgcttcggcacaatccctgtcgccaaccccgacgacgcggcccaaggctccggccacaccaaatccatcctaaacctccgcacctcaaccgaaaccaacaacccttgcgccaaaaccatcgtaaaactgttcgaaatacagaaaacaggcttcaacatccaagacatggacatagtagcctccgaacacctactccaccagtccctagtcggcaaacaatcccccttccagaacgcctacaacgtcaaaggtaacgccaccagcgccaacatcatctaa

SEQ ID NO: 8103 - RNA, 1449 nt, synthetic construct
  misc_feature 1..1449: note = derived and/or modified CDS sequence (opt11) from CCHFV(NIV 10405051)__JF922681.1__N
  source 1..1449: mol_type = other RNA
atggaaaacaaaatagaagtcaacaacaaagacgaaatgaacaaatggttcgaagagttcaagaaaggcaacggactcgtcgacacattcaccaatagttatagcttctgcgaaagcgtcccaaacctcgaccgcttcgtattccagatggcttccgccacagacgacgcacaaaaagactcaatctacgcgtcagcccttgtcgaagccaccaaattctgcgcccccatctacgaatgcgcatgggtaagcagcacgggaatagtaaagaaaggcctggaatggtttgagaaaaacgccggcacaatcaaatcatgggacgaatcatacacagaactcaaagtggaagtcccaaagatagagcaactagccaactaccaacaagccgccctcaaatggcgcaaagacatcggcttccgagtcaacgccaacacagccgcactctcccacaaagtcctggccgaatacaaagtcccaggcgaaatcgtcatgtcagtcaaagaaatgctctcggacatgatccggcgcaggaacctgatcctaaacagaggaggagacgaaaacccccgaggacccgtaagccgcgaacacgtcgaatggtgccgtgagttcgtaaaaggcaaatacataatggcattcaacccgccatggggcgacatcaacaaatcgggcaggtcaggcatagccctagtagcaacaggcctagcaaaactcgccgaaacagaaggcaagggcgtattcgacgaagccaagaaaactgtagaagcactgaacggctacctggacaaacacaaagacgaagtcgacaaggccagcgccgacaacatgatcaccaacctcctcaaacacatcgccaaagcacaagaactatacaaaaacagctccgccctccgcgcccaaggcgcccaaatcgacaccgccttcagctcctactactggctctacaaagccggcgtcaccccagaaacctttcccaccgtaagccaattcctcttcgaactcggcaaacaaccccgaggcacaaagaaaatgaagaaagccctactaagcacacccatgcgctggggcaagaaactatacgaactcttcgccgacgactcattccaacaaaaccgaatctacatgcaccccgccgtactcacagccggacgaatcagcgaaatgggagtatgcttcggcacaatcccggtagcaaacccagacgacgccgcccaaggcagcggccacacaaaaagcatactcaacctccgaaccaacaccgagaccaacaacccctgcgccaaaactatcgtcaaactgttcgaaatccagaaaacaggcttcaatatacaagatatagacatcgtggccagcgagcacctactccaccaatcactggtcggaaaacaaagtccattccagaacgcctacaacgtcaaaggaaacgcaacctccgccaacataatctaa

SEQ ID NO: 8104 - RNA, 1449 nt, synthetic construct
  misc_feature 1..1449: note = derived and/or modified CDS sequence (opt11) from CCHFV(Oman)__DQ211645.1__N
  source 1..1449: mol_type = other RNA
atggaaaacaaaatagaggtcaacaacaaggatgaaatgaacaagtggttcgaagagttcaagaaagggaacggcctagtagacaccttcaccaacagctactcattctgcgaatcagtcccaaacctcgaccgattcgtattccagatggccagcgccaccgacgacgcacaaaaagacagcatctatgcatccgccctcgtcgaggccaccaaattctgcgcacccatatacgaatgcgcatgggccagcagcaccggaatcgtaaaaaaaggactagaatggttcgaaaaaaacgcgggaaccataaaatcctgggacgaatcgtacacagaactgaaagtcgaagtccccaaaatcgaacaactctcaaactaccaacaagccgccctcaaatggcggaaagacatcggcttcagagtaaacgccaacacagccgccctctcaaacaaagtactagccgaatacaaagtaccaggagaaatcgtcatgtcagtaaaagaaatgctatccgacatgatccgacgccgaaacctgatcctgaaccgaggaggagacgaaaaccccaggggacccgtaagccgcgaacacgtagaatggtgccgagaattcataaaaggcaaatacatcatggccttcaaccccccatggggcgacataaataagtccggcagaagcggcatcgccctcgtcgccaccggactcgccaaactcgcagaaacagaaggcaaaggcgtattcgacgaagcaaaaaaaaccgtcgaggccctaaacggctacctcgacaaacacaaagacgaggtcgacaaagccagcgccgactcaatgatcaccaacctactaaaacacatagccaaagcgcaagaactctacaaaaactccagcgctctccgggcccagggagctcaaatcgacacagtgttctccagctactactggctctacaaagccggcgtgacacccgacacattcccaacagtttcccaattccttttcgaactcggaaaacaacctagaggcaccaaaaaaatgaaaaaagccctcctcagcaccccaatgaagtggggaaaaaaactgtacgaactcttcgccgacgacagcttccaacaaaaccgcatatacatgcacccagccgtcctcacagccggacgcatcagcgaaatgggagtctgcttcggaaccatccccgtcgccaacccagacgacgcagccctcggcagcggccacaccaaatcaatactcaacctaagaaccaacaccgaaaccaacaacccctgcgcaaaaaccatagtcaaactattcgaaatccaaaaaacaggattcaacatccaggacatggacatcgtagcctcagaacacctactccaccaatccctcgtcggcaaacaaagccccttccagaacgcctacaacgtcaaaggcaacgcaacatccgcaaacatcatataa

SEQ ID NO: 8105 - RNA, 1449 nt, synthetic construct
  misc_feature 1..1449: note = derived and/or modified CDS sequence (opt11) from CCHFV(SCT ex Afghanistan)__JX908640.1__N
  source 1..1449: mol_type = other RNA
atggagaacaaaatagaagtaaacaataaggatgaaatgaacaaatggttcgaagagttcaagaaaggaaacggactcgtggacactttcacaaacagctacagcttctgcgaatcggtccccaacctcgaccgcttcgtcttccaaatggccagcgccacagacgacgcacaaaaagacagcatctacgcctcagcactcgtcgaagccaccaaattctgcgcacctatatacgaatgcgcctgggcgagcagcaccggaatagtcaagaaaggcctagaatggttcgagaaaaacgcaggaaccatcaaaagctgggacgaaagctacaccgaactaaaagtcgaagtcccgaaaattgaacaactaagcaactaccaacaagccgccctcaaatggagaaaagacataggcttcagagtgaacgccaacacagcggcactctctaacaaagtactcgccgaatacaaggtcccaggagaaatagtaatgtccgtcaaagaaatgctctcagacatgataagaagaagaaacttaatactgaacagaggaggcgacgaaaaccctcgcgggcccgtcagcagggaacacgtcgaatggtgccgcgagttcataaaaggcaaatacatcatggccttcaacccaccctggggagacatcaacaaaagcgggcgctctggcatcgcactcgtagccaccggtctagccaaactagccgaaaccgaaggcaaaggagtcttcgacgaagcaaagaaaaccgtcgaagccctcaacggctacctcgacaaacacaaagacgaagtcgacaaagcaagcgcagactcaatgatcaccaatctcctaaaacacatcgccaaagcccaagaactgtacaaaaactccagcgccctccgagcacaaggcgcgcagatcgacaccgtcttctcaagctactactggctctacaaagccggcgtcaccccggaaacattccccaccgtaagccagttcctcttcgaactcggcaagcaaccccgaggaaccaagaaaatgaagaaagccctcctcagcacccccatgaaatggggaaagaaactatacgaactattcgcagacgactccttccaacaaaacagaatatacatgcaccctgccgtactaaccgccggaagaatcagcgaaatgggcgtatgcttcggaaccatccccgtcgcaaaccccgacgacgcagcacttggctccggccacaccaaaagcatcctaaacctacgcaccaacaccgaaaccaacaacccgtgcgcaaaaacaatcgtaaaactattcgagatacagaaaacaggcttcaacatccaagacatggacatcgtcgcctcagaacacctactccaccaatcactcgtcggaaaacaaagccccttccaaaacgcatacaacgtaaagggcaacgcaaccagcgccaacatcatatag

SEQ ID NO: 8106 - RNA, 1449 nt, synthetic construct
  misc_feature 1..1449: note = derived and/or modified CDS sequence (opt11) from CCHFV(Semunya)__DQ076413.1__N
  source 1..1449: mol_type = other RNA
atggaaaacaaaattgaggtaacctctaaagacgaaatgaacagatggttcgaggagttcaagaaaagcaacggcctagtagacaccttcaccaactcctactccttctgcgaatcagtccccaacctcgaccgcttcgtcttccaaatggcaagcgcaaccgacgatgcccaaaaagacagcatctacgccagcgccctcgtagaagcaaccaaattctgcgcacccatctacgagtgcgcatgggtctcctccacaggcatagtcaagaaaggcctagaatggttcgagaaaaacgccgggacaatcaaatcctgggacgaatcatacacagaactgaaagtaggcgtaccaaaaatcgaacaactcgccaactaccaacaagccgccctgaaatggcgcaaagacatcggcttccgcgtcaacgccaacacggcagcactatccaacaaagtcctggcagaatacaaagtgcccggagaaatagtaatgagcgtcaaagaaatgctctcagacatgataagaagaaggaacctaatcctgaaccgcggcggcgacgaaaacccccgtggacccgtcagccgcgaacacgtcgaatggtgccgcgagttcgtaaaaggcaaatacatcatggcattcaacccaccctggggcgacatcaacaaaagcggacgcagcggaatagcactcgtcgcaacaggcctcgccaaactagcagaaacagaagggaagggcgttttcgacgaagccaagaaaaccgtcgaagcccttaacggatacctagacaaacacaaagacgaagtcgacaaagcaagcgccgacggaatggtcaccaacctactaaaacacatcgccaaagcacaagaactatacaaaaacagcagcgccctccgagcccaaggagcacaaatcgatacccccttcagcagcttctactggctatacaaagcaggagtcagcccggaaaccttcccaaccgtatcacaattcctcttcgaactcggaaaacaaccccgcgggacaaagaaaatgaagaaagccctcctcagtacaccaatgaaatggggcaagaaactctacgaactcttcgccgacgactcattccaagaaaaccgaatctacatgcaccccgcagtcctgacagccggccgaatcagcgaaatgggcgtctgcttcggcacaatccccgtggcgaacccagacgacgccgcccaaggcagcggccacaccaaaagcatcctaaacctccgcaccaacaccgagaccaacaacccctgcgcaaaaaccatcgtgaaacttttcgagatccagaaaaccggcttcaacatacaagacatggacatagtagcctcggaacacctcctacaccaatccctggtcggaaaacaatcccccttccaaaacgcctacaacgtaaaaggcaacgcaacctcagcaaacatcatataa

SEQ ID NO: 8107 - RNA, 1449 nt, synthetic construct
  misc_feature 1..1449: note = derived and/or modified CDS sequence (opt11) from CCHFV(SK 2015/human)__KX129738.1__N
  source 1..1449: mol_type = other RNA
atggaaaacaaaatagaagtaaacaacaaagacgaaatgaacaaatggttcgaagagttcaagaaaggaaacggcctagtcgacacatacacaaattcatactccttctgtgaatccgtccccaacctagacagattcgtattccaaatggccagcgccaccgacgacgcccaaaaagactcgatctacgcatcggcgctagtagaagcaacaaagttctgcgccccaatctacgaatgcgcctgggcgagctccacaggaatcgtcaaaaaggggctagaatggttcgagaaaaacgcaggaacgataaaactatgggacgaatcgtacgccgaactcaaagtagaagtccccaaaatagaacaactcagcaattaccaacaagccgccctcaaatggcgcaaagacatcggcttcagagtaaacgcaaacaccgccgccctcagcaacaaggtactcgcagaatacaaagtacccggcgaaatagtaatgtccgtcaaagaaatgctgagcgacatgatacgccgcagaaacctaatcctgaaccgaggcggagacgaaaacccccgaggacccgtaagcagggaacacgtcgaatggtgccgagagttcgtaaaaggaaagtacatcatggccttcaacccaccatggggcgacataaacaaatcaggcaggagcggaatcgcgctggtcgccacaggcctagcaaaacttgccgaaacagaaggaaaaggcgtattcgacgaagccaagaaaaccgtcgaagccctaaacggctacctcgacaaacacaaagacgaagtcgacaaagccagcgccgactcaatgataacaaacctactcaaacacatcgccaaagcccaagaactttacaaaaactcaagcgccctacgagcccaaggggcccaaatcgacaccgtattctcaagctattactggctatacaaagcgggcgtgaccccagacacattccccaccgtaagccaattcctgttcgaactcgggaaacaaccccgcggcacaaagaaaatgaagaaagccctactatccaccccaatgaaatggggaaagaaactatacgaactcttcgccgacgacagcttccaacaaaaccgcatatacatgcaccccgcagtcctaaccgccggccgcataagcgaaatgggagtctgcttcggaacggtaccagtcgcaaaccccgacgacgccgccctcggcagcggccacaccaaaagcatcctaaacctccgaaccaacaccgaaaccaacaacccctgcgccaaaacgatcgtcaaactcttcgaaatccagaaaaccggcttcaacatacaagacatggacatcgtggcatccgaacacttactccaccaatcattagtcggaaaacaaagccccttccaaaacgcgtacaacgtcaaaggaaacgccacgagcgcaaacatcatctag

SEQ ID NO: 8108 - RNA, 1449 nt, synthetic construct
  misc_feature 1..1449: note = derived and/or modified CDS sequence (opt11) from CCHFV(SPU128/81/7)__DQ076415.1__N
  source 1..1449: mol_type = other RNA
atggaaaacaaaatcgaagtaaacaacaaacacgaaatgaacaaatggtttgaagagttcaagaaaggtaacggcctcgtagacacgttcacaaactcatacagcttctgcgaatccgtccccaacctcgacaaattcgtattccaaatggcctccgcgaccgacgacgcacaaaaagactccatctacgcctcggcactcgtcgaagccaccaaattctgcgccccaatatacgaatgcgcctgggtgtcctcaaccggcatcgtaaaaagaggactggaatggttcgagaaaaacgcaggaaccataaaatcgtgggacgaatcatacacagaactgaaagtagacgtccccaaaatagaacaactcgccaattaccaacaagccgccctgaaatggagaaaagacataggcttccgcgtaaacgcaaacaccgccgccctcagcaacaaggtactcgcagaatacaaagtacccggagaaatcgtaatgtccgtaaaagaaatgctctcggacatgatccgacgccgaaaccaaatcctcaaccgcggcggggacgagaacccgcgaggacccgtaagccgggaacacgtagactggtgcagagagttcgtcaaaggcaaatacatcatggccttcaacccgccctggggcgacatcaataaatcaggccggagcggcatagcgctcgtagccaccggcctcgccaaactagcggaaacagaaggcaaaggcgtcttcgacgaagccaagaaaacagtcgaagtcctcaacggctacctggacaaacacaaagacgaagtcgaccgcgcaagcgcagactccatgataaccaacctcctcaaacacatcgccaaggcgcaagaactatacaaaaacagctcggccctacgcgcgcaaggcgcacagattgacaccgcatttagcagctactactggctctacaaagcaggcgtaacccccgaaacattccccacggtgagccaattcctcttcgaactcggcaaacaacctcgcggcacaaagaaaatgaagaaagcactcctcagcacacccatgaaatggggaaagaaactctacgaactcttcgccgacgactcattccaacaaaaccgaatatacatgcacccagcagtactcaccgccggccgcataagcgaaatgggagtatgcttcggaaccatacccgtcgctaatcccgacgacgcagcccaaggctccggccataccaaaagcatactcaacctccgcaccaacaccgaaaccaacaacccatgcgcccgcactatcgtaaaactattcgagatccagaaaacaggattcaacatacaagacatggacatagtagcctccgaacacctcctacaccaatccctggtcggcaaacaaagtccgttccaaaacgcatacaacgtcaaaggaaacgcgacaagcgcaaacataatctaa

SEQ ID NO: 8109 - RNA, 1449 nt, synthetic construct
  misc_feature 1..1449: note = derived and/or modified CDS sequence (opt11) from CCHFV(Sudan Al-Fulah 4-2008)__GQ862372.1__N
  source 1..1449: mol_type = other RNA
atggaaaacaaaatcgaagtcaacaacaaagacgaaatgaacaaatggttcgaagagttcaagaaaggaaacgggcttgtagacaccttcaccaactcatacagtttctgcgaatccgtaccgaacctggacaaattcgtattccaaatggcaagcgcgaccgacgacgcccaaaaagacagcatctacgcctccgccctcgtagaagcaacaaaattctgcgccccaatctacgagtgcgcctgggtaagctcaaccggcatcgtcaaacgcggcctcgagtggttcgagaaaaacgccggaaccatcaaatcctgggacgaatcctacaccgaactcaaagttgacgtccccaaaatcgaacaactagccaactaccaacaagcagcactcaaatggcgcaaagacataggcttccgcgtgaacgcaaacaccgcagccctatccaacaaagtcctggccgagtacaaggtaccgggagaaatcgtaatgtcggtcaaggaaatgctatccgacatgatcagacgcagaaaccaaatactaaaccgaggcggggacgaaaacccacgcggacccgtaagccgagaacatgtggactggtgccgcgagttcgtaaaaggcaagtacatcatggcctttaacccaccctggggcgacatcaacaaatcaggccgctcaggaatagcactcgtcgccaccggcctggcaaagctagccgaaacagaaggaaaaggagtcttcgacgaagccaagaaaacagtagaagccctaaacggctacctggacaaacacaaagacgaagtcgaccgcgcaagcgcagactcaatgataaccaacctcctcaaacacatcgccaaagcgcaagaactctataaaaactccagcgcactacgggcacaaggagcacaaatagacactgcgttctccagctactactggctatacaaagcgggggtcaccccggaaaccttccccaccgtctcacagttcctcttcgaactaggcaaacaaccacgcggtacaaagaaaatgaagaaagcgctcctaagcacccccatgaaatggggcaagaaactatacgaactattcgccgacgactcattccaacaaaaccgaatctacatgcacccagcagtactaaccgccggacgcatctcagaaatgggagtctgcttcgggaccattcccgtggccaaccctgacgacgccgcccagggctccggccacacaaaaagcatcctcaacctacggacaaacacagaaaccaacaacccctgcgcacgaacaatcgtgaaactattcgagatacagaaaacaggcttctccatacaagacatggacatcgtagcctcagaacacctactacaccaatcccttgtaggcaaacaaagcccgttccaaaacgcatacaacgtcaaaggcaacgcaacaagcgcaaacataatctaa

SEQ ID NO: 8110 - RNA, 1449 nt, synthetic construct
  misc_feature 1..1449: note = derived and/or modified CDS sequence (opt11) from CCHFV(TAJUK)__JN086996.1__N
  source 1..1449: mol_type = other RNA
atggaaaacaaaatcgaagtaaacaataaagacgaaatgaacaaatggttcgaagagttcaagaaaggcaacggcctcgtcgacaccttcacaaactcatactcattttgcgagtcagtccccaacctcgacagattcgtattccaaatggcaagcgcaaccgacgaagcacagaaagactcgatctacgcctcggcactcgtcgaagccaccaaattctgcgcacccatatacgaatgcgcatgggtaagctcaacaggcatcgtcaagaaaggactggaatggttcgagaaaaacgccgggacgatcaaaagctgggacgaatcctacacagaactcaaagtcgaagtacccaaaatcgaacaactcgccaactaccaacaagcagccctaaaatggcgcaaggacataggattccgcgtaaacgcgaacacggcagcactatcccacaaagtactcgccgaatacaaagtcccgggcgagatcgtaatgagcgtcaaagaaatgctcagcgacatgatccgccgaaggaacctgatcctgaaccgcggcggggacgaaaacccccgcggacccgtctccagagaacacgtagagtggtgccgagagttcgtaaaaggaaaatacatcatggcgttcaacccaccctggggcgacatcaacaaatccggacgctccgggatagcattagtggccaccggactcgccaaactcgcagaaacggaaggcaaaggagtcttcgacgaagcaaagaaaacagtagaagccctcaacggatacctagacaaacacaaagacgaagtcgacaaagcaagcgccgacaacatgataacaaacctcctaaaacacatcgccaaagcccaagaactctacaaaaacagctccgccctacgcgcacaaggcgcacaaatcgacaccgcattctcatcctactattggctctacaaggcgggcgtcacccccgaaaccttccccacggtatcccaattcctgttcgaacttggcaaacaaccacgcggcaccaagaaaatgaaaaaggcactattaagcacccccatgaaatggggaaagaaactgtacgaactattcgcagacgactccttccagcaaaacagaatctacatgcacccagccgtcctcaccgccggccgaataagcgagatgggagtctgcttcgggaccatcccagtcgccaaccccgacgacgccgcacaaggaagcggacacaccaaatccatactcaacctcagaacaaacaccgaaacaaacaacccatgcgccaaaacaatagtcaaactcttcgaaatccagaaaaccggcttcaacatccaagacatggacatagtcgcctcagaacacctcctccaccaaagtctcgtaggcaaacaatcaccattccaaaacgcttacaacgtcaaaggcaacgccacaagcgccaacatcatctaa

SEQ ID NO: 8111 - RNA, 1449 nt, synthetic construct
  misc_feature 1..1449: note = derived and/or modified CDS sequence (opt11) from CCHFV(UG3010)__DQ211650.1__N
  source 1..1449: mol_type = other RNA
atggagaacaaaatcgaggtcacaagcaaagacgagatgaacagatggttcgaagaattcaaaaaaagcaacggcttagtggacaccttcaccaactcttacagcttctgcgagtccgtacccaacctagaccgattcgtcttccagatggcatccgccaccgacgacgcccaaaaagactccatctacgcctccgccctcgtagaagcgacaaaattctgcgcaccaatctatgaatgcgcatgggtcagcagcaccggcatagtaaaaaaaggactagaatggttcgaaaaaaacgccggaacaataaaaagctgggacgaaagctacacagaactcaaagtcggagtaccaaaaatagagcaactagcaaactatcaacaagccgccctcaaatggcgcaaagacatcggtttccgcgtcaacgccaacaccgccgccctcagcaacaaagtcctcgcagagtacaaggtcccaggcgaaatcgtcatgagcgtcaaagaaatgctctccgacatgattcgccgccggaacctcatactaaaccgaggcggcgacgagaacccccgcggcccagtcagccgagaacacgtagaatggtgccgcgagttcgtaaaaggcaaatacatcatggcattcaaccccccctggggcgacatcaacaaatccggtcgaagcggaatcgccctcgtcgcaaccggcctcgccaaactagcagaaacagaaggaaaaggcgtattcgacgaagccaaaaaaacagtcgaagacctaaacggatacctagacaaacacaaagacgaagtcgacaaagcatccgcagacggaatggtcaccaatctactcaaacacatagccaaagcacaagaactatataagaacagctcagcactccgcgcacaaggcgcccaaattgacacaccattcagcagcttctactggctctacaaagcaggcgtaagccccgaaaccttccccaccgtctcccaattcctcttcgaactcggaaaacaaccccgcggcacgaaaaaaatgaaaaaagccctactctccacccccatgaaatggggcaaaaaactctacgaactcttcgcagacgacagcttccaagaaaaccggatctacatgcacccagccgtactcaccgccggccgaatcagcgagatgggcgtctgcttcgggaccatccccgtcgcaaacccagacgacgccgcccagggatccggacacacgaaaagcatactaaacctccgaaccaacaccgaaacaaacaacccctgcgccaaaaccatcgtaaaactcttcgaaatccaaaaaaccggcttcaacatacaggacatggacatagtagccagcgaacacctcctccaccaaagcctagtcggaaaacaatcaccattccaaaacgcctacaacgtgaaaggcaacgccacctcggcaaacataatatga

SEQ ID NO: 8112 - RNA, 1449 nt, synthetic construct
  misc_feature 1..1449: note = derived and/or modified CDS sequence (opt11) from CCHFV(UGANDA 3010)__U88416.1__N
  source 1..1449: mol_type = other RNA
atggaaaacaaaatcgaagtaaccagcaaagacgaaatgaaccgctggttcgaagagttcaagaaatccaacggcctggtagacaccttcaccaacagctactccttctgcgaatccgtccccaacctagaccgattcgtcttccaaatggcgtccgccaccgacgacgcacaaaaagacagcatatacgcaagcgcactcgttgaagcaaccaaattctgcgcccccatctacgaatgcgcctgggtgtcctcaaccggaatcgtaaagaaaggcttagaatggttcgagaaaaacgccggcacaatcaaatcctgggacgaaagctacaccgaactgaaagtaggagtaccaaaaattgaacaactagccaactaccaacaagcagccctaaaatggagaaaagacatcggcttccgtgtcaacgccaacacagctgccctctccaacaaagtcctcgccgaatacaaagtacccggagaaatagtcatgtccgtcaaagaaatgctgagcgacatgatccgccgtcgaaacctcatcctaaaccgaggcggcgacgaaaacccacggggccccgtcagccgggaacacgtggaatggtgccgcgaatttgtcaaaggaaaatacataatggccttcaacccaccatggggcgacataaacaaatccggcagatccggcatcgccctcgtcgccacaggcctagccaaactcgcggaaaccgaaggcaaaggcgtattcgacgaagccaagaaaacggtcgaagacctaaacggctaccttgacaaacacaaagacgaagtcgacaaagcaagcgctgacggaatggtcaccaacctactcaaacacatagcaaaagcccaggaactttacaaaaactcatccgccctcctcctacaaggagcccaaatcgacaccccgttcagcagcttctactggctatacaaagcaggcgtgagcccagaaaccttcccaacagttagccaattcctcttcgaactcggcaaacaacccagagggaccaagaaaatgaagaaagcactcctcagcacccctatgaaatggggcaagaaactctacgaactcttcgccgacgactccttccaagaaaaccgcatatacatgcaccccgcggtactcacagccgggcgcatctccgaaatgggagtatgcttcgggacaatacccgtagccaacccagacgacgccgcccaaggcagcggacacaccaaatccatactcaacctaggcaccaacacagaaaccaacaacccttgcgccaaaacaatcgtcaaactattcgaaatccagaaaaccggattcaacatccaagacatggacatcgtcgcatcagaacacctactacaccaatccctcgtaggaaaacaatcccccttccaaaacgcatacaacgtaaaaggcaacgccacctcagccaacataatataa

SEQ ID NO: 8113 - RNA, 1449 nt, synthetic construct
  misc_feature 1..1449: note = derived and/or modified CDS sequence (opt11) from CCHFV(UK ex Bulgaria)__KM201260.1__N
  source 1..1449: mol_type = other RNA
atggaaaacaaaatcgaagtaaacagcaaagacgagatgaacaaatggttcgaagaatttaagaaaggaaacggactgatggacaccttcacaaactcctacagcttctgcgaaaatgtccccaacctcgacaaattcgtcttccaaatggccagcgcaacagacgacgcccaaaaagactcaatctacgcctcagcactcgtcgaagccacacgcttctgcgcccccatttacgaatgcgcgtgggtaagcagcaccgggatcgtgaagaaaggcctggaatggttcgagaaaaactctggcaccataaaaagctgggacgaaaactacgccgaactcaaagtagacgtacccaaaatagaacaactagccaactaccaacaagccgccctcaaatggcgcaaagacataggattcagagtcaacgccaacacagctgccctctccaacaaagtcctagccgaatacaaagtcccaggcgaaatcgtcatgagcgtcaaagaaatgctatccgacatgatcagacgacgcaacctaatcctcaacaggggcggcgacgaaaacccccgcgggcccgtaagcagagaacacgtcgaatggtgccgagagttcgtcaaaggcaaatacataatggccttcaacccaccatggggcgacatcaacaaatccggcagaagcggcatagccctggtcgcaaccggcctagccaaactggccgaaaccgaaggcaaaggagtcttcgacgaagcaaagaagacggtcgaagcactgaacggctacctagacaaacaccgcgacgaagtcgacaaagcatccgcggactccatgatcaccaacctactaaaacacatagcaaaagcacaagaactctacaaaaatagctcagcactccgagcccaaggcgcccaaatcgacacaccattctcctccttctactggctctacaaagctggagtcaccccagaaaccttcccaaccatctcccaattcctgttcgaactcggaaaacaaccgagaggcaccaagaaaatgaagaaagcactactgtccacccccatgaaatggggaaagaaactatacgaactattcgccgacgactcgttccaacaaaaccggatatacatgcacccggccgtcctcacagctggccgaatctccgagatgggagtctgcttcggaaccatccccgtagccaaccccgacgacgccgcccagggatcgggacacaccaaatccatcctcaacctaagaacctccaccgagaccaacaacccctgcgccaaaacaatcgtaaaactcttcgaaatccagaaaacaggattcaacatccaagacatggacatagtcgcaagcgagcacctactgcaccaatccctagtcggcaaacaatccccattccaaaatgcctacaacgtcaaaggcaacgcaaccagcgcgaacatcatataa

SEQ ID NO: 8114 - RNA, 1449 nt, synthetic construct
  misc_feature 1..1449: note = derived and/or modified CDS sequence (opt11) from CCHFV(Yozgat19-2012)__KR092375.1__N
  source 1..1449: mol_type = other RNA
atggaaaacaaaatagaagtaaactccaaggacgaaatgaacaaatggttcgaggagttcaagaaagggaacggcctcatggacaccttcaccaacagctacagcttctgcgaaaacgtcccaaacctcgacaaattcgtcttccaaatggcgtcagccaccgacgacgcacaaaaagacagcatatacgcaagcgcgctcgtagaagccaccaaattttgcgcccccatctacgaatgcgcctgggtctccagtaccggcatcgtcaagaaagggctggagtggttcgagaaaaactccggcacaatcaaatcctgggacgaaaactacgcagaactaaaagtagatgtgcccaaaatcgaacaactcgcaaactaccaacaagcagccctgaaatggcgaaaagacatcggcttcagagtaaacgccaacaccgccgcgctctcaaacaaagtccttgccgaatacaaagtccccggagaaatcgtcatgagcgtaaaagaaatgcttagcgacatgatcagacgccgcaacctcatcctgaaccgaagcggggacgaaaacccccgaggcccagtatcacgcgaacacgtcgaatggtgccgtgagttcgtcaaaggaaaatacatcatggccttcaacccaccctggggagacataaacaaaagcggccgctccggcatcgccctcgtcgccacgggcctagccaaactcgccgaaaccgaaggcaaaggtgtattcgacgaggcaaagaaaacagtcgaagcactaaacggctaccttgacaaacaccgcgacgaagtagacaaagccagcgccgactcaatgataaccaacctcctaaaacacatcgccaaagcacaagaactatacaaaaactcaagcgccctacgcgcccaaggcgcccaaatcgacacccccttcagctctttctactggctctacaaagccggcgtcacccccgaaacctttcccaccatctcccaattcctcttcgaactcggaaaacaaccacgcggcaccaagaaaatgaagaaagccctcctctccacccccatgaaatggggcaagaaactatacgaactcttcgccgacgactcattccaacaaaatcgaatctacatgcaccccgccgtgctaacagccggccgcatatcagagatgggagtatgcttcggcacaatcccagtcgccaacccagacgacgcagcacaaggttctggccacacgaaaagcatactaaacctacgcacatccacagaaaccaacaatccatgcgccaaaacaatagtcaaactcttcgaaatccagaaaaccggattcaacatccaagacatggacatcgtagccagcgaacacctacttcaccaatccctcgtaggaaaacaaagcccctttcaaaacgcctaccacgtgaaaggcaacgcgacatcagcaaacatcatctaa

SEQ ID NO: 8115 - RNA, 1449 nt, synthetic construct
  misc_feature 1..1449: note = derived and/or modified CDS sequence (opt11) from CCHFV(Yozgat207-2011)__KR092377.1__N
  source 1..1449: mol_type = other RNA
atggaaaacaaaatcgaagtcaactcaaaagacgaaatgaacaaatggttcgaagagttcaaaaaaggcaacggcctaatggacacgttcaccaactcctacagcttctgcgaaaacgtaccaaacctggacaaattcgtattccaaatggccagcgccaccgacgacgcccagaaagactccatatacgcctcagccctcgtagaagcgaccaaattctgcgcccccatatacgaatgcgcctgggtctccagcacagggatagtaaaaaaaggcctcgaatggttcgaaaaaaactccggcacaatcaaatcatgggacgagaactacgccgaactcaaagtcgacgtaccaaaaatcgaacaactggccaactaccagcaagccgccctcaaatggcgcaaagacataggattccgcgtaaacgcaaacacagccgcactcagcaacaaagtcctcgcagaatacaaagtccccggcgaaatagtaatgagcgtcaaagaaatgctatccgacatgatcaggcgccgaaacctcatcctaaaccggggcggagacgaaaacccacgcggccccgtcagccgcgaacacgtcgaatggtgccgtgaattcgtcaaaggaaaatacatcatggccttcaaccccccctggggagacatcaacaaatccggccgaagcggcatcgccctcgtagccacaggactagccaaactagcagaaacggaagggaaaggcgtcttcgacgaagccaaaaaaaccgtcgaggcacttaacgggtacctcgacaaacaccgcgacgaagtcgacaaagcctctgccgactccatgataaccaacctacttaaacacatcgccaaagcgcaagagctatacaaaaacagctcagccctacgcgcacaaggcgcccagatcgacacccccttcagttccttctactggctgtacaaagcgggcgtcaccccagaaaccttccccacaatatcacagttcctgttcgaactcggcaaacaaccccgaggtaccaaaaaaatgaaaaaagccctcctaagcacccctatgaaatggggaaagaaactatacgaactattcgcagacgactcattccaacaaaaccgaatctacatgcacccggccgtcctcacagcaggacgcatcagcgaaatgggcgtctgcttcggcaccatccccgttgccaacccggacgacgccgcccaaggctcaggccataccaaatccatcctaaatcttcgcacctcgaccgagaccaacaacccatgcgcaaagaccatcgttaaactcttcgaaatccaagaaaccggcttcaacatccaagacatggacatagtcgcctccgaacacctcctacaccagagcctcgttggaaaacaatcccccttccagaacgcctacaacgtaaaaggcaacgccacctccgccaacataatataa

SEQ ID NO: 8116 - RNA, 1452 nt, synthetic construct
  misc_feature 1..1452: note = derived and/or modified CDS sequence (opt11) from DUGV(ArD44313)__AF434161.1__N
  source 1..1452: mol_type = other RNA
atggaaaaccaaatcaaagccaacaacaaaaaagaattcgacgaatggttcaaaccattctccgaaaaactgcaattaagatctaatctcaccaactcagccagcctatgcgaccgcgtacccgacctcgccctcgcagaaatgaaaatggccctcgcaacagacgacaaagaaaaagactccatattctccaacgccctcgtggaagcaacccgcttctgcgcccccatctacgaatgcgcctggacttgtagcaccggagtcgtccaaaaatccctctcctggttcgacaaaaataaagacttcatcaaactatgggacgccaaatacatggacctcaaaaaaggcatcccggaaccagaacagctcgtcagctaccaacaagcagcccaaaaatggcgcaaggacgtcggatacgaaatcaaccaattcacacgctccctaacccaccccgtcgtggccgaatacaaagtacccggcgaaatcgctgtagacgtaaaagagatgctatccgacatgatccgcagacgcaacgtcctcctcaacggtgacggtgagaacgcaggcaaaaaaggccccatatcccgcgaacacgtctcgtggggccgagaactcgcaggcggcaaattccaagtcgtcttcaacccgccctggggagacatcaacaaatgcggcaaatcagggatcccgctcgccgccaccgcaatggtaaaagtagcagaactcgacggcagcaaaaaactagaagacatccgccaagccctcctagacctaaaaaaatgggtcgaagacaacaaggacgccctagaagacgggaaaggaaacgaactcgtccaaaccatgaccaaacacctcgcacaagccgtagaactcagcaaaaaaagcaacgcactccgcgcccaaggggcccaaatagatacccccttctcagcctactactgggcctggagcgccggcgtaaaaccagaaacattcttcaccctctcccaattcctgttcgaaatgggccaatcagcacgaggaggaaaaaaaatgatcaaagccctcacctcaacccccctccgctggggcaaaggcctcatcaacctcttcgccgacgacgacttcctaggcaaccgcctctacatgcacccagccgtcctaactccagggcgaatgtccgaaatgggagcatgcttcggcgtcataccagtagcctcacccgaagacgcaatactaggctcaggccactcaaaaaacatcctaaacttcaagatcgacacctcagtacagaacccatgcgcgtcaaccatagtccaactctaccgaatacaaaaatccggcttcgacctggaatccctcgaggtagttagcacagaacacctcctccaccaaagcttcgtaggaaaaagatgccccacccaaaacgcctacaaagtccgaggaaacgcaaccaacgtgaacataatctaa

SEQ ID NO: 8117 - RNA, 1452 nt, synthetic construct
  misc_feature 1..1452: note = derived and/or modified CDS sequence (opt11) from DUGV(ArD16095)__AF434162.1__N
  source 1..1452: mol_type = other RNA
atggaaaaccaaatcaaagccaacaacaagaaagagttcgacgaatggttcaaacccttcagcgagaaacttcagctcaggagcaacctcacaaacagcgcaagcctctgcgaccgcgtacccgacctcgcactggccgaaatgaaaatggccctagccaccgacgacaaagaaaaagacagcatattcagcaatgcactcgtagaagcaacacgcttctgcgccccaatatacgaatgcgcatggacctgctcaaccggcgtcgtccagaaatccctgagctggtttgacaagaacaaagatttcatcaaactctgggactcaaaatacatggacctccgaaaaggaatccccgaacccgaacaactcgtctcataccaacaagccgcccaaaaatggcgaaaagacgtcggctacgaaatcaatcaattcaccagatccctgacacaccccgtagtcgccgagtacaaagtcccaggagaaatcgcagtcgacgtgaaagaaatgctcagcgacatgatccgacgccgtaacgtcctcctaaacggagacggagaaaacgcgggaaagaaaggcccaatcagccgagaacacgtctcatggggacgcgaattagccggaggcaaattccaagtggtattcaacccaccctggggcgacatcaacaaatgcggaaaatccggcatccccctcgccgccacagcaatggtcaaagtcgccgaactcgacggctcaaagaaactagaagacatccgacaagcccttctcgacctcaagaaatgggtggaagacaacaaagacgcactcgaagacggcaaaggcaacgagctagtgcaaaccatgaccaaacacctagcacaagcagtggaactgtccaagaaatccaacgcgctacgcgcacaaggggcccaaatcgacacacccttcagcgcgtactattgggcctggtccgccggggtcaaacccgaaaccttcttcacactctcccaattcctcttcgaaatgggacaaagcgcccgcggaggaaagaaaatgatcaaagccctcacatccacacccctccgatggggcaaaggcctcatcaacctgttcgccgacgacgacttcagcggcaatcgcctatacatgcaccccgccgtcctcacccccggacgaatgtcagaaatgggcgcatgcttcggcgtcatccccgtagccagcccggaagacgcaattctaggctcaggccacagcaaaaacatactgaacttcaaaatcgacaccagcgtacagaacccatgcgccagcaccatcgtccaactctaccgcatccaaaaatcgggattcgacctagaaagcctcgaagtagtcagcaccgaacatctactccaccagagctttgtcggaaaacgttgccccacacaaaacgcctacaaagtcagaggaaacgccaccaacgtaaacataatctga

SEQ ID NO: 8118 - RNA, 1452 nt, synthetic construct
  misc_feature 1..1452: note = derived and/or modified CDS sequence (opt11) from DUGV(IbH11480)__AF434163.1__N
  source 1..1452: mol_type = other RNA
atggaaaaccaaatcaaagcgaacaacaaaaaagaattcgacgaatggttcaaaccgttctccgaaaaactccaactccgttcaaacctcaccaacagcgccagcctgtgcgacagagtcccggacctcgccctggcagaaatgaaaatggccctcgcgacagacgacaaagaaaaagactccatcttctccaacgcgctggtcgaagccacaagattctgcgccccaatctacgaatgcgcctggacctgcagcaccggcgtcgtacagaaatccctctcctggttcgacaaaaacaaagacttcataaaactatgggacgcgaaatacatggacctccgcaaaggcatccccgaacccgaacaactagtgagctaccaacaagccgcccaaaaatggcgcaaagacgtaggctacgaaatcaatcagttcacccgaagcctcacccaccccgtcgtcgcggaatacaaagtaccaggcgaaatcgcagtcgacgtcaaagaaatgctcagcgacatgatccgccgccgcaacgtcctgctcaatggggacggcgagaacgcagggaagaagggcccaatctcccgcgagcacgtatcgtggggccgcgaactcgcgggcggcaagttccaagtcgtcttcaaccccccatggggcgacatcaacaaatgcggcaaatcaggaatcccactcgcagccactgccatggtcaaagtcgcggaactcgacggctccaaaaaactagaagacatacgccaagccctactagacctcaaaaaatgggtagaagacaacaaagacgcactagaggacggcaaaggcaacgaactcgtgcaaaccatgacaaaacacctagcccaagccgtcgaactatcaaaaaaaagcaacgccctaagagcccaaggagcacaaatcgacaccccattctcagcattctactgggcttggtcagcaggagtcaaacccgaaaccttcttcacactgtcccaattcctcttcgaaatgggccaatctgcccgcggcggcaaaaaaatgatcaaagcactcacaagcactccactgcggtggggcaaaggccttatcaacctattcgccgacgacgatttcctaggcaacagactctacatgcaccccgccgtactaactcccggcagaatgagcgaaatgggagcatgcttcggcgtcatacccgtagcatcacccgaagacgcaatcctaggctccggacacagcaaaaacatcctcaacttcaaaatcgacacctcagtacaaaacccatgcgcaagcaccatagtccaactgtacagaatccaaaaatcaggcttcgacctcgaatcattagaagttgtcagcaccgaacacctcctacaccaaagcttcgtgggaaaaagatgcccgacacaaaacgcctacaaagtccgcggcaacgcaaccaacgtaaacataatctga

SEQ ID NO: 8119 - RNA, 1452 nt, synthetic construct
  misc_feature 1..1452: note = derived and/or modified CDS sequence (opt11) from DUGV(IbAr1792)__AF434164.1__N
  source 1..1452: mol_type = other RNA
atggaaaaccaaatcaaagcaaacaacaaaaaagaattcgatgaatggttcaaacccttctcagaaaaactacaactacgcagcaacctaaccaactcagcatccctatgcgaccgcgtccccgacctcgcgctagccgagatgaagatggccctagccaccgacgacaaagaaaaagacagcatcttctccaacgctctcgtcgaagccacccgattctgcgcgcccatctacgaatgcgcctggacatgctccacgggcgtcgtccaaaaatccctctcatggttcgacaaaaacaaagacttcataaaactctgggacgcaaaatacatggacctacgcaaaggcatacccgaaccagaacaactcgtatcctaccaacaagcagcccaaaagtggcgcaaagacgtcggctacgaaataaaccaattcacccgatcactaacccaccccgtagtggccgaatacaaagtgcccggagaaatagccgtcgacgtcaaagaaatgctcagtgacatgatccgacgacgcaacgtcctcctaaatggagacggcgagaacgccggaaaaaaaggacccataagcagagaacacgtatcctggggccgagaattagccggcggaaaattccaagtcgtattcaaccccccctggggagatatcaacaaatgcggaaaatccggcatcccactagccgcaacagccatggtaaaagtcgcagagcttgacggaagcaaaaaactggaagacatccgccaagcccttctcgaccttaaaaaatgggtcgaagacaacaaagacgcgctcgaagacggcaagggaaacgaactcgtacaaaccatgaccaaacacctcgcccaggctgtcgaactcagcaaaaagtccaacgccctccgcgctcaaggcgcacaaatagacacccccttctccgcctactactgggcctggtcagcaggcgtaaaaccagaaaccttcttcaccctctcccaattcctcttcgaaatgggccagtccgccagaggagggaaaaaaatgatcaaagccctgacaagcacacccctccgctggggaaaaggactcatcaacctcttcgcagacgacgacttcttaggtaacaggctctacatgcaccccgccgtactcacacccggcagaatgtccgaaatgggggcctgcttcggagtcatacccgtagccagcccagaagacgcaatcctaggatcgggacactcaaaaaacatcctgaacttcaaaatcgacaccagcgtccaaaacccctgcgcgtccaccatcgtacaactctaccgcatacagaaatccggattcgacctagaaagcctcgaggtcgtaagcaccgaacacctactccaccaatccttcgtgggcaaacggtgcccaacccagaacgcctacaaagtccgcggaaacgcgaccaacgtaaacataatctag

SEQ ID NO: 8120 - RNA, 1452 nt, synthetic construct
  misc_feature 1..1452: note = derived and/or modified CDS sequence (opt11) from DUGV(KT281/75)__AF434165.1__N
  source 1..1452: mol_type = other RNA
atggaaaaccaaatcaaagccaacaccaagaaagagttcgacgaatggttcaaacccttcagcgacaaacttcaactccgcagcaccctcacgaactcagcctcactctgcgaccgagttccagacctggccctggccgaaatgaaaatggccctcgctaccgatgacaaagaaaaagactccatcttctccaacgccctagtcgaagcaacacgattctgcgccccaatctacgaatgcgcgtggacttgctccacgggcgtcgtccagaaaagcctgtcatggttcgacaagaacaaagatttcatcaaactctgggacgcaaaatacatggacctacgcaaaggaatccccgaacccgaacaattagtctcctaccaacaagccgcccaaaaatggcgaaaagacatcgggtacgaaatcaaccaattcacccgctccctcacccaccccgtcgtggccgaatacaaggtacccggcgaaatagcagtcgacgtgaaagaaatgctgtccgacatgatccgccgccgcaacgtcctcctaaacggcgacggcgaaaacgccggcaagaaaggcccaatctcccgcgaacacgtatcctggggccgcgaactagcaggcggcaaattccaggtcgtcttcaatcccccatggggagacatcaacaaatgcggcaaaagcggcatccccctcgccgcgaccgccatggtcaaagtcgccgaacttgacggctccaagaaactcgaagacatccgacaagctctcctcgacctcaagaaatggatagaagataacaaagacgccctcgaagacggaaaaggtaacgaactcatccaaaccatgacaaaacacctagcacaagccgtagaactttcaaagaaatccaacgccctccgagcacaaggcgcccaaatagacacacccttctcagccttctactgggcatggagcgccggagtaaaacccgagacatttttcaccctctcacaattcctattcgaaatgggccaatcagcccgcggcggaaagaaaatgataaaagcgctaaccagcaccccactccggtggggcaaagggctaataaacctcttcgccgacgacgacttctccggcaacagactatacatgcaccccgcagtcctcaccccagggcgcatgtccgaaatgggagcctgcttcggcgtcatcccagtcgcctcaccagaagacgcaatcctaggaagcggccacagcaaaaacatcctcaacttcaaaatagacacatcagtccaaaacccctgcgcctcaaccatcgtccaactataccgaatacaaaaatccggcttcgacctagaatccctcgaagtcgtctccaccgaacacctcctacaccaatccttcgtcggcaaacgctgcccaacccaaaacgcctacaaagtccgcggcaacgccacaaacgtcaacataatataa

SEQ ID NO: 8121 - RNA, 1452 nt, synthetic construct
  misc_feature 1..1452: note = derived and/or modified CDS sequence (opt11) from DUGV(NJT130)__FJ422213.2__N
  source 1..1452: mol_type = other RNA
atggaaaaccaaatcaaagctaacaacaaaaaagaattcgacgaatggttcaagcccttctccgacaaactacaactaagatccacgctcaccaactcagcctccctatgcgacaaagtccccgacctggcactagccgaaatgaaaatggccctagccaccgacgacaaagagaaagactccatcttctccaacgccctagtcgaagctaccagattctgcgcacccatctacgaatgcgcctggacttgcagcaccggcgtcgtccaaaaatccctatcatggttcgacaaaaacaaagacttcataaaactatgggacgccaaatacatggacctccgaaaaggcatacccgaaccagaacaactagtcagctaccaacaagccgcccaaaaatggcgcaaagacatcggatacgaaataaaccaattcaccagatccctcacccaccccgtagttgccgaatacaaagtccccggcgaaatagccgtcgacgtgaaagaaatgctctcggacatgatccgacgacgtaacgtacttctaaacggagacggcgagaacgccggcaaaaaaggccccatatcccgagaacacgtcagctggggccgcgaactcgccgaaggcaaattccaagtagtctttaacccaccctggggcgatatcaacaaatgcggcaagtcaggaatacccctcgcagccaccgcaatggtcaaagtcgccgaactggatggctccaaaaaactagaagacatccgccaagcgctgctcgacctcaagaaatgggtcgaagacaacaaagacgccctcgaagacggcaaaggcaacgaacttatccaaacaatgacaaaacacctagcccaagccgtcgaactcagcaaaaaatccaacgccctccgagcacaaggcgcccaaatcgacacacccttctcagccttctactgggcatggtcagccggcgtcaaacccgaaaccttcttcaccctctcccaattcctattcgaaatgggacaaagcgcccgaggcggcaagaaaatgatcaaagccctgacatccacccccctacgctgggggaaaggcctcataaacctattcgccgacgacgacttcagcgggaaccgcctttacatgcaccccgccgtcctaaccccaggccgaatgtcggaaatgggcgcgtgcttcggcgtcatccccgtcgccagccccgaagacgccattctcggatccggccactcaaaaaacatcctaaacttcaaaatagacaccagcgtccaaaatccctgcgcctccaccatcgtccaactctaccgcatccaaaaatccggcttcgacctagaaagcctagaagtcgtatctacagaacacctactccatcaatcattcgtaggcaaacgatgcccaacacagaacgcatacaaagttcgcgggaacgcaaccaacgtcaatataatctaa

SEQ ID NO: 8122 - RNA, 1452 nt, synthetic construct
  misc_feature 1..1452: note = derived and/or modified CDS sequence (opt11) from DUGV(IbAr1792)__KU925457.1__N
  source 1..1452: mol_type = other RNA
atggaaaaccaaatcaaagccaacaacaaaaaagaattcgacgaatggttcaaaccattctccgaaaagctacaactacgaagcaacctaaccaactctgccagcctctgcgaccgcgtccccgacctagccctcgccgaaatgaaaatggccctcgccaccgatgacaaagaaaaagactccatcttctcaaacgccttagtcgaggctacacgtttctgcgcccccatatacgaatgcgcgtggacatgctccaccggcgtcgtccaaaaaagcctgagttggttcgacaaaaacaaagacttcatcaaactatgggacgccaaatacatggacttacgaaaaggtatccccgagcccgagcaactcgtatcataccaacaagcagcccaaaaatggcgcaaagacgtcggctacgaaataaaccagttcacccgcagcctcacccaccccgtcgtagcagaatacaaagtccccggcgaaatcgcggtcgacgtcaaagaaatgctcagcgacatgatccgccgacgaaacgtcctcctcaacggagacggagaaaacgcaggcaaaaaaggccctatctcgcgagaacacgtctcctggggacgcgaactcgcaggaggcaagttccaagtcgttttcaaccccccgtggggagacataaacaaatgcggaaaatcaggcatacccctcgccgccaccgcaatggtcaaagtcgccgaactagacggatccaaaaaactagaagacatccgacaagcactcctcgacttaaaaaaatgggtcgaagacaacaaagacgccctcgaagacggaaaaggcaacgaactagtacaaaccatgaccaaacacctcgcccaagccgtcgagctctcaaaaaaatccaacgccctccgcgcacaaggagcccaaatagacacccccttctccgcattctactgggcctggtccgcaggagtcaaacccgaaaccttcttcaccctatcccaattcctcttcgaaatgggacaaaacgcccgaggcggcaaaaaaatgataaaggcactaacctccacgcccctaagatggggcaagggcctcatcaacctattcgccgacgacgacttcctcggaaaccgcctctacatgcaccccgcggtcctcacacccggccgcatgtcagaaatgggcgcctgcttcggcgtaatcccggtggccagccccgaagacgccatcctcggaagtggtcacagcaaaaacatacttaacttcaaaatcgacaccagcgtccagaatccctgcgccagcaccatagtacaactataccgcatacaaaaatccggcttcgacctcgaatccctcgaggtagtcagcacagaacacctcctccaccaatcgttcgtaggcaaacgatgccccacccaaaacgcctacaaagtccgcggcaacgccaccaacgtaaacattatatga

SEQ ID NO: 8123 - RNA, 1449 nt, synthetic construct
  misc_feature 1..1449: note = derived and/or modified CDS sequence (opt11) from NSDV(Jilin)__NC_034386.1__N
  source 1..1449: mol_type = other RNA
atgcaaaaccaaatagtcgcagacaataaagacgccatactcgcgtggcacaaaacctactcagagaagcacagactcaaaagcgtactcacaaactcagcgtcgttctgcgaaacgatccccgaccttagcggatacgaagtaagcatgcgactggtcagctcagaaagcgaaaaagacagcgtatacgcctcggccctggtagcggccacgaaattctgcgcgcccatactcgaatgcgcatggacaagctgcaccggaatggtggaaaggggcctagactggttcgagaacaacaaagagacagtaaaaatatgggatgccgaatacgggaaactccgaacggaagcgccctcgcccgaacaactactcggataccaacgcgccgcactgaaatggcgcaaagacaccaaatacggcataaacagaaacacggccgcgctagcagccgcaatcgcgaccgagtaccgagtcccaggctccatcgtagtcaacgtaaaagacatgctctcagacatgatccgacgccgcaacaaaatcctcaacagagacgggagcgaagacgtacccaaacgaggacccgtaagcaaagaacacatcgactgggcacgcgacctcgcacaagggaaattcctcgtagtcttcaacccaccctggggcgacataaataaagcgggcaaaagcgggatcgcactagcggcaacaggcatggccaaactcatcgaactcgacgggcccaaaatcgcagaagacctccgagaatcactaaaaggcctagtcgcctggatcaacgcgcacaaagacgaagtcgaaaacggaaaagaagtcgtggacggactcacaaaacacctccaaaaagcactagaactcgcaaaacaaagctccgccatgagagcacaaggagcacaaatagacaccgtgttctcaagctactactggctctggaaagcgggagtaaccgccgaaatgttcccaaccgtgagccagttcctattcgaactcggaaaagtgcccagaggcaacaaaaaaatgaaaaaagcgctctcaagcatgccactgaaatggggaaaaaaactactcgcactctttgcggatgactcattcacagccaatcgcatatacatgcaccccggagtactcacagcagggcgcatgagcgagctcggagtctgcttcggggcaattcccgtagcaaacccagacgacgcggccgaaggttccggacacataaaaaacatactagcacaaacaaccgacacccaggccgggaacccttgcgcccaaaacatagtcgccctattcaacatccaaaaagcgggcttcgacatagaatcaatggacatcgtagccctagaacacctcctacaccaaagcctagtcggcaaaagaagcccgttccagaacgcgtacaacatccgcggcaacgcaaccagcatacaaatcatctag

SEQ ID NO: 8124 - RNA, 1449 nt, synthetic construct
  misc_feature 1..1449: note = derived and/or modified CDS sequence (opt11) from NSDV(62873)__HQ286609.1__N
  source 1..1449: mol_type = other RNA
atgcaaaaccaaatagtcgcagacaacaaagacgccatacttgcctggcacaaaacctactcggaaaaacacaaactcaaaagcgtactcacaaactcagcatcattctgcgaaactatcccagacctgagcggatacgaagtatcaatgcgactcgtgtcctccgaatcagaaaaagactcagtatacgcctcagctctagtcgcagccacaaaattctgcgctcccatccttgaatgcgcgtggacgagctgcacagggatgatacaaagaggcctggactggttcgagaacaacggagagatggtaaaaatatgggacgccgactatggaaaactacgaacggaaataccctcacccgaacaactgctcgggtaccagcgcgccgccctaaaatggcgaaaagacacaaaatacggcatcaacaaaaacactgccgcactagcagcagcgatcgcaaccgagtaccgcgtcccaggctccatcgtagtcaacgtcaaagacatgctctcggacatgataagacgccgaaacaaaatcctcaacagggacgggagtgaggacgtacccaagcgcgggcccgtgagcaaagaacacatcgactgggcgcgcgacctcgcacagggaaaatttctagtagtattcaacccaccatggggcgacatcaacaaagccggcaagagcggaatcgcactcgcagccacgggaatggccaaactaatcgaactagacggacccaaagtcgcggaagacctcaaagagtccctcaaaagcctagtcgcatggatcaacgcgcacaaagacgaagtcgaaaacgggaaagaggtcgtagacggactcacgaaacacctccaaaaagcacttgagctcgcaaaacaaagctccgcaatgcgcgcacaaggagcccagatcgacaccgtattctcaagctactactggctctggaaggcaggagtaaccgcggaaatgttcccaaccgtatcccagttcctcttcgaactcggaaaagtacccaggggcaacaagaaaatgaagaaagccctatccagcatgcccctaaaatggggaaagaaactgctcgcactattcgccgatgactcgttcaccgccaaccgcatatacatgcacccgggcgtactaacagccggacgcatgagcgaactcggagtctgctttggggccatccccgtagcaaatcccgacgacgcggccgaaggatcgggccacatcaaaaacatcctcaattacaaaacagacacccaagccggaaatccgtgcgcgcaaaacatagtagccctattcaacatccagaaagcgggcttcgatatcgagtcaatggacatcgtagcctcagaacacctcctgcaccagagcctggtcggaaaacggagcccatttcaaaacgcatacaacatccgaggcaacgccacaagcatacaaataatctag

SEQ ID NO: 8125 - RNA, 1449 nt, synthetic construct
  misc_feature 1..1449: note = derived and/or modified CDS sequence (opt11) from NSDV(779)__HQ286602.1__N
  source 1..1449: mol_type = other RNA
atgcaaaatcaaatagtcgcagacaacaaagacgcaatactcgcgtggcacaaaacatactcagaaaaacacaaactcaaaagcgtgctcacgaactcagcctcattctgcgaaacgatccccgacctctccggatacgaagtctcaatgcgcctagttagctccgaatcggaaaaagactcagtctacgcctcagccctcgtcgcagccaccaaattctgcgcccccatactcgagtgcgcatggacgagctgcaccggaatgatccaaagaggcctcgactggttcgacaacaacggcgaaatggtcaaaatctgggacgcggactacggcaaactccgaacggaagtaccctcaccagaacaactgctaggataccaacgcgcagcactgaaatggagaaaagacacaaaatacggaataaacaaaaacacggccgcgctagcagcagcaatcgcaaccgaataccgcgtccccggatcaatagtagtcaacgtcaaagacatgctctcggacatgataaggagacgcaacaaaatcctaaaccgagacggcagcgaagacgtcccaaaacgcggccccgtcagcaaagaacacatcgactgggcccgagacctagcccaaggcaaatttctagtcgtcttcaatccaccctggggagacatcaacaaagccggcaaaagcggcatagcactagccgcaacaggcatggccaaactcatagaactggacgggcccaaggtcgcagaagatctaaaagaatcactaaaaagcctagtcgcatggataaacgcacacaaggacgaagtagagaacggaaaagaggtcgtcgacggtctaaccaaacacctccaaaaagcactcgaactcgcaaaacagtcatccgccatgcgcgcccaaggtgcccagatcgataccgtattctcgagctactactggctgtggaaggccggagtcaccgcagaaatgttcccaaccgtcagccagttcctcttcgaactcggaaaagtaccacgaggcaacaagaaaatgaagaaagcactctcaagcatgcccctgaaatggggaaagaaactacttgcactcttcgccgacgattccttcaccgccaaccgcatatacatgcatccaggagtactcacggccggacgcatgagcgaactaggggtctgcttcggagccataccagtggccaaccccgacgacgcagccgaaggctcgggccacatcaaaaacatactcaactacaaaaccgatacccaagccggaaacccctgcgcccaaaacatcgtagccctgttcaacatacagaaagccggcttcgacattgaatcaatggacatagtagcctcagaacacctactgcaccaaagcctcgtcggaaaacgcagcccattccagaacgcctacaacatccgcggcaacgcaacatcaatacagatcatctaa

SEQ ID NO: 8126 - RNA, 1449 nt, synthetic construct
  misc_feature 1..1449: note = derived and/or modified CDS sequence (opt11) from NSDV(6233)__HQ286603.1__N
  source 1..1449: mol_type = other RNA
atgcaaaaccaaatagttgcagacaacaaagatgccatactcgcatggcacaaaacctactcggaaaaacacaaactaaagagcgtcctcacgaactcagcctcattctgcgaaactatcccggacctatcagggtacgaggtatccatgagactcgtatcctcggaatcagaaaaagactcggtatatgcctccgccctagtcgcggcaacaaaattctgcgcccccatactcgaatgcgcgtggacgagctgcaccggaatgattcaaagaggcctggactggttcgacaacaacggcgaaatggtaaaaatatgggacgccgactacgggaaattacgcaccgaagtgccctcccccgagcaactactcggataccaacgcgcagctctaaaatggcgaaaagacacgaaatacggaataaacaaaaacacagccgcacttgcagccgcaatagcgaccgaataccgcgtcccgggctccatcgtagtaaacgtcaaagacatgctctccgacatgatcagaagaaggaataagatcctcaacagggacggaagcgaagacgtacccaaacgtggccccgtaagcaaggaacacatagactgggcacgagacctcgcacaagggaaattcctcgtagtcttcaacccgccctggggcgacatcaacaaagcgggaaaaagtgggatcgcactcgcagcaacgggcatggccaaactaatagaattagacgggcccaaggtcgccgaagacctcaaggaatccctcaaatccctggtcgcctggatcaacgcacacaaagacgaggtcgagaacggcaaagacgtcgtagacgggctgacaaaacacctccaaaaagcactcgaactcgccaaacaaagctccgccatgcgagcacaaggcgcccaaatcgataccgtcttttccagctactactggctctggaaagcaggcgtcaccgccgaaatgttccccaccgtttcccaattccttttcgaactcggcaaagtgccccggggcaacaagaagatgaagaaagcactcagcagcatgccactaaaatggggcaagaaactacttgcgctattcgccgacgactcattcacggccaaccgcatatacatgcacccgggcgtgctcacggccggaagaatgagcgaactcggggtctgtttcggggcaatccccgtcgcaaaccccgacgacgcggcagagggctccggacacatcaaaaacatactaaactacaaaaccgacacccaagccggcaacccatgcgcgcaaaacatcgtcgcgctattcaacatccagaaagcgggcttcgacatagaatctatggacatcgtagcatcagaacacctactacaccaaagtctggtcgggaaaaggagcccattccagaacgcatacaacatccgaggcaacgccacaagcatacaaatcatctag

SEQ ID NO: 8127 - RNA, 1449 nt, synthetic construct
  misc_feature 1..1449: note = derived and/or modified CDS sequence (opt11) from NSDV(40350)__HQ286608.1__N
  source 1..1449: mol_type = other RNA
atgcaaaaccaaatcgtcgcggactcgaaagacgccatactagcgtggcacaaaacatactctgaaaaacacaaactaaagtccgtactcacaaactcggcatcattctgtgaaacgatcccagacctaagcgggtacgaggtctcaatgaggctggtcagctcagactccgaaaaggactcggtatacgcatcggcactggtcgcggccacgaaattctgcgcgcccatcctcgaatgcgcgtggacgagctgcacagggatgatacaaagaggcctggactggttcgagaacaacggcgagatggtgaaaatctgggatgccgactacgggaaactgcgcacagaagtgccctcacccgagcaactcctaggataccaacgtgcagccctaaaatggcgaaaagacacgaaatacggcataaacaagaacacggccgccctcgcggccgcgatcgcaacagagtacagagtcccgggctcaatcgtagtcaacgtcaaagacatgctaagcgacatgatccgccgaagaaacaagatattaaatagggacggcagcgaggacgtgccaaaacgaggccccgtaagcaaggaacacatcgactgggcacgcgacctagcacaaggcaaattcctcgtggtcttcaacccgccctggggcgacatcaacaaagcaggcaagagcggaatagcgctcgcggccacaggcatggccaaactcatagaactggacggaccgaagatcgcagaagacctcaaggaatcacttaaaagtctggtagcgtggataaacgcgcacaaggacgaagtcgaaaacgggaaagaagtcgtggacggtctaacgaaacacctacagaaagcgttagaactcgcgaaacaaagctcagcaatgagagcgcaaggggcacaaatagacaccgtgttctcgagctactactggctatggaaagcgggagtgacagcagaaatgttcccaaccgtaagccagttcctcttcgagctcggaaaagtaccccggggcaacaagaaaatgaagaaagcgctctcaagcatgccactcaaatggggcaagaaattgctagccctcttcgccgacgactcgttcacggccaacagaatatacatgcaccccggcgtgctcacggcaggacgaatgagcgaactcggggtctgttttggggccataccagtagccaacccagatgacgcagccgagggatcgggccacatcaaaaacatactaaactacaaaacagacacccaggccggaaacccatgcgcgcaaaacatcgtagccctgttcaacatacaaaaagcgggcttcgacatagaatcgatggacatcgtagcctcggaacatctgctacaccagagcctagtagggaaaagaagcccgttccagaacgcgtacaacatcagaggcaacgccacaagtatacaaataatctag

SEQ ID NO: 8128 - RNA, 1449 nt, synthetic construct
  misc_feature 1..1449: note = derived and/or modified CDS sequence (opt11) from NSDV(616287)__HQ286605.1__N
  source 1..1449: mol_type = other RNA
atgcaaaaccaaatcgtcgcagacaacaaagacgccatactcgcatggcataaaacatacagcgaaaaacacaaactcaaatccgtactaaccaactcagccagcttctgtgaaacgatcccagacctatccggctacgaagtatccatgagactcgtaagctccgaatcagaaaaagactcagtatacgcctcggctctggtagcagccaccaaattctgcgcgcccatcctcgaatgcgcctggaccagctgcaccggaatgattcaaagaggcctcgactggttcgacaacaacggcgaaatggtaaaaatatgggacgccgactacgggaaactacgcacagaagtaccctcacccgaacaactcctcggataccaaagggcagccctcaaatggcgcaaagacacgaaatacggaataaacaagaacacggccgcactcgcggcagcaattgcgaccgagtacagagtcccaggcagcatcgtggtaaacgtaaaagacatgctcagcgacatgatacggcgaagaaacaagatcctcaacagggacggaagcgaagacgtccccaaaaagggtccagtgagcaaagagcacgtagactgggcccgcgacctagcgcaagggaaattcctcgtggtcttcaatcccccatggggcgacataaacaaagcaggcaaaagcggaatcgcactcgcagccaccggaatggcaaaactcatagaactggacggacccaaggtcgccgaagacctcaaagaatcactaaaaagcctcgttgcatggatcaacgctcacaaagacgaagtcgaaaacggaaaagaagttgtggacgggctaaccaaacacctccaaaaagcattagaactcgccaaacaaagctcagccatgcgcgcacaaggagcacaaatcgacaccgtattcagcagctactactggctatggaaggccggcgtaacagcagaaatgttccccacagtaagccaattcctattcgaactcggaaaagtaccacggggaaacaagaaaatgaagaaagcactctcaagtatgcccctaaaatggggcaagaaactactagccctcttcgcggacgactccttcacagcaaaccgaatctacatgcacccaggggtcctcaccgccgggcgcatgagcgaactaggagtatgcttcggagccatacccgtcgccaaccccgacgacgccgcagagggctcaggacacatcaaaaacatcctcaactacaaaacagacacccaggcaggcaacccatgcgcgcaaaacatcgtagccctcttcaacatccaaaaagcgggcttcgacatagaatcaatggacatcgtggcatcagaacacctcctccaccaatccctagtcggcaaacggtcccccttccagaacgcatacaacatcagaggaaacgccacatccatacaaatcatctaa

SEQ ID NO: 8129 - RNA, 1449 nt, synthetic construct
  misc_feature 1..1449: note = derived and/or modified CDS sequence (opt11) from NSDV(615526)__HQ286606.1__N
  source 1..1449: mol_type = other RNA
atgcaaaaccaaatagtcgccgacaacaaagacgccatactcgcgtggcacaaagcatactccgaaaagcacaaactaaaaagcgtgctcacgaactccgcctcattctgtgaaacaatcccagacctgagcgggtacgaagtctcaatgcggctcgtaagctcggaatcggaaaaagactccgtgtatgcctcagccctagtcgcagccacaaagttctgcgcgcccatactcgagtgcgcatggacaagctgcaccggaatgatccaaagaggcctcgactggttcgacagcaatggcgaaatggtcaaaatatgggacgccgactacgggaaactgcgcacggaagtaccatcgcccgaacaactgctcgggtaccagcgagccgccctcaaatggcgaaaagacacgaaatacggcataaacaagaacacagccgcactagccgcagcgatagcgaccgaatacagggttccaggctcgatcgtagtaaacgtcaaagacatgctctccgacatgataagacgaagaaacaagatcctaaaccgagacggaagcgaagacgtacccaaaggtggacctgtaagcaaagaacacatcgattgggcaagagacctcgcgcaagggaaattcctcgtcgtcttcaacccaccctggggcgacataaacaaagcaggcaaaagcggcatagcactcgcagccaccggcatggcaaaactcatagaactagacggccccaaaatcgcagaggacctcaaggaatcactcaaaagcctcgtcgcgtggataaatgcacacaaagacgaagtcgagaacggaaaagaggtcgtcgacggactaacaaaacacctacaaaaagcactcgaactcgccaaacaaagctcagcaatgcgcgcacaaggagcacaaatcgacaccgtattctcaagctactactggctctggaaagcgggcgtgaccgcagaaatgttcccgacagtaagccagttcttattcgaactcgggaaagtcccccgcggcaacaagaaaatgaagaaagccctctcaagcatgcccctaaaatggggaaagaaactgctcgcactcttcgccgacgactctttcaccgccaaccgcatctacatgcacccaggagtgctcacggccggacgaatgagtgagctcggagtatgcttcggagccataccagtggcaaaccccgacgacgcagcagaaggatcaggccacatcaaaaacatcctaaactacaaaaccgacacccaagcaggaaacccctgcgcgcaaaacatcgtagccctgttcaacatccagaaagcaggcttcgacatagaatcaatggacatcgtagcatcggaacacctcctgcaccaaagcctagtcgggaaacggagccccttccaaaacgcatacaacatcagaggcaacgccacctcaatacaaataatctaa

SEQ ID NO: 8130 - RNA, 1449 nt, synthetic construct
  misc_feature 1..1449: note = derived and/or modified CDS sequence (opt11) from NSDV(708)__AF504293.1__N
  source 1..1449: mol_type = other RNA
atgcaaaaccaaatagtagcagacaacaaagacgcaatacttgcgtggcacaaagcgtactcggaaaagcacaagctcaagagcgtactcacaaactcggcatcgttctgcgaagcgatcccagacctgagcggatacgaggtatcgatgaggctagtaagctcggactcggaaaaggactcagtatacgcctcggccctagtcgcagccacaaaattctgcgcgcccatactggaatgcgcgtggacgagctgcaccggaatggtcgaaaggggtctggactggtttgagaacaaccgcgaaatggtgaaaatatgggacacggaatacggaaaactcagaacagaagtaccctccccagaacaactactcggataccagagagcggccctgaaatggagaaaggacacgaaatacggcatcaacaagaacacggccgcactcgcagccgcgatcgcaaccgagtacaaagtcccgggatcgctagtcgtcaacgtaaaagacatgctatcggacatgatcaggcgcagaaacaagatcctgaaccgagacggcagcgaagacgtacccaaacgagggcccgtaagcaaggagcacatcgattgggcccgcgacctagcccaagggaaattcctggtagtcttcaacccgccctggggcgatatcaataaagcgggtaagtccgggatcgccctagcggccacaggcatggccaaactcatagagctggacgggccaaagatagcagaagacctcaaggagtcactaaagagcctggtcgcatggataaacgcgcacaaggacgaggtcgaaaacgggaaagaagtagtggactcgctcacaaaatacctccaaaaagcgctcgagctcgcaaaacagagcagcgccatgcgcgcacaaggtgcacagatcgacacagtcttcagcagctactactggctctggaaagccggcgtaacagcagaaatgttcccgaccgtgagccagttcctattcgagctcgggaaagtaccccggggcaacaagaaaatgaagaaagcactctcaagcatgcccctaaaatggggcaagaaactgctcgcactctttgccgacgattcattcacagccaaccgaatatacatgcacccaggcgtactaacggccggacgaatgagcgaactaggcgtctgcttcggtgcaataccagtagccaatccagacgacgcagccgacggctcaggacacatcaaaagcatactcaactacaaaaccgacacgcaggccggcaacccatgcgcacaaaatatcgtagccctcttcaacatccagaaagccggattcgacatagaatcgatggacatcgtggcatcagaacacctcctgcaccaaagcctagtagggaaaagatcccccttccagaacgcctacaacatcagaggcaacgccacgagcatacaaataatctaa

SEQ ID NO: 8131 - RNA, 702 nt, synthetic construct
  misc_feature 1..702: note = derived and/or modified CDS sequence (opt11) from BUNV__NC_001927.1__N
  source 1..702: mol_type = other RNA
atgatcgaactcgaattccacgacgtcgccgccaacacctcctccaccttcgaccccgaagtcgcctacgccaacttcaaacgcgtccacaccaccggcctctcctacgaccacatccgcatcttctacatcaaaggccgagaaatcaaaacctcactagccaaacgctccgaatgggaagtcaccctcaacctcggaggctggaaaatcaccgtctacaacaccaacttccccggcaaccgcaacaaccccgtccccgacgacggcctcaccctccaccgactatccggcttcctcgcacgctacctcctcgaaaaaatgctcaaagtctccgaacccgaaaaactcatcatcaaaagcaaaatcataaaccccctcgccgaaaaaaatggcatcacctggaacgacggcgaagaagtctacctctccttcttccccggctccgaaatgttcctaggcaccttccgcttctaccccctcgccatcggcatctacaaagtccaacgcaaagaaatggaacccaaatacctcgaaaaaaccatgcgacaacgctacatgggcctcgaagccgccacatggaccgtctccaaactcaccgaagtccaatccgccctcaccgtagtctcctccctcggctggaaaaaaaccaacgtctcagcagccgcccgagacttcctcgccaaattcggcatcaacatgtaa

SEQ ID NO: 8132 - RNA, 702 nt, synthetic construct
  misc_feature 1..702: note = derived and/or modified CDS sequence (opt11) from BUNV(SFCrEq231)__KP063894.1__N
  source 1..702: mol_type = other RNA
atgatcgaactcgaattcaacgacgtcgccgccaacacctcctcaaccttcgaccccgaagtcgcctacatcaacttcaaacgcatctacaccaccggactctcctacgaccacatccgcatcttctacatcaaaggccgcgaaatcaaaacctccctcaccaaacgatccgaatgggaagtcacactcaacctcggcggctggaaagtaaccgtcttcaacaccaacttccccggcaaccgcaactcccccgtccccgacgacggcctaaccctccaccgcctatccggcttcctcgcccgctacctcctcgaaaaaatcctcaaagtctccgaacccgaaaaactcatcatcaaatccaaaatcatcaaccccctcgccgaaaagaacggcatcacctggtccgacggcgaagaagtctacctctccttcttcccaggctccgaaatgttcctcggcaccttcaaattctaccccctagccatcggcatctacaaagtccaacgcaaagaaatggaacccaaatacctcgaaaaaaccatgcgacaacgctacatgggactcgaagcctccacctggaccgtctccaaagtcaacgaagtccaatcagccctcaccgtcgtctccggactcggctggaaaaaaaccaacgtctccgccgccgcccgcgaattcctcgcaaaattcggcataaacatgtaa

SEQ ID NO: 8133 - RNA, 702 nt, synthetic construct
  misc_feature 1..702: note = derived and/or modified CDS sequence (opt11) from BUNV(AMH001130)__JF961342.1__N
  source 1..702: mol_type = other RNA
atgatagaactcgaattccacgacgtcgccgccaacacctcctccaccttcgaccccgaagtcgcctacgcaaacttcaaacgcgtccacaccaccggactctcatacgaccacatccgcatcttctacatcaaaggacgcgaagtcaaaacctccctcgccaaacgctccgaatgggaagtcaccctcaacctcggcggctggaaaatcaccgtctacaacaccaacttccccggcaaccgaaacaaccccgtccccgacgacggactcacactccaccgcctatcaggcttcctagcccgctacctcctcgaaaaaatgctaaaagtctcagaacccgaaaaactcatcatcaaaagcaaaatcatcaacccactcgccgaaaaaaacggcatcacctggaacgacggcgaagaagtctacctctccttcttcccaggctccgaaatgttcctcggcaccttccgcttctaccccctcgccataggcatctacaaagtccaacgaaaagaaatggaacccaaatacctagaaaaaaccatgcgacaacgctacatgggcctcgaagccgccacctggaccgtatccaaactaaccgaagtccaatccgcccttaccgtcgtctcctcactcggctggaaaaaaaccaacgtctctgccgccgcccgcgacttcctcgcaaaattcggcataaacatgtaa

SEQ ID NO: 8134 - RNA, 702 nt, synthetic construct
  misc_feature 1..702: note = derived and/or modified CDS sequence (opt11) from BUNV(ArB29051)__AM709778.1__N
  source 1..702: mol_type = other RNA
atgatcgaactagaattccacgacgtcgcagccaacacctccagcaccttcgaccccgaagtcgcctacgccaacttcaaacgcgtccacaccaccggcctctcatacgaccacatcagaatcttctacatcaaaggccgagaaatcaaaacctccctagccaaacgatccgaatgggaagtcaccctaaacctcggcggctggaaaatcaccgtctacaacaccaacttccccggcaaccgcaacaaccccgtccccgacgacggcctaaccctccaccgcctctccggcttcctcgcccgctacctcctcgaaaaaatgctcaaactctccgaacctgaaaaactaattatcaaatcaaaaataatcaaccccctcgccgaaaaaaacggaatcacctggaacgacggcgaagaagtctacctctcattcttccccggctccgaaatgttcctcggaaccttccgcttctaccccctcgccatcggcatctacaaagtccaacgcaaagaaatggaacccaaatacctcgaaaaaaccatgcgccaacgatacatgggccttgaagccgcaacctggaccgtctccaaactcaccgaagtccaatccgccctcaccgtcgtatccagcctaggctggaaaaaaaccaacgtctccgccgccgcccgagacttcctagccaaattcggcatcaacatgtga

SEQ ID NO: 8135 - RNA, 702 nt, synthetic construct
  misc_feature 1..702: note = derived and/or modified CDS sequence (opt11) from BUNV(ArB28215)__AM711130.1__N
  source 1..702: mol_type = other RNA
atgatcgaactcgaattcaacgacgtcgccgtcaacacctcctcctcattcgaccccgaagcggcctacgccaacttcaaaagagtccacacaaccggcctctcctacgaccacatccgcatattctacatcaaaggccgcgaaatcaaagtctccctatccaaacgctccgagtgggaagtaaccatcaacctcggcggctggaaaatagccgtatacaacacaaacttccccggcaaccgcaactcccccgtccctgacgacggcctcaccctacaccgcctctccggcttcctcgcccgcttcctcctcgaaaaaatgctcaaaatgtccgaacccgaaaaactcatcatcaaagccaaaatcatcaacccactcgccgaaaaaaaccgcatcacctggaacgacggcgaagaagtctacctatccttcttccccggcagcgaaatgttcctcggcaccttcaaattctaccccctagccatcggcatatacaaagtccaacgaaaagaaatggaaccaaaatacttcgaaaaaaccatgcgccaacgctacatgggcctcgaagcctcatcctggaccgtctccaaactaaccgatgtccaatccgccctcaccgtagtctccggcctaggctggaaaaaaaccaacgtctccgccgccgcccgagacttcctcgccaaattcggcatcaacatgtaa

SEQ ID NO: 8136 - RNA, 702 nt, synthetic construct
  misc_feature 1..702: note = derived and/or modified CDS sequence (opt11) from BUNV(Peurto Almendras)__AJ697960.1__N
  source 1..702: mol_type = other RNA
atgtccgaaatcgcattcgacgacataggccaaatcgccgcctcaaccttcaaccccgacaaccaatacatcggattcaaaaaagtcttcacaatcggcctcacatacgaccaaatccgcatcttcttcctcaacggcaaaaaagcaaaagaaaccctatccaaacgctccgaagaaaccgtcaccctcaacttcggcggatggcgaatccccatcgtaaacacacacttccccggaaaccgcaacatagacctagcagacgacgccctcaccctccaccgcgttagcggctacctagcacgctacctactcgaaaaagtcctctccgcccaagaacccgaaaaagtcatcatcaaaacccgcatcatcaaccccatcgccgcctcaaacggcatcacctgggacgacggctacgaagtctacctatccttcttccccggctcagaatgcttcctcgaagccttcaaattctaccccctcgccatcggcatctacaaagtccaaaaaggcatgatggacgtcaaattcctcgaaaaaaccatgcgccaaaaatacgccggcctcgacgcaacagtctggacccaacaaaaatataccgacgtcatcaacgccctcctcgtagtcaacggcctcggctggaaaaaatccaacgtctccgccgccgccaaagacttcctctcaaaattcggcatccaaatatga

SEQ ID NO: 8137 - RNA, 702 nt, synthetic construct
  misc_feature 1..702: note = derived and/or modified CDS sequence (opt11) from BUNV__AF325122.1__N
  source 1..702: mol_type = other RNA
atgatcgaactcgaattcaacgacgtcgccgcaaacacctcctccaccttcgaccccgaagtcgcctacatcaacttcaaacgcctctacaccacaggcctatcatacgaccacatacgcatcttctacatcaaaggacgcgaaatcaaaacctccctcgccaaacgctccgaatgggaagtcaccctcaacctcggcggctggaaagtcaccgtcttcaacaccaacttcccaggcaaccgcaactcccccgtccccgacgacggcctcaccctacaccgcctcagcggatacctagcccgctacctcctagaaaaaatcctcaaagtctccgaccccgaaaaactcatcatcaaatccaaaatcatcaaccccctagccgaaaaaaacggaatcacctggtccgacggcgaagaagtatacctctcattcttccccggctccgaaatgttcctcggcaccttccgcttctaccccctagccatcggcatctacaaagtacaacgaaaagaaatggaacccaaatacctcgaaaaaaccatgcgccaacgctacatgggcctagaagcctcaacctggaccgtctccaaactcaacgaagtccaatccgccctcaccgtcgtatccggcctcggctggaaaaaaaccaacgtctcctccgccgcccgcgaattcctcgccaaattcggaataagcatgtaa

SEQ ID NO: 8138 - RNA, 702 nt, synthetic construct
  misc_feature 1..702: note = derived and/or modified CDS sequence (opt11) from Ab-BUNV(Cu20-XJ)__KJ710424.1__N
  source 1..702: mol_type = other RNA
atgctcgaactcgaattcgaagacgtccccaccaacataggatccaccttcgaccccgaatccggatacataaacttccaacgaaactacctccccggcgtcaccctcgaccaaatccgcatcttctacatcaaaggccgcgaaatcaaaaactccctcgccaaacgctccgaatgggaagttaccctgaaccttggcggatggaaagtccccgtcctcaacaccaacttccccggcaacagatccaacgcagtccccgactacggcctcaccttccaccgcatctcaggctacctcgcccgctacctcctcggcaaatacctcgccgaaaccgaacccgaaaaactcataatgcgcaccaaaatcatcaaccccctcgccgaaaaaaacggcatcacatgggaatccggccccgaagtctacctctcattcttccccggcgccgaaatgttcctcggcaccttcaaattctaccccctagcaatcggaatctacaaagttcaacgcaaagaaatggaccccaaattcctcgaaaaaaccatgcgtcaacgctacctaggcctcgacgcccaaacctggaccaccaccaaactcgacgaagtcgaacgcgccctcaaagtagtctccggcctcggctggaaaaaaacaaacgtctccaacgccgcccgcgaattcctctccaaattcggcatccgaatgtaa

SEQ ID NO: 8139 - RNA, 702 nt, synthetic construct
  misc_feature 1..702: note = derived and/or modified CDS sequence (opt11) from ANADV(2513 Irkutsk)__KT313716.1__N
  source 1..702: mol_type = other RNA
atgatcgaactcgaattcaacgacgtcgccgccaacacctcctccaccttcgaccccgaagtcgcctacatcaacttcaaacgaatctacaccacaggcctcagctacgaccacatccgaatcttctacatcaaaggccgcgaaatcaaaacctccctcgccaaacgttccgaatgggaagtcaccctcaacctcggcggctggaaagtcaccgtcttcaacaccaacttccccggcaaccgcaactcccccgtcccagacgacggtctcaccctccaccgcctctccggcttcctcgcccgatacctactcgaaaaaatcctcaaagtcagcgaccccgaaaaactcatcatcaaatccaaaatcatcaaccccctcgccgaaaaaaacggcataacctgggccgacggcgaagaagtctacctctccttcttccccggctctgaaatgtttctcggcaccttccgcttctaccccctcgcaatcggcatctacaaagtccaacgcaaagaaatggaacccaaatacctcgaaaaaaccatgcgccaacgatacatggggctcgaagccagcacctggacagtctccaaactcaacgaagtccaatccgccctcacagtcgtctccggcctaggctggaaaaaaaccaacgtctcctccgccgcccgcgaattcctcgcccgcttcggcatcaacatgtaa

SEQ ID NO: 8140 - RNA, 702 nt, synthetic construct
  misc_feature 1..702: note = derived and/or modified CDS sequence (opt11) from ANADV(EIV-23263Tyum)__KT313761.1__N
  source 1..702: mol_type = other RNA
atgatcgaactcgaattcaacgacgtagccgccaacacctcatccaccttcgaccccgaagtcgcctacatcaacttcaaacgcatctacaccaccggactctcctacgaccacatccgcatcttctacatcaaaggccgagaaataaaaacctcactcgccaaacgctccgaatgggaagtcacactcaacctaggcgggtggaaaatcaccgtcttcaacaccaacttccccggaaaccgcaactcccccgtccccgacgacggactcaccctccaccgcctctccggattcctcgcacgatacctcctcgaaaaaatactcaaagtctccgaccccgaaaaactcatcatcaaatccaaaatcatcaaccccctcgccgaaaaaaacggcatcacctgggcagacggagaagaggtctacctctccttcttccccggctccgaaatgttcctcggcacattccgcttctacccactcgccataggcatctacaaagtccaacgcaaagaaatggagcccaaatacctcgaaaaaaccatgcgccaacgctacatgggactcgaagcctccacctggaccgtcagcaaactcaacgaagtccaatccgccctaacagtcgtctcaggcctcggctggaaaaaaaccaacgtctcctccgcagcccgcgaattcctcgcccgcttcggcatcaacatgtaa

SEQ ID NO: 8141 - RNA, 702 nt, synthetic construct
  misc_feature 1..702: note = derived and/or modified CDS sequence (opt11) from BATV__X73464.1__N
  source 1..702: mol_type = other RNA
atgatcgaactcgaattcaacgacgtagccgccaacaccagctccaccttcgaccccgaagtcgcctacatcaacttcaaacgaatctacacaaccggcctctcctacgacaacatcagaatattctacatcaaaggccgcgaaatcaaaacatccctctccaaacgctcagaatgggaagtaacactcaacctcggcggctggaaagtcaccgtcttcaacaccaacttccccggcaaccgaaactctcccgtacccgacgacggactcacactccaccgactctccggcttcctagcccgatacttactcgaaaaaatcctcaaagtctccgacccagaaaaactcatcataaaatccaaaatcgtcaaccccctcgcagaaaaaaacggaataacctgggcagacggcgaagaagtctacctctcattcttccccggctccgaaatgttcctcggcacattccgattctaccccctcgccatcggcatctacaaagtccaacgaaaagaaatggaacccaaatacctcgaaaaaaccatgcgccaacgatacatgggcctcgaagccagcacctggaccgtctccaaactcaacgaagtacaatccgccctcaccgtcgtcagcggcctcggctggaaaaaaaccaacgtctccagcgccgcccgagaattcctcgccaaattcggcatctcaatgtaa

SEQ ID NO: 8142 - RNA, 702 nt, synthetic construct
  misc_feature 1..702: note = derived and/or modified CDS sequence (opt11) from BATV(668)__KT313687.1__N
  source 1..702: mol_type = other RNA
atgatcgaactcgaattcaacgacgtcgcagcaaacacctcctccaccttcgaccccgaagtcgcctacctcaacttcaaacgcatatacaccaccggcctctcctacgacaacatccgcatcttctacataaaaggccgcgaaatcaaagtctccctcgccaaacgctccgaatgggaagtaacactcaatctcggcggctggaaagtcaccgtattcaacaccaacttccccggcaaccgcaactcccccgtcccagacgacggcctcaccctccaccgcctatccggcttcctcgcacgatacctcctagaaaaaatccttaaagtctccgaccccgaaaaactcatcatcaaatccaaaatcatcaaccccctagccgaaaaaaacggcatcacctggtccgacggcgaagaagtctacctctccttcttccccggctccgaaatgttcctcggcaccttccgcttctaccccctcgccatcggcatctacaaagtccaacgcaaagaaatggaaccaaaatacctagaaaaaacaatgcgccagcgctacatgggcctcgaagccagcacctggaccgtctccaaactcaacgaagtccaatcagccctcaccgtcgtctccggcctaggctggaaaaaaaccaacgtctcctccgcagcccgcgaattcctcgccaaattcggcatcaacatgtaa

SEQ ID NO: 8143 - RNA, 702 nt, synthetic construct
  misc_feature 1..702: note = derived and/or modified CDS sequence (opt11) from BATV(804922)__FJ436805.1__N
  source 1..702: mol_type = other RNA
atgatcgaactagaattcaacgacgtcgccgccaacacctcctccaccttcgaccccgaagtcgcctacatcaacttcaaacgcatctacaccaccggactctcatacgacaacatccgaatcttctacatcaaaggccgagaaatcaaaacaagcctcgccaaacgctccgaatgggaagtcaccctcaacctcggcggatggaaagtcaccgtattcaacaccaacttccccggcaaccgcaactcccccgtccccgacgacggcctcaccctccaccgcctctccggcttcctcgcccgctacctcctcgaaaaaatcctcaaagtctccgaccccgagaaactcatcataaaatcaaaaatcgtcaaccccctcgccgaaaaaaacggcatcacctgggccgacggagaagaagtctacctctccttcttccccggctccgaaatgttcctcggaaccttccgcttctaccccctcgccatcggcatctacaaagtccaacgcaaagaaatggaacccaaatacctcgaaaaaacaatgcgacaacgctacatgggcctcgaagcctcaacatggaccgtaagcaaactcaacgaagtccaatccgcactcaccgtcgtctccggcctcggctggaaaaaaaccaacgtctcctccgccgcacgcgaattcctagccaaattcggcatatccatgtaa

SEQ ID NO: 8144 - RNA, 702 nt, synthetic construct
  misc_feature 1..702: note = derived and/or modified CDS sequence (opt11) from BATV(8627-11)__FJ436802.1__N
  source 1..702: mol_type = other RNA
atgatcgaactcgaattcaacgacgtagccgcaaacacctcctccaccttcgaccccgaagtagcatacatcaacttcaaacgcatctacaccaccggcctctcctacgacaacatccgcatcttctacatcaaaggccgagaaatcaaaacctccctcgccaaacgatccgaatgggaagtcaccctcaacctcggcggctggaaagtcaccgtcttcaacaccaacttccccggcaaccgcaactctcccgtccccgacgacggcctcacactccaccgcctctccggcttcctcgcccgctacctcctcgaaaaaatcctcaaagtctctgaccccgaaaaactcatcatcaaatccaaaatcgtcaaccccctcgccgaaaaaaacggcatcacctgggccgacggcgaagaagtatacctctcattcttccccggctccgaaatgttcctcggcaccttccgcttctaccccctcgccatcggcatctacaaagtccaacgcaaagaaatggaacccaaatacctagaaaaaacaatgagacaccgctacatgggcctcgaagcctccacctggaccgtctccaaactcaacgaagtccaatccgccctcaccgtcgtctccggccttggctggaaaaaaacaaacgtatcctcagccgcacgcgaattcctcgccaaattcggcatctccatgtaa

SEQ ID NO: 8145 - RNA, 702 nt, synthetic construct
  misc_feature 1..702: note = derived and/or modified CDS sequence (opt11) from BATV(G-20217)__FJ436806.1__N
  source 1..702: mol_type = other RNA
atgatcgaactcgaattcaacgacgtcgccgccaacacctcatctaccttcgaccccgaagtagcctacataaacttcaaacgcatatacaccactggcctctcctacgacaacatccgcatattctacatcaaaggtcgcgaaatcaaaacctccctagcaaaacgctccgaatgggaagtcacactcaaccttggcggctggaaagtcaccgtcttcaacaccaacttccccggcaatcgcaactcccccgtaccagacgacggcctcaccctacaccgcctctccggcttcctcgcccgctacctcctagaaaaaatcctcaaagtctccgaccccgaaaaactcatcatcaaatccaaaatcgtcaaccccctcgccgaaaaaaacggcatcacctgggcagacggcgaagaagtctacctctccttcttccccggctccgaaatgttcctcggcaccttccgcttctaccccctctccatcggcatctacaaagtccaacgcaaagaaatggaaccaaaatacctcgaaaaaaccatgcgacaacgctacatgggcctcgaagcctccacctggaccgtctcaaaactcaacgaagtccaatcagccctcaccgtagtcagcggcctcggctggaagaagaccaacgtctcctcggccgcccgcgaattcctcgccaaattcggaatctccatgtga

SEQ ID NO: 8146 - RNA, 702 nt, synthetic construct
  misc_feature 1..702: note = derived and/or modified CDS sequence (opt11) from BATV(MS50)__JX846604.1__N
  source 1..702: mol_type = other RNA
atgatcgaactagaattcaacgacgtcgccgccaacacctcctccaccttcgaccccgaagtcgcatacgccaacttcaaacgcgtccacaccaccggcctctcctacgaccacgtccgcatattctacatcaaaggccgagaaataaaaacctcactatccaaacgcagcgaatgggaagtcaccctcaacctcggcggctggaagatcgccgtctacaacacaaacttcccctccaaccgcaacaaccccgtccccgacgacggactcaccctccaccgcctctccggctacctcgcccgctacctcttcgaaaaaatcgtcaaagtctcagaacccgaaaaactcctaatcaaatccaaaatcatcaaccccctcgccgaaaaaaacggcatcacctgggccgacggcgaagaaatctacctctccttcttccccggctccgaaatgttcctcggcaccttcaaattctacccactcgccatcggcatctacaaagtccaaagaaaagaaatggaacccaaatacctcgaaaaaaccatgcgccaacgatacatgggcctcgaagccggaacctggaccgtctccaaagtcaacgaagtccaagcggccgtcaacgtagtctccaccctcggctggaaaaaaaccaacgtctcagccgccgcccgagaattccttgcaaaattcggcatcgctatgtaa

SEQ ID NO: 8147 - RNA, 702 nt, synthetic construct
  misc_feature 1..702: note = derived and/or modified CDS sequence (opt11) from BATV(ON-1/E/94)__AB257761.1__N
  source 1..702: mol_type = other RNA
atgatcgaactcgaattcaacgacgtcgccgccaacacctcctccaccttcgaccccgaagtcgcctacatcaacttcaaacgcgtctacaccacaggactatcctacgacaacatacgcatcttctacatcaaaggccgagaaatcaaaacctccctagccaaacgctccgaatgggaagtcaccctcaacctcggcggctggaaagtcaccgtcttcaacaccaacttccccggaaaccgcaactcccccgtccccgacgacggcctcaccctccaccgcctttccggcttcctagcccgctacctactagaaaaaatactcaaagtctccgaccccgaaaaactcataatcaaatcaaaaatcgtcaacccactagccgaaaaaaacggcatcacctgggccgacggagaagaagtatacctctccttcttccccggatccgaaatgttcctcggcaccttccgcttctacccgctcgccatcggcatctacaaagtccaacgcaaagaaatggaacccaaatacctcgaaaaaacaatgcgccaacgctacatgggactcgaagcctcaacctggaccgtctccaaactcaacgaagtccaatccgccctcaccgtcgtctccggcctcggctggaagaaaaccaacgtctcctcagccgcccgagaattcctcgccaaattcggcatcagcatgtaa

SEQ ID NO: 8148 - RNA, 702 nt, synthetic construct
  misc_feature 1..702: note = derived and/or modified CDS sequence (opt11) from BATV(UgMP-6830)__JX846601.1__N
  source 1..702: mol_type = other RNA
atgatcgaactcgaattcaacgacgtcgccgccaacacctcctccaccttcgaccccgaagtcgcatacatcaacttcaaacgcatctacaccaccggcctgtcctacgacaacatccgcatcttctacatcaaaggacgtgaaatcaaaacctccctcgccaaacgatcagaatgggaagtcaccctcaacctcggcggatggaaagtcaccgtcttcaacaccaacttccccggcaaccgcaactcccccgtccccgacgacggcctcaccctccaccgcctctcaggcttcctcgcacgctacctcctagaaaaaatactcaaagtatccgaccccgaaaaactcatcatcaaatctaaaatcatcaaccccctcgccgaaaagaacggcatcacctgggccgacggcgaagaagtctacctcagcttcttccccggctccgaaatgttcctcggcaccttccgcttctaccccctcgccatcggcatctacaaagtccaacgcaaagaaatggaacccaaatacctagaaaaaaccatgcgccaaagatacatgggcctcgaagcctccacctggacagtctccaaactcaacgaagtccagtccgccctcaccgtcgtctccggcctcggctggaaaaaaaccaacgtctcctcagccgcccgcgaattcctcgccaaattcggcatctccatgtaa

SEQ ID NO: 8149 - RNA, 702 nt, synthetic construct
  misc_feature 1..702: note = derived and/or modified CDS sequence (opt11) from BIRV(ArB2198)__AM711131.1__N
  source 1..702: mol_type = other RNA
atgatcgaactcgaattccaccacgtcgccgccaacacctcctccaccttcgaccccgaagtcgcctacgccaacttcaaacgaatccacaccaacggcctctcctacgacaacatccgcatcttctacatcaaaggcagagaaatcaaaacctccctcgccaaacgctccgaatgggaagtaaccctcaacctcggcggatggaaagtcgcagtatacaacaccaacttccccggcaaccgcaacaacccagtccccgacgacggcctcacactccaccgcctaagcggcttcctcgcccgatacctcctcgaaaaaatgctaaaagtctccgaacccgaaaaactcataatcaaaaccaaaatcataaacccactcgccgaaaaaaacggcatcacctggaaagacggcgaagaagtctacctctccttcttccccggctcagaaatgttcctcggcaccttcaaattctacccccttgccatcggcatatacaaagtccaaaaaaaagaaatggaccccaaatacctcgaaaagaccatgcgacaacgctacatgggcctagaggcctccacctggacagtctcaaaagtctccgaagtccaatccgccctcaccgtcgtctcctccctcggctggaaaaaaaccaacgtcacagccgccgcccgagacttcttcgccaaattcggcatcaacatgtaa

SEQ ID NO: 8150 - RNA, 702 nt, synthetic construct
  misc_feature 1..702: note = derived and/or modified CDS sequence (opt11) from BOZOV(ArB13529)__AM711132.1__N
  source 1..702: mol_type = other RNA
atgatcgaactcgaattcaacgacgtcgccgccaacacctcctccaccttcgaccccgaagccgcctacgccaacttcaaacgcgtccacaccacaggcctcacctacgaccacatccgcatcttctacatcaaaggctccgaaatcaaaacctccctagccaaacgctccgaatgggaagtcaccctcaacctcggcggctggaaaatcaccgtctacaacaccaacttccccggcaaccgcaacaacccctcccccgacgacggcctcaccctccacttcttctgcggcttcctagccaaatccctcctcgaaaaaatgctcaaagtctccgcccccgaaaaactcataatcaaatccaaaatcacatccccactcgccgaaaaaaacggcatcacatggaacgacggcgaagaagtctacctctccttcttccccggatccgaaatgttccttggcaccttccacttctaccccctacccatcggaatctaccaaggcctccgccgcgacctcgagcccaaatacttcggcaaaacactccgcctaatgtacatgggcctcgaagcctcctcctggaccgtctcaaaactcaccgaaggccaatccgccctcaccgtcgtctccggcctcggatggaaaaaaaccaacgtctcagccgcagcccgcgacttcctcgccaaattcggcatcaacatgtaa

SEQ ID NO: 8151 - RNA, 702 nt, synthetic construct
  misc_feature 1..702: note = derived and/or modified CDS sequence (opt11) from CVV__X73465.1__N
  source 1..702: mol_type = other RNA
atgatcgagctcgaattcaacgacgtcgccgccaacacctcctccaccttcgaccccgaaatcgcctacgtaaacttcaaacgcatccacaccaccggcctctcctacgaccacatccgcatcttctacatcaaaggccgcgaaatcaaaacctccctcacaaaacgctccgaatgggaagtcaccctcaacctcggcggatggaaagtaaccgtcttcaacaccaacttccccggcaaccgaaactcccccgtacccgacgacggcctcacactccaccgcctctccggctacctcgcccgctacctcctcgaaaaaatcctcaaagtatccgaccccgaaaaagtcatcatcaaatccaaaatcataaaccccctcgccgaaaaaaacggcataacctggtccgacggcgaagaagtctacctctcattcttccccggctccgaaatgttcctaggcaccttcaaattctaccccctagccatcggcatatacaaagtacaacgcaaagaaatggaaccaaaataccttgaaaaaacaatgcgccaacgatacatgggcctagaagcctccacctggacaatctccaaagtcaacgaagtacaagccgccctcaccgtcgtctccggcctcggctggaaaaaaacaaacgtctccgccgccgcccgcgaattcctagccaaattcggcatctccatgtaa

SEQ ID NO: 8152 - RNA, 702 nt, synthetic construct
  misc_feature 1..702: note = derived and/or modified CDS sequence (opt11) from CVV(10081)__KP835932.1__N
  source 1..702: mol_type = other RNA
atgatcgaactcgaattcaacgacgtcgcagccaacacatcctccaccttcgaccccgaaatcgcctacgtcaacttcaaaagaatctacaccaccggcctctcctacgaccacatccgcatcttctacatcaaaggccgcgaaatcaaaacctccctcacaaaacgatccgaatgggaagtcaccctcaacctcggcggctggaaaatcaccgtattcaacaccaacttccccggcaaccgaaactccccagtccccgacgatggcctcaccctccaccgcctctcaggctacctagcccgctaccttctagaaaaaatactcaaagtctccgaccctgaaaaagtcatcatcaaatccaaaatcatcaatccactagcagaaaaaaacggcatcacctggtccgacggcgaagaagtctacctctccttcttccccggctcagaaatgttcctcggcaccttcaaattctaccccctagcaatcggcatttacaaagtccaacgaaaagaaatggaacccaaatacctagaaaaaaccatgcgacaacgctacatgggcctcgaagcctccacctggacaatctccaaagtcaacgaagtccaagccgccctcaccgtcgtaagcggcctcggctggaaaaaaaccaacgtctccgccgccgcccgcgaattcctcgccaaattcggcatctccatgtaa

SEQ ID NO: 8153 - RNA, 702 nt, synthetic construct
  misc_feature 1..702: note = derived and/or modified CDS sequence (opt11) from CHLV(CHLV-Mex07)__EU879062.3__N
  source 1..702: mol_type = other RNA
atgatagaactcgaattcaacgacgtcgccgccaacacatcatcaaccttcgaccccgaaatcgcctacgtaaacttcaaacgaatctacaccaccggcctcagctacgaccacatccgaatcttctacatcaaaggcagagaaatcaaaacatcactaacaaaacgaagcgaatgggaagtcaccctcaacctaggcggctggaaagtaaccgtcttcaacaccaacttccccggcaaccgcaactcccccgtccccgacgacggcctcaccctacaccgcctctccggctacctcgcccgctacctcctggaaaaaatactcaaagtctccgaccccgaaaaagtcatcataaaatcaaaaatcatcaaccccctagccgaaaaaaacggcatcacatggtccgacggcgaagaagtctacctctccttcttcccgggctccgaaatgttcctcggcaccttcaaattctaccccctcgccatcggcatctacaaagtccaacgcaaagaaatggaacccaaatacctcgaaaagacaatgcgccaacgctacatgggcctcgaagcatccacctggacagtctcaaaagtcaacgaagtccaagccgccctcaccgtcgtctccggcctcggctggaaaaaaaccaacgtctccgcagccgcccgcgaattcctagccaaattcggcatctccatgtaa

SEQ ID NO: 8154 - RNA, 702 nt, synthetic construct
  misc_feature 1..702: note = derived and/or modified CDS sequence (opt11) from GERV__M19420.1__N
  source 1..702: mol_type = other RNA
atgctcgaactcgaattcgaagacgtcccaaacaacatcggctcaaccttcgaccccgaatccggctacaccaacttccaacgcaactacctccccggcgtaaccctcgaccaaatccgcatcttctacatcaaaggccgcgaaatcaaaaactcactctcaaaacgctccgaatgggaagtaaccctcaacctcggcggctggaaagtacccgtactcaacaccaatttccccggcaaccgcaacaacgccgtccccgactacggcctaaccttccaccgaatctccggctacctcgcccgctacctcctaggcaaatacctagccgaaaccgaacccgaaaaactgatcatgcgcaccaaaatcgtcaaccccctcgccgaaaaaaacggcatcacctgggaatccggccccgaagtctaccttagcttcttcccaggcgccgaaatgttcctaggcaccttccgcttctaccccctagccatcggcatctacaaggtccaacgcaaagaaatggacccaaaattcctcgaaaaaaccatgagacaacgctacctcggcatcgacgcacaaacatggaccaccaccaaactcggcgaagtcgaagccgcactcaaagtcgtctcaggactcggctggaaaaaaaccaacgtatcctccgccgcccgcgaattcctcagcaaattcggcatccgaatgtaa

SEQ ID NO: 8155 - RNA, 702 nt, synthetic construct
  misc_feature 1..702: note = derived and/or modified CDS sequence (opt11) from IACOV(BeAn314206)__JN572067.1__N
  source 1..702: mol_type = other RNA
atgtccgaaatcatcttcgacgacgtcggccaaatcacctcatcaaccttcaaccccgacgtccaatacatcaacttcaaaaaaaaccacaccaccggcctcaactacgaccaaatccgcgtcttcttcctaaacggcaaaaaagccaaagaaaccctagccaaacgatccgaagaatcactccaactcaacttcggcggatggcgcgtcgtcgtcatgaacacccacttccccggcaaccgcaacatgctcatacccgacgaagccatgaccctccaccgcctctccggctacctcgcccgctacctcctagaaagaatcctctcaggcccagaacacgagaaagtcgtcatcaccagcaaaatcgtcaacccaatcgccgcctccaacggaatcacctggaccgacggccccgaagtctacctatccttcttccccggcaccgaaatgttcctcgaatcattcaaattctacccactcgccatcggaatctacaaagtccaaaaaaaaatgatggaaagcaaatacctcgaaaaagccatgcgccaaaaatacagcggaatggacgccaccctctggacccaacaaaagtacgccgaagtcaccaacgccctcgccgtcgtctccaacctcggctggaaaaaatccaacgtctccgccgccgcccgcgacttcctagccaaattcggcatccaactctaa

SEQ ID NO: 8156 - RNA, 702 nt, synthetic construct
  misc_feature 1..702: note = derived and/or modified CDS sequence (opt11) from ILEV(ArB16282)__AM709780.1__N
  source 1..702: mol_type = other RNA
atgatcgaactagaattccacgacgtcaccgccaacacctctagcaccttcgaccccgaagtcgcctacgcaaacttcaaacgcatccacacaaacggcctcaactacgaccacatccgcatcttctacatcaaaggccgcgaaatcaaaacaagcctcgccaaacgctccgaatgggaagtcaccctaaacctaggcggctggaaaataagcgtctacaacaccaaattccccggcaaccgcaacaacccagtccccgacgacggcctcaccctccaccgcctctcaggcttcctagcccgctacctcctagaaaaaatgctcaaagtctccgagcccgaaaaactaatcatcaaatcaaaaatcataaaccccctcgccgaaaaaaacggcataacctggtacgacggcgaagaagtctacctatccttcttcccaggctcagaaatgtgcctaggcacccaagacttctaccccatggccatcgaattctaccaagtccaacgcaaagaaatggaacccaaattcctcgaaaaaaccctaaaacaacgcagcctcggcctcgaaccctccacctggaccatctcccaactcgtcaaactccaatccgccctcaccgtcgtctccggactcggctggaaaaaaaccaacgtcggagccgccgcccgaaacttcctcgccaaattcggcatcaacatgtaa

SEQ ID NO: 8157 - RNA, 702 nt, synthetic construct
  misc_feature 1..702: note = derived and/or modified CDS sequence (opt11) from ILEV(HB80P125)__AM709779.1__N
  source 1..702: mol_type = other RNA
atgatcgaactcgaattccacgacgtcaccgccaacacctcctcaaccttcgaccccgaagtcgcctacgcaaacttcaagcgcatccacaccaacggcctcaactacgaccacatccgcatcttctacatcaaaggccgagaaatcaaaacctccctcgccaaacgctccgagtgggaagtcacacttaacctcggcggctggaaaatagccgtctacaacaccaacttcccaggcaaccgcaacaaccccgtccccgacgacggcctcaccctacaccgcctctccggctacctcgcccgctgccttctcgaaaaaatgctcaaagtctccgaacccgaaaaacaaatcatcaaatcaaaaatcatcaaccccctcgccgaaaaaaacggcatcacctgggacgacggcgaagaagtctacctcagcttcttccccggatccgaaatgttcctcggaaccttccgcttctaccccctcgccatcggaatatacaaagtccaacgcaaagaaatggaacccaaatacctagaaaaaaccatgcgccaacgctacatgggcctcgaagcctccacctggaccatctccaaactcgccgaagtccaatccgccctcaccgtcgtctccggcctcggctggaaaaaaaccaacgtctccgccgccgctcgcgacttcctcgccaaattcggcatcaacatgtga

SEQ ID NO: 8158 - RNA, 702 nt, synthetic construct
  misc_feature 1..702: note = derived and/or modified CDS sequence (opt11) from ILEV(ILESHA/8e)__KC608151.1__N
  source 1..702: mol_type = other RNA
atgatcgaactcgaattccacgacgttaccgccaacacatcaagcaccttcgaccccgaagtcgcctacgcaaacttcaaacgaatccacacaaacggcctaaactatgaccacatccgcatcttctacatcaaaggacgcgaaatcaaaacctccctcgccaaacgatccgaatgggaagtcaccctcaacctcggcggatggaaaatcgcagtctacaacacaaacttccccggcaaccgcaacaaccccatccccgacgacggcctcaccctccaccgcctctccggctacctagcccgctacctccttgaaaaaatgctcaaagtatcagaacccgaaaaacaaatcatcaaatccaaaatcatcaaccccctcgccgaaaaaaacggaatcacctgggacgacggcgaagaagtctacctctccttcttccccggctccgaaatgttcctcggcaccttccgcttctaccccctcgccatcggcatctacaaagtccaacgcaaagaaatggaaccaaaatacctcgaaaaaacaatgcgccaaagatacatgggcctcgaagcctccacctggaccatctccaaactcgccgaagtacaatcagccctaaccgtcgtctccggcctcggctggaaaaaaacaaacgtctccgccgccgcccgcgacttcctcgcaaaattcggcatcaacatgtaa

SEQ ID NO: 8159 - RNA, 702 nt, synthetic construct
  misc_feature 1..702: note = derived and/or modified CDS sequence (opt11) from ILEV(R5964)__AY729651.1__N
  source 1..702: mol_type = other RNA
atgatcgaactcgaattccacgacgtcaccgccaacacctcctccacattcgaccccgaagtcgcctacgccaacttcaaacgcatccacaccaacggcctcaactacgaccacatccgtatcttctacatcaaaggccgcgaaatcaaaaccagcctagccaaacgctccgaatgggaagtcaccctaaacctcggcggctggaaaatcgccgtctacaacacaaatttccccggcaaccgcaacaaccccatacccgacgacggcctaaccctccaccgcctctccggctacctagcccgctacctcctcgaaaaaatgctcaaagtctccgaacccgaaaaacaaatcatcaaatcaaaaataataaaccccctcgcagaaaaaaacggaatcacctgggacgacggcgaagaagtctacctctccttcttcccaggctcagaaatgttcctcggcaccttccgcttctaccccctagccatcggcatatacaaagtccaacgcaaagaaatggaacccaaatacctcgaaaaaaccatgcgccaacgctacatgggcctcgaagcatcaacctggacaatctcaaaactcgccgaagtccaatccgccctaaccgtcgtctcaggcctcggctggaaaaaaaccaacgtctcagcccccgcccgcgacttcctcgcaaaattcggaatcaacatgtaa

SEQ ID NO: 8160 - RNA, 702 nt, synthetic construct
  misc_feature 1..702: note = derived and/or modified CDS sequence (opt11) from MAGV__D13783.1__N
  source 1..702: mol_type = other RNA
atgattgaactcgaattcaacgacgtagccgccaacacctcctccaccttcgaccccgaaatcgcctacgtcaacttcaaacgcatccacacaaccggcctatcctacgaccacatccgcgtcctctacatcaaaggccgagaaatcaaaacctcactcacaaaacgctccgaatgggaagtcaccctcaacctcggcggctggaaagtcgccgtcttcaacaccaacttccccggcaaccgcaactcccccgtccccgacgacggcctcaccctccaccgcctctccggcttcctagcccgttacctactagaaaaaatactaaaagtatccgaccccgaaaaactaatcatcaaaagcaaaatcatcaaccccctcgcagaaaaaaacggcatcacctgggccgacggcgaagaagtctacctctccttcttccccggctccgaaatgttcctcggcaccttcaaattctaccccctcgccataggcatctacaaagtccaaaaaaaagaaatggaaccaaagtacctcgaaaaaaccatgcgccaacgctacatgggcctcgaagcagcaacctggaccgtctccaaagtcaacgaagtacaagccgcactcaccgtagtctccggactcggctggaaaaaaaccaacgtctccgccgccgcccgcgaattcctagccaaattcggaatcaacatgtaa

SEQ ID NO: 8161 - RNA, 702 nt, synthetic construct
  misc_feature 1..702: note = derived and/or modified CDS sequence (opt11) from MAGV(7272)__KX100103.1__N
  source 1..702: mol_type = other RNA
atgatcgaactcgaattcaacgatgtcgccgccaacaccagctccaccttcgaccccgagatcgcctatgtaaacttcaaacgcatccacaccaccggccttagctacgaccacatccgagtcctctacatcaaaggccgcgaaatcaaaaccagcctcaccaaacgaagcgaatgggaagtcaccctcaacctcggcggctggaaagtagcagtcttcaacaccaacttccccggaaaccgcaacagcccagtccccgacgacggactaacactccaccgcctctccggcttcctcgcccgctacctactcgaaaaaatcctcaaagtcagcgaccccgaaaaactaatcataaaatccaagataatcaaccccctcgccgaaaaaaacggcatcacctgggccgacggcgaagaagtctacctctccttcttccccggaagcgaaatgttcctcggcaccttcaagttctaccccctcgccatcggcatctacaaagtccagcgcaaagaaatggaacccaaatacctcgaaaaaaccatgcgccaacgatacatgggcctcgaagccgcaacatggaccgtctcaaaagtcaacgaagtccaagccgccctaaccgtagtctccggcctaggctggaaaaagacaaacgtcagcgccgcagcccgagaattcctcgccaaattcggcatcaacatgtaa

SEQ ID NO: 8162 - RNA, 702 nt, synthetic construct
  misc_feature 1..702: note = derived and/or modified CDS sequence (opt11) from MAGV(3363)__KX100106.1__N
  source 1..702: mol_type = other RNA
atgatcgaactcgaattcaacgacgtcgccgccaacacctcctccaccttcgaccccgaaatcgcctacgtcaacttcaaacgcatctacaccaccggcctatcatacgaccacatccgcatattctacatcaaaggccgcgaaatcaaaacctcactcacaaaacgctccgaatgggaagtaaccctcaacctcggcggatggaaagtaaccgtattcaacaccaacttccccggcaaccgcaactcccccgtcccagacgacggcctaaccctccaccgcctctccggctacctcgcccgatacctcctagaaaaaatcctcaaagtctccgaccccgaaaaagtcatcatcaaatccaaaataatcaaccccctcgccgaaaaaaacggcataacctggtccgacggcgaagaagtctacctctccttcttccccggctccgaaatgttcctcggcaccttcaaattctaccccctcgccatcggaatctacaaagtccaaagaaaagaaatggaacccaaatacctcgaaaaaaccatgcgccaacgatacatgggcctcgaagcctccacctggaccatctccaaagtcaacgaagtccaagccgccctcacagtcgtctccggcctcggctggaaaaaaaccaacgtatccgctgccgcccgagaattcctcgccaagttcggcatcagcatgtaa

SEQ ID NO: 8163 - RNA, 702 nt, synthetic construct
  misc_feature 1..702: note = derived and/or modified CDS sequence (opt11) from NRIV(DakArY357/6e)__AY593727.1__N
  source 1..702: mol_type = other RNA
atgatcgaactagaattccacgatgtaaccgccaacacctccagcaccttcgaccccgaagtcgcctacgccaacttcaaacgcatccacaccaacggcctcaactacgactacatacgcatcttctacatcaaaggccgcgaaatcaaaacatccctcgccaaacgttccgaatgggaagtcaccctaaacctcggcggctggaagatcgccgtatacaacaccaacttccccggcaaccgcaacaaccccataccagacgacggactcacactccaccgcctctccggctacctcgcccgctacctcctcgaaaaaatgctcaaagtctccgaacccgaaaaacaaatcatcaaatccaaaatcatcaacccactcgccgaaaaaaacggaatcacctgggacgacggcgaagaagtctacctctccttcttccccggctccgaaatgttcctcggcaccttccgcttctaccccctcgccataggaatctacaaagtccaacgcaaagaaatggaaccaaaatacctagaaaaaaccatgcgccaacgctacatgggcctcgaagcctcaacctggaccatctccaaactcgccgaagtccaatccgccctaaccgtcgtctccggcctcggctggaaaaaaaccaacgtctcagcagccgcccgcgacttcctcgccaaattcggcatcaacatgtaa

SEQ ID NO: 8164 - RNA, 702 nt, synthetic construct
  misc_feature 1..702: note = derived and/or modified CDS sequence (opt11) from NORV__X73470.1__N
  source 1..702: mol_type = other RNA
atgatcgaactagaattcaacgacgtcgccgccaacacctcaagcactttcgaccccgaagtcgcctacatcaacttcaaacgcgtctacaccaccggcctctcttacgaccacatccgaatcttctacataaaaggccgcgagatcaaaacctcgctcaccaaacgctcagaatgggaagtcaccctcaacctaggcggctggaaagtcaccgtattcaacaccaacttccccggcaaccgcaactcccccgtccccgacgacggcctcaccctccaccgcctctccggcttcctcgcccgatacctcctcgaaaaaatcctaaaagtctccgaacccgaaaaactcatcatcaaatccaaaatcataaaccccctcgccgagaaaaacggcatcacctggaccgacggcgaagaagtctacctctccttcttccccggctcagaaatgttcctcggcaccttcaaattctaccccctcgccatcggcatctacaaagtccaacgcaaagaaatggaacccaaatacctagaaaaaaccatgcgacaacgctacatgggcctagaagccagcacctggacaatctccaaagtaaacgaagtccaagcagccctcaccgtcgtctccggcctcggctggaaaaaaacaaacgtctccgccgccgcacgcgaattcctagccaaattcggaatcaacatgtaa

SEQ ID NO: 8165 - RNA, 702 nt, synthetic construct
  misc_feature 1..702: note = derived and/or modified CDS sequence (opt11) from POTV(89-3380)__AY729652.1__N
  source 1..702: mol_type = other RNA
atgatcgaactagaattcaacgacgtcgccgccgacacctcctcaaccttcgaccccgaaatcgcatacgtcaacttcaaacgcatccacaccaccggcctctcatacgaccacatccgtatcttctacataaaaggccgcgaaatcaaaacctcactcaccaaacgctccgaatgggaagtcaccctcaacctcggaggctggaaaataaccgtcttcaacacaaacttccccggcaaccgaaactcccccgtccccgacgacggcctcacactccaccgcctctccggctacctcgcccgctacctcctcgaaaaaatcctaaaagtatccgaccccgaaaaagtcatcatcaaatccaaaatcatcaaccccctcgccgaaaaaaacggaatcacctggtccgacggcgaagaagtctacctctccttcttccccggctccgaaatgttcctcggcaccttcaaattctaccccctcgccatcggcatctacaaagtccagcgcaaagaaatggaaccaaaatacctagaaaaaactatgcgccaacgctacatgggcctcgaagcctccacatggaccgtctccaaagtcaacgaagtccaagccgcactcacagtcgtatcaggcctcggctggaaaaaaaccaacgtatccgccgccgcccgcgaattcctcgcaaaattcggcatctcaatgtaa

SEQ ID NO: 8166 - RNA, 702 nt, synthetic construct
  misc_feature 1..702: note = derived and/or modified CDS sequence (opt11) from SHOV(4042)__EU564831.1__N
  source 1..702: mol_type = other RNA
atgatcgaactcgaattccacgacgtagccgccaacacctcatccaccttcgaccccgaagtcgcctacgccaacttcaaacgcgtccacacaacaggcctgtcctacgaccacatccgcatcttctacatcaaaggccgcgaaatcaaaacctccctcgccaaacgaagcgaatgggaagtaacactaaacctcggcggctggaaaatcaccgtctacaacaccaacttcccaggcaaccgaaacaaccccgtccccgacgacggactcaccctacacagactatccggcttcctcgcccgctacctcctcgaaaaaatgctaaaagtatccgaacccgaaaaactcatcatcaaatccaaaatcatcaaccccctcgccgaaaaaaacggcatcacctggaccgacggcgaagaagtctacctctccttcttcccaggcgccgaaatgttcctcggcacattcaaattctaccccctcgccatcggcatctacaaagtccaacgcaaagaaatggaacccaaatacctcgaaaaaaccatgcgacaacgatacatgggactagaagcagccacatggaccgtatccaaactcaccgaagtccaagccgccctcacagtcgtatccggcctcggctggaaaaaaaccaacgtctccgccgcagcaagagacttcctcgccaaattcggcatctcaatgtaa

SEQ ID NO: 8167 - RNA, 702 nt, synthetic construct
  misc_feature 1..702: note = derived and/or modified CDS sequence (opt11) from TENV(TSV-FE3-66FB)__FJ943505.1__N
  source 1..702: mol_type = other RNA
atgatcgaactcgaattcaacgacgtcgccgccaacacaagctccaccttcgaccccgaagtcggctacgtcaacttcaaacgagtccacacaaccggcctatcctacgaccacatccgcatcttctacatcaaaggacgagaaatcaaaacctcactcaccaagcgatcagaatgggaagtcaccctcaacctcggcggatggaaagtcaccgtattcaacaccaacttcccaggcaaccgcaactcacccgtccccgatgacggactcaccctccaccgcctatcaggcttcctcgcccgctacctcctcgaaaaaatcctaaaagtctcagaccccgaaaaactaatcatcaaatccaaaataataaaccccctcgccgaaaaaaacggcatcacgtgggccgacggcgaagaagtctacctctccttcttccccggctccgaaatgttcctcggcaccttcaaattctaccccctcgccatcggcatctacaaagtccaacgcaaagaaatggaacccaaatacctcgaaaaaaccatgcgacaacgctacatgggactcgaagccgccacctggaccatatccaaagtcaacgaagtccaatcagccctcaccgtcgtctccggtctcggctggaaaaaaaccaacgtatccgccgccgcccgagaattcctcgcaaaattcggcatcaacatgtaa

SEQ ID NO: 8168 - RNA, 702 nt, synthetic construct
  misc_feature 1..702: note = derived and/or modified CDS sequence (opt11) from XINV(BeH388464)__EU564830.1__N
  source 1..702: mol_type = other RNA
atgctcgaactcgaattcaacgacgtcgccgccaacaccagctccaccttcgaccccgaagtcggctacgccaacttcaaacgcatccacaccaacggcctctcctacgacaacatacgcatcttctacatcaaaggccgagaaatcaaaacctccctcgccaaacgctccgaatgggaagtaaccctcaacctcggcggctggaaaatcaccgtctacaacaccaacttccccggcaaccgcaaccaccccatccccgacgacggcctcaccatccaccgactatccggctacctcgcccgctacctcctagaaaaaatacttaaagtatcagaccccgaaaaactcctcatcaaaaccaaaataatcaaccccctcgccgaaaaaaacggcatcacctggaacgacggcgaagaagtctacctctccttcttccccggctccgagatgttcctcggcaccttcaaattctaccccctcgccatcggaatctacaaagtccaacgcaaagaaatggaacccaaatacctcgaaaaagccatgcgacaacgctacatgggcctagagtcagccacctggacagtctccaaactcaacgaagtccaatccgccctcacagtcgtaagcggactcggctggaaaaaaaccaacgtctccgccgccgcccgcgaattcctcgccaaattcggcataaacatgtaa

SEQ ID NO: 8169 - RNA, 702 nt, synthetic construct
  misc_feature 1..702: note = derived and/or modified CDS sequence (opt11) from NRIV(9800535)__JX857328.1__N
  source 1..702: mol_type = other RNA
atgatcgaactagaattccacgacgtcgccgcaaacacatcctccacattcgaccccgaagtagcctacgccaacttcaaacgcgtccacacaaccggcctctcctacgaccacatccgcatcttctacatcaaaggccgagaaataaaaacctccctcgccaaacgctccgaatgggaagtcaccctaaacctcggaggctggaaaatcaccgtctacaacaccaacttccccggcaaccgcaacaaccccgtcccagacgacggcctcaccctccaccgcctctccggcttcctcgcccgctacctcctagaaaaaatgctcaaagtctccgaacccgaaaaactcatcatcaaatccaaaatcatcaaccccctcgccgaaaaaaacggtatcacctggaacgacggcgaagaagtctacctatccttcttccccggctccgaaatgttcctaggaaccttccgcttctaccccctcgccatcggcatctacaaagtccaacgcaaagagatggaacccaaataccttgaaaaaacaatgcgccaacgctacatgggcctcgaagccgccacctggaccgtctccaaactcacagaagtccaatccgccctcaccgtcgtatcctccctcggatggaaaaagaccaacgtctcagccgccgccagagacttcctcgcaaaattcggcatcaacatgtaa

SEQ ID NO: 8170 - RNA, 702 nt, synthetic construct
  misc_feature 1..702: note = derived and/or modified CDS sequence (opt11) from NRIV(Adrar)__KJ716848.1__N
  source 1..702: mol_type = other RNA
atgatcgaactcgaattccacgacgttgccgccaacacatcatccaccttcgaccccgaagtcgcctacgccaacttcaaacgcatctacaccaccggcctttcctacgaccacatccgaatattctacatcaaaggccgcgaaataaaaacctccctagccaaacgctccgaatgggaagtcaccctcaacctcggcggctggaaaatcaccgtctacaacaccaacttccccggcaaccgaaacaaccccgtccccgacgacggccttacactccaccgcctctcaggcttcctcgcccgctacctcctcgaaaaaatgctcaaagtatcagaacccgaaaaactcatcatcaaatccaaaatcatcaaccccctcgccgaaaaaaacggcatcacctggaacgacggcgaagaagtctacctctccttcttccccggctccgaaatgttcctcggcaccttccgcttctacccactcgccatcggcatctacaaagtccaacgcaaagaaatggagcctaaatacctcgaaaaaacaatgcgccaacgctacatgggactcgaagccgccacctggaccgtttcaaaactcaccgaagtccaatccgcactcaccgtcgtctcctcactcggctggaaaaaaaccaacgtctccgccgccgcccgcgacttcctcgccaaattcggcatcaacatgtaa

SEQ ID NO: 8171 - RNA, 702 nt, synthetic construct
  misc_feature 1..702: note = derived and/or modified CDS sequence (opt11) from NRIV(D28542/4e)__KC608154.1__N
  source 1..702: mol_type = other RNA
atgatcgaactcgaattccacgacgtcgccgccaacacctcatccaccttcgaccccgaagtcgcctacgccaacttcaaacgagtctacaccaccggcctctcctacgaccacatccgaatcttctacatcaaaggccgcgaaataaaaacctccctagccaaaagatccgaatgggaagtcaccctcaacctcggcggctggaaaatcaccgtctacaacacaaacttccccggaaaccgcaacaaccccgtccccgacgacggcctcaccctccaccgcctctcaggcttcctcgcccgctacctactcgaaaaaatgctaaaagtctccgaacccgaaaaactcatcatcaaatccaaaatcatcaaccccctcgccgaaaaaaacggcatcacatggaacgacggcgaagaagtctacctatccttcttccccggatcagaaatgttcctcggcaccttccgcttctacccactcgccatcggcatctacaaagtccaacgcaaagaaatggaaccaaaatacctcgaaaaaaccatgcgccaacgatacatgggcctcgaagccgccacctggaccgtctccaaactcaccgaagtccaatcagccctcaccgtcgtctcctccctcggctggaaaaaaaccaacgtctccgccgccgcccgcgacttcctagccaaattcggcatcaacatgtaa

SEQ ID NO: 8172 - RNA, 702 nt, synthetic construct
  misc_feature 1..702: note = derived and/or modified CDS sequence (opt11) from NRIV(SUD-HKV141)__JX857322.1__N
  source 1..702: mol_type = other RNA
atgatcgaactcgaattccacgacgtcgcagccaacacctcctcaaccttcgaccccgaagtcgcctacgccaacttcaaacgcgtccacacaaccggcctctcctacgaccacatccgcatcttctacatcaaaggccgcgaaatcaaaacctcactcgccaaacgctcagaatgggaagtcacccttaacctcggcggctggaaagtcaccgtctacaacaccaactttcccggcaaccgcaacaaccccgtccccgacgacggcctaaccctccaccgactctccggcttcctcgcccgctacctactcgaaaaaatgctcaaagtctccgaacccgaaaaactaatcatcaaatcaaaaatcatcaaccccctcgccgaaaaaaacggcatcacctggaacgacggcgaagaagtctacctctcattcttccccggctccgaaatgttcctaggcacattccgcttctaccccctcgccatcggcatctacaaagtccaacgcaaagaaatggaacccaaatacctcgaaaagaccatgcgccaacgctacatgggcctcgaagccgctacctggacagtctccaaactaactgaagtccaatccgccctcaccgtcgtctcttcactaggctggaaaaaaaccaacgtatccgccgccgcccgcgacttcctcgccaaattcggcatcaacatgtaa

SEQ ID NO: 8173 - RNA, 705 nt, synthetic construct
  misc_feature 1..705: note = derived and/or modified CDS sequence (opt11) from BWAV(M459)__NC_034480.1__N
  source 1..705: mol_type = other RNA
atgtccgacctcatcttctacgacgtcgactccgtcaacgccaacgaattcgaccccgacaccggctacctcgacttcaaaaacaactaccccggagccctcaacaccaacacagcccgcaccttcttcctcaacgccgccaaagccaaaaacgtcctccgcaacaaaccagacaaaaaagtcaacccaaaattcggaaactgggaagtcgaagtcgtcaacaaccacttccccggaaaccgtaacaaccccatcggcaaagacgacctcaccctccacagaatatccggctacctcgcccgctggatcctcgaagaatacaaacgtgacgacgaatccgaaaaagaaatcatcgaatccacagtcatcaaccccatcgcagaatccaacggcatccgctggtcagacggcgccgaaatctacctatccttcttcccaggcaccgaaatgttcctcgaacccttcaaattctaccccctagcaatcggcatctacagagtcaaacacaaaatgatggacgcccaattcctcaaaaaagccctccgccaacgctacggcaaaatgaccgccgaaaaatggatgtccaccaaggtcaaaaccatcggcgaagcagtccgaaacgtcgaaaaactcaaatggggcaaaggcggcctctccgacgccgcccgcaacttcctaaaaaaattcgacatcgccatgatctaa

SEQ ID NO: 8174 - RNA, 705 nt, synthetic construct
  misc_feature 1..705: note = derived and/or modified CDS sequence (opt11) from BWAV(M459)__EU564827.1__N
  source 1..705: mol_type = other RNA
atgtccgacctcatattctacgacgtcgactccgtaaacgccaacgaattcgacccggacaccggctacctagacttcaaaaacaactacccaggcgccctcaacacaaacaccgcccgaacattcttcctcaacgcagccaaagccaaaaacgtactcagaaacaaacccgacaaaaaagtcaaccccaaattcggaaactgggaagtcgaagtcgtcaacaaccacttccccggcaaccgaaacaaccccatcggcaaagacgacctcaccctccaccgcatctccggctacctcgcccgctggatcctagaagaatacaaacgcgacgacgaatcagaaaaagaaatcatcgaaagcaccgtcatcaaccccatcgccgaatccaacggcatccgctggtccgacggagccgaaatctacctctccttcttccccggcaccgaaatgttcctcgaacccttcaaattctaccccctcgcaatcggcatctaccgagtcaaacacaaaatgatggacgcccaattcctcaaaaaagccctccgacaacgctacggcaaaatgaccgcagaaaaatggatgtccaccaaagtcaaagcaatcggcgaagccgtacgcaacgtcgaaaaactcaaatggggaaaaggcggactcagcgacgccgccagaaacttcctaaaaaagttcgacatcgccatgatctaa

SEQ ID NO: 8175 - RNA, 705 nt, synthetic construct
  misc_feature 1..705: note = derived and/or modified CDS sequence (opt11) from BWAV(UgAr1888)__KJ867185.1__N
  source 1..705: mol_type = other RNA
atgtccgacctcatcttctacgacgtcgacagcgtcaacgcaaacgaattcgaccccgacaccggctacctcgacttcaaaaacaactaccccggcgccctcaacacaaacacagcccgaaccttcttcctaaacgccgccaaggccaaaaacgtcctccgcaacaaacccgacaaaaaagtcaaccccaaattcggcaactgggaagtcgaaatcgtaaacaaccacttccccggcaaccgcaacaaccccatcggcaaagacgacctcaccctccaccgcatctccggctacctagcccgctggatcctagaagaatacaaacgcgacgacgaatccgaaaaagaaataatcgaatcaaccgtgatcaacccaatcgccgaaagcaacggcatccgctggtccgacggcgcagaaatatacctaagcttcttcccaggcaccgaaatgttcctcgaacccttcaaattctaccccctcgccataggcatctaccgagtcaaacacaaaatgatggacgcccaattcctcaagaaagccctccgccaacgctacggcaaaatgaccgccgaaaaatggatgagcacaaaagtaaaagccatcggcgaagccgtccgcaacgtcgaaaaactcaaatggggaaaaggaggcctcagcgacgccgcccgcaacttcctaaaaaaattcgacatcgccatgatataa

SEQ ID NO: 8176 - RNA, 708 nt, synthetic construct
  misc_feature 1..708: note = derived and/or modified CDS sequence (opt11) from BWAV/PGAV(SAAr1)__EU564828.1__N
  source 1..708: mol_type = other RNA
atgtccggcgacctagtcttctacgacgtcgactcagtcaacagcaacgccttcgacccagacgccggctacgtcgccttctccaacaaccaccccggcgccctaaacatcaccaccgcccgaaccttcttcctcaacgccgccaaagccaaaggcgtcctccgaaacaaacccgacaaaaaagtcaaacccaaattcggagactgggaagtcgaaatcgtcaacaaccacttccccggcaaccgcaacaacaccatcggcgaagacgacctcacactacaccgaatctccggatacctcgccagatgggtactcgaggaacactccaaagacgacgaatccgaaaaagaactcatcgaaagcaccatcgtcaaccccatcgccgaatccaacggcataaaatggagcgacggagccgccatctacctctcattcttccccggaaccgaaatgttcctcgaacccttcaaattcttcccactcgccataggcatctaccgcgtcaaacacaaaatgatggacgcccaattcctaaaaaaagccctccgccagcgctacggcaaactaaccgccgaaaaatggatggccaccaaggtcaaatcaatcggcgaagccgtacgcgccgtcgaaaaactcaaatggggcaaaggcggcatctcagacgccgcacgcaccttcctcaagaaattcgacatcgccctaatctaa

SEQ ID NO: 8177 - RNA, 708 nt, synthetic construct
  misc_feature 1..708: note = derived and/or modified CDS sequence (opt11) from BWAV/PGAV(191B-07)__KJ867179.1__N
  source 1..708: mol_type = other RNA
atgagcggcgacctcgtattctacgacgtcgactcagtcaacagcaacgccttcgaccccgacgcaggctacgtcgcattctccaacaaccacccaggcgcactcaacatcaccaccgcccgcaccttcttcctcaacgccgccaaagccaaaggcgtcctccgaaacaaacccgacaagaaagtcaaacccaaattcggcgactgggaagtcgaaatcgtaaacaaccacttccccggcaaccgcaacaacaccatcggcgaagacgacctaaccctccaccgcatctccggatacctcgcccgatgggtcctcgaagaacacagcaaagacgacgaatccgaaaaagaactcatcgaaagcacaatcgtcaaccccatcgccgaatccaacggcataaaatggtccgacggagccgcaatctacctctcattcttcccaggcaccgaaatgttcctcgaacccttcaaattcttccccctcgccatcggaatctacagagtcaaacacaaaatgatggacgcccaattcctgaaaaaagccctccgacaacgctacggtaaactcaccgccgaaaaatggatggcaaccaaagtcaaaagcataggagaagcagtccgcgcagtcgaaaaactgaaatggggcaaaggcggcatctcagacgccgcccgcacatttctaaaaaaattcgacatcgccctcatctaa

SEQ ID NO: 8178 - RNA, 708 nt, synthetic construct
  misc_feature 1..708: note = derived and/or modified CDS sequence (opt11) from CEV(283)__KX817314.1__N
  source 1..708: mol_type = other RNA
atgtccgacctcgtcttctacgacgtcgcatccaccggcgccaacggcttcgaccccgacgccggctacgtcgacttctgcgccaaatacggcgaatcaatcaacctagccgccgtacgcatcttcttcctcaacgccgccaaagccaaagccgccctgtcccgcaaaccagaacgaaaagcaaaccccaaattcggcgaatggcaagtcgaagtcgtaaacaaccacttccccgccaacagaaacaaccccatcggcaacaacgacctaaccatccaccgcatcagcggatacctcgcccgctgggtcctcgaacaatacaaagaaaacgaagacgaatcccaacgagaactcgtcaaaaccacagtaatcaacccaatcgccgaaagcaacggcatccgctgggaaaacggcgccgaaatctacctcgccttcttccccggaaccgaaatgttcctcgaaacattcaaattctaccccctaacaatcggcatctaccgagtcaaaaacggcatgatggactcacaatacctcaaaaaagcactccgccaacgctacggctccctcaccgccgaaaaatggatgtcccaaaaaacaggcatgatcgccaaatccctcaaagaagtcgaacaactaaaatggggccgcggcggcctctcagacacagccagaaccttcctccaaaaattcggaatcaaactcccctaa

SEQ ID NO: 8179 - RNA, 708 nt, synthetic construct
  misc_feature 1..708: note = derived and/or modified CDS sequence (opt11) from CEV(BFS-283)__U12797.1__N
  source 1..708: mol_type = other RNA
atgagcgacctcgtcttctacgatgtcgcctcaaccggagccaacggcttcgaccccgacgcaggttacgtcgacttctgcgccaaacacggggaatccatcaacctcgccgccgtccgcatattcttcctcaacgccgccaaagccaaagccgccctctcccgcaaacccgaacgcaaagccaaccccaaattcggcgaatggcaagtcgaagtcgtcaacaaccacttccccgccaaccgcaacaaccccatcggaaacaacgacctcacgatccaccgcatcagcggctacctagccagatgggtcctcgaacaatacaaagaaaacgaagacgaatcccaacgcgaactcgtaaaaaccaccgtaatcaaccccatcgccgaatccaacggcatacgctgggaaaacggcgccgaaatctacctcgccttcttcccaggcaccgaaatgttcctagaaaccttcaaattctaccccctcaccatcggcatataccgcgtcaaaaacggaatgatggactcacaatacctcaaaaaagcactccgccaacgctacggaagcctcacagcagaaaaatggatgagccaaaaaaccggcatgatcgcaaaatccctcaaagaagtagaacaactcaaatggggacgcggcggcctcagcgacaccgcacgcaccttcctgcaaaaattcggaatcaaactcccctga

SEQ ID NO: 8180 - RNA, 708 nt, synthetic construct
  misc_feature 1..708: note = derived and/or modified CDS sequence (opt11) from CHATV(Mohko ILO8-3)__KF719221.1__N
  source 1..708: mol_type = other RNA
atgtccgacctcgtcttctacgacgtcgcctcaaccggcgccaatggcttcgaccccgacgaaggctacatggccttctgcgtcaaacacgcagaatcaatctccctcgcagccgtacgcatcttcttcctaaacgccgcgaaagccaaagcagcactcgccagaaaacccgaaaaaaaagcctcccccaaattcggcgaatggcaagtcgaaatcgtcaacaaccacttcccaggcaacagaaacaaccccatcggcaacaacgacctcaccgtccaccgcctctccggctacctcgcccgctgggtcctcgagcaatacaaagaaaacgaagacgaaagccaacgagaactcatcaaaacaaccgtcatcaaccccatcgccgaatccaacggcgtacgctgggactcaggccccgaaatatacctatccttcttcccaggcaccgaaatgttcctagaaaccttcaaattctaccccctcaccatcggcatataccgcgtcaaacaaggcatgatggacccacaatacctcaaaaaagccctcagacaacgatacggcaccctcaccgccgacaaatggatgtcccaaaaagtaaccgccatagccaaatccctcaaagaagtcgaacaactcaaatggggccgcggcggcctatccgacaccgcccgcaccttcctccaaaaattcggcatccgactcccataa

SEQ ID NO: 8181 - RNA, 708 nt, synthetic construct
  misc_feature 1..708: note = derived and/or modified CDS sequence (opt11) from CHATV(Mohko M07-1)__KF719224.1__N
  source 1..708: mol_type = other RNA
atgtccgacctcgtcttctacgacgtcgcctcaaccggcgccaacggcttcgaccccgacgaaggctacatggccttctgcgtaaaacacgccgaatccatcaaccttgccgccgtgcgcatcttcttcctcaacgccgccaaagccaaagcagccctggcccgcaaacccgaaaagaaagcaagccccaaattcggcgaatggcaagtcgaaatcgtcaacaaccacttccccggcaacagaaacaaccccatcggcaacaacgacctcacagtccaccgcctcagcggctacctcgcccgatgggtcctcgaacaatacaaagaaaacgaagacgaaagccaacgcgaactcatcaaaaccaccgtcataaaccccatcgccgaatcaaacggagtccgatgggactcgggccccgaaatctacctctccttcttccccggcaccgaaatgttcctagaaaccttcaaattctaccccctcaccatcggcatctaccgcgtcaaacaaggcatgatggacccccaatacctcaagaaagccctccgccaacgctacggcaccctaaccgccgacaaatggatgtcccaaaaagtcaccgcaatcgccaaatccctcaaagaagtcgaacaactcaaatggggacgcggaggcctcagcgacaccgcacgcacattcctccaaaaattcggaatacgactcccctaa

SEQ ID NO: 8182 - RNA, 708 nt, synthetic construct
  misc_feature 1..708: note = derived and/or modified CDS sequence (opt11) from CHATV(Mohko S07-2)__KF719233.1__N
  source 1..708: mol_type = other RNA
atgagcgacctcgtattctacgacgtcgcctcaaccggcgccaacggcttcgacccagacgaaggctacatggcattctgcgtaaaacacgcagaatccatcaacctcgccgccgtacgcatattcttcctcaacgccgccaaagcgaaagccgccctagccagaaaacccgaaaaaaaagccagcccaaaattcggagaatggcaagtcgaaatcgtaaacaaccacttccccgggaaccgaaacaaccccatcggcaacaacgacctcacggtccaccgcctatccggatacctcgcccgatgggtcctcgaacaatacaaagaaaacgaagacgaaagccaacgcgaactcataaaaaccaccgtaatcaacccaatcgccgaaagcaacggcgtacgatgggacagcggcccagaaatatacctcagcttcttccccggcaccgaaatgttcctcgaaacattcaaagtctaccccctgaccacaggcatctaccgagtcaaacaagggatgatggacccacaatacctcaaaaaagcgctcagacaacgctacggaaccctaaccgcggacaaatggatgagccaaaaagtgaccgccatcgccaaatccctcaaagaagtagaacaactcaaatggggacgcggaggcctcagcgacaccgcacgcaccttcctacaaaaattcggaatacgactcccataa

SEQ ID NO: 8183 - RNA, 708 nt, synthetic construct
  misc_feature 1..708: note = derived and/or modified CDS sequence (opt11) from CHATV(LEIV-11483)__FJ853592.1__N
  source 1..708: mol_type = other RNA
atgagcgacctcgtcttctacgacgtcgcatctaccggagccaacggcttcgaccccgacgaaggctacatggccttctgcgtcaaacacggccaaagcgtcaacctcgccgccgtccgcatattcttcctcaacgccgcaaaagccaaagcagccctagccagaaaacccgaaaaaaaagcctccccaaaattcggcgaatggcaagtcgaaatcgtcaacaaccacttccccggcaaccgcaacaaccccatcggcaacaacgacctcaccatccaccgcctatccggctacctagcccgctgggtcctcgaacaatacaaagaaaacgaagacgaaagccaacgcgaactcataaaaacaaccgtcataaaccccatagcagaatccaacggcgtacgctgggactcaggcgccgaaatatacctctccttcttccccggcacagaaatgttcctagaaacattcaaattctaccccctcaccatcggcatctacagagtcaaacaaggcatgatggacccccaatacctaaaaaaagccctcagacaacgctacggcaccctcaccgccgacaaatggatgtcccaaaaagtaaccgccatagccaaatccctaaaagaagtcgaacagctcaaatggggccgaggcggcctcagcgacaccgcccgcaccttcctccaaaaattcggaatccgactcccataa

SEQ ID NO: 8184 - RNA, 708 nt, synthetic construct
  misc_feature 1..708: note = derived and/or modified CDS sequence (opt11) from CHATV(LEIV-11552)__EU479702.1__N
  source 1..708: mol_type = other RNA
atgtccgacctcgtcttctacgacgtcgcctccaccggagccaacggcttcgaccccgacgaaggctacatggccttctgcgtcaaacacggccaatccgtcaacctcgccgccgtaagaatcttcttcctcaacgccgccaaagcaaaagccgcactcgcccgaaaacccgaaaaaaaagcctcccccaaattcggcgaatggcaagtcgaaatagtcaacaaccacttccccggcaacagaaacaaccccataggcaacaacgacctcaccatccaccgcctcagcggctacctggcccgctggatcctcgaacaatacaaagaaaacgaagacgaatcccaacgcgaactcatcaaaaccaccgtaatcaaccccatcgccgaatccaacggcgtacgatgggactcaggcgccgaaatctacctgtccttcttcccaggaaccgaaatgttcctcgaaaccttcaaattctaccccctcaccatcggcatctaccgcgtcaaacaaggcatgatggacccccaatacctcaaaaaagccctccgccaacgatacggcaccctcaccgccgacaaatggatgtcccaaaaagtcaccgccatcgccaaatccctcaaagaagtcgaacagctaaaatggggacgcggaggactctccgacaccgcccgcaccttcctccaaaagttcggcataagactcccataa

SEQ ID NO: 8185 - RNA, 708 nt, synthetic construct
  misc_feature 1..708: note = derived and/or modified CDS sequence (opt11) from CHATV(LEIV-13107)__FJ946829.1__N
  source 1..708: mol_type = other RNA
atgagcgacctcgtgttctacgacgtggcctcgaccggggccaacggcttcgacccggacgagggctacatggcgttctgcgtcaagcacgggcaatcagtcaacctcgcggccgtgcgcatattcttcctcaacgccgccaaagcgaaagcggccctagccaggaaaccggaaaagaaagcgaacccgaaattcggagaatggcaggtcgagatcgtgaacaaccacttcccagggaacaggaacaaccccataggcaacaacgacctcacaatccaccgcttaagcggatacctggcccggtgggtgctagagcaatacaaagagaacgaggacgagagccagcgagagctcataaaaacaaccgtgatcaaccccatagccgagagcaacggcgtacgctgggactcgggagcagaagtgtacctgagcttcttcccgggcacagaaatgttcctagaaacgttcaagttctaccccctaaccataggcatatacagagtcaagcaagggatgatggacccgcaatacctcaagaaagcactcaggcaacggtacgggaccctgaccgcggacaagtggatgagccagaaagtgaccgcgatcgcgaaatcactcaaggaagtagaacagctcaagtgggggcgcgggggcctgagcgacaccgcgcgcacgttcctgcaaaagttcgggatcagactcccgtga

SEQ ID NO: 8186 - RNA, 708 nt, synthetic construct
  misc_feature 1..708: note = derived and/or modified CDS sequence (opt11) from CHATV(LEIV-17794)__FJ913879.1__N
  source 1..708: mol_type = other RNA
atgagcgacctcgtattctacgacgtagcctcaaccggcgccaacggcttcgacccggacgaaggttacatggcgttctgcgtcaagcacggacaatcggtaaacctcgcagccgtccgcatattcttcctcaacgccgcaaaagcgaaagcggccctggccaggaaaccggaacggaaagcaagcccgaaattcggcgagtggcaagtagagatcgtgaacaaccacttccccgggaacaggaacaacccaataggcaacaacgacctcacgatccaccgcctaagcggatacctggccaggtgggtgctcgagcaatacaaagaaaacgaagacgagagccaacgcgagctcataaaaacaaccgtaatcaaccccatagccgagagcaacggcgtgcgctgggactcgggcgcagaaatatacctgagcttcttcccaggcacggaaatgttcctagaaacgttcaaattctaccccctgaccataggcatatacagggtcaaacaaggaatgatggacccacaatacctcaagaaagcgctcagacaaagatacgggaccctaaccgcagacaaatggatgagccagaaagtgaccgcgatcgcaaaatcactcaaagaagtggaacagctcaagtgggggcgaggaggcctaagcgacacagcgcgaacattcctgcaaaagttcgggatcagacttccgtga

SEQ ID NO: 8187 - RNA, 708 nt, synthetic construct
  misc_feature 1..708: note = derived and/or modified CDS sequence (opt11) from CHATV(LEIV-17827)__GQ330475.1__N
  source 1..708: mol_type = other RNA
atgagcgacctagtcttctacgacgtagcctcaaccggagccaacggcttcgacccagacgaaggctacatggccttctgcgtcaaatacggggaatcaatcaacctagccgccgtacgcatattcttcctcaacgccgcaaaagcaaaagcagccctagcccgcaaaccggaaaaaaaagccaaccccaaattcggcgaatggcaagtcgaaatcgtcaacaaccacttccccgggaacaggaacaaccccatcggcaacaacgacctcaccatacaccgcctcagcggctacctagccagatgggtactcgaacaatacaaagaaaacgaagacgaaagccaacgcgaactaatcaaaaccaccatcatcaaccccatcgccgagagcaacggcgtacgatgggaatcaggcgccgaagtctacctaagcttcttcccaggcacagaaatgttcctcgaaattttcaaattctaccccctcaccatcggcatctaccgcgtcaaacaaggcatgatggacccacaatacctcaaaaaagcactccgacaaagatacggcaccctaaccgccgacaaatggatgagccaaaaagtaaccgcaatcgccaaatcactaaaagaagtcgaacaactcaaatggggccgcggaggcctaagcgacaccgcccgcactttcctacaaaaattcggcatcaggctcccctga

SEQ ID NO: 8188 - RNA, 708 nt, synthetic construct
  misc_feature 1..708: note = derived and/or modified CDS sequence (opt11) from CHATV(LEIV-17829)__GQ330476.1__N
  source 1..708: mol_type = other RNA
atgagcgacctcgtattctacgacgtagcctccaccggcgccaacggcttcgacccagacgagggctacatggccttctgcgtcaaatacggcgaatcaatcaacctcgcagccgtacgcatcttcttcctcaacgccgcaaaagccaaagcagccctagccagaaaacccgaaaaaaaagccaacccaaaattcggcgaatggcaagtagaaatcgtcaacaaccacttccccggaaacagaaacaaccccatcggaaacaacgacctcacgatccaccgcctaagcggctacctggcccgatgggtactcgaacaatacaaagaaaacgaagacgaaagccaacgagaactcataaaaacaaccatcatcaaccccatagccgaaagcaacggcgtacgctgggactccggcgcagaagtctacctaagcttcttcccaggcacggaaatgttcctcgaaatcttcaaattctaccccctaaccatcggcatatacagagtcaaacaagggatgatggacccacaatacctcaaaaaagccctcagacaaagatacgggaccctaaccgccgacaaatggatgagccaaaaagtcaccgcaatcgcaaaatccctcaaagaagtagaacaactcaaatgggggcgcggaggcctgagcgacaccgcacgcaccttccttcaaaaattcggaatccgcctaccctaa

SEQ ID NO: 8189 - RNA, 708 nt, synthetic construct
  misc_feature 1..708: note = derived and/or modified CDS sequence (opt11) from CHATV(LEIV-18733)__HQ734824.1__N
  source 1..708: mol_type = other RNA
atgagcgacctcgtgttctacgacgtggcctcaaccggggccaacggcttcgacccagacgaaggctacatggcgttctgcgtcaaatacggggaatcaatcaacctcgcggccgtacgcatattcttcctcaacgccgcaaaagcgaaagcggccctggccaggaaaccggaaaagaaagcgaacccgaaattcggcgagtggcaggtcgagatcataaacaaccacttccccggaaacaggaacaaccccataggcaacaacgacctcacgatccaccgcttgagcgggtacctagccaggtgggtactcgaacaatacaaagagaacgaggacgaaagccagcgcgagctcataaaaacaacaataataaaccccatagccgagagcaacggcgtgcgctgggactcgggcgcggaagtgtacctgagcttcttcccgggcacggaaatgttcctagaaatattcaagttctacccactgaccataggcatatacagggtcaaacaagggatgatggacccacaatacctaaagaaagcgctcaggcaaagatacgggaccctgaccgcggacaagtggatgagccagaaagtaacagcgatcgcgaaatcactcaaggaagtagaacagctcaagtgggggcgcgggggcctgagcgacaccgcgcgcacgttcctgcaaaagttcgggatcaggctcccgtga

SEQ ID NO: 8190 - RNA, 708 nt, synthetic construct
  misc_feature 1..708: note = derived and/or modified CDS sequence (opt11) from CHATV(LEIV-18895)__GQ330482.1__N
  source 1..708: mol_type = other RNA
atgagcgacctcgtcttctacgacgtagcctccaccggagccaacggcttcgaccccgacgaaggctacatggccttctgcgtcaagtacggcgaatccatcaacctcgccgccgtacgcatcttcttcctaaacgccgcaaaagcaaaagcagcactagcccgcaaacccgaacgaaaagccaaccccaaattcggcgaatggcaagtcgaaatcgtcaacaaccacttcccaggcaaccgcaacaaccccatcggcaacaacgacctaaccatccaccgactctccggctacctagcccgatgggtcctagaacaatacaaagaaaacgaagacgaatcccaacgagaactcatcaaaaccaccatcatcaaccccatcgccgaatccaacggcgtccgctgggactcaggcgccgaagtctacctcagcttcttccccggcacagaaatgttcctagaaatcttcaaattctaccccctaacaatcggcatctaccgagtcaaacaaggcctcatggacccccaatacctcaagaaagcactccgacaacgatacggcacactcaccgccgacaaatggatgagccaaaaagtaaccgccatcgccaaatcactcaaagaagtagaacaactaaaatggggccgcggcggcctaagcgacaccgcacgcaccttcctacaaaaattcggaatccgcctcccctga

SEQ ID NO: 8191 - RNA, 708 nt, synthetic construct
  misc_feature 1..708: note = derived and/or modified CDS sequence (opt11) from CHATV(LEIV-22712)__HQ734825.1__N
  source 1..708: mol_type = other RNA
atgagcgacctagtattctacgacgtggcctcgaccggggccaacggattcgacccggacgagggctacatggcattctgcgtcaagcacggggaatcgatcaacctagcagccgtccgcatattcttcctaaacgccgcgaaagcgaaagcggccctggccaggaagccggaaaagaaagcaagcccgaaattcggcgagtggcaggtcgagatcataaacaaccacttccccgggaaccggaacaaccccataggcaacaacgatctcacaatccaccgcctgagcgggtacctggccagatgggtactcgagcaatacaaagagaacgaggacgagagccagcgcgagctcataaaaacgacagtgatcaaccccatagccgagagcaacggcgtgcgctgggactcgggagcggaaatatacctgagtttcttcccgggtacggaaatgttcctggaaacattcaagttctaccccctgaccataggcatatacagagtcaagcaagggatgatggacccacaatacctcaagaaagcgctcaggcaaagatacgggaccctaaccgcggacaagtggatgagccagaaagtgaccgcgatcgcaaaatcgctaaaggaagtggaacagctaaagtggggacgagggggcctgagcgacaccgcacgcacgttcctgcaaaaattcgggatcagactcccctga

SEQ ID NO: 8192 - RNA, 708 nt, synthetic construct
  misc_feature 1..708: note = derived and/or modified CDS sequence (opt11) from CHATV(LEIV-23500)__EU479701.1__N
  source 1..708: mol_type = other RNA
atgagcgacctcgtcttctacgacgtcgcctccaccggcgccaacggcttcgaccccgacgcgggctacatggccttctgcgtcaaacacggagaatcaatcaacctcgccgccgtacgcatattcttcctaaacgccgcaaaagcaaaagccgcactcgcccgaaaacccgaaaaaaaagcaaacccaaaattcggcgaatggcaagtcgaaatcgtcaacaaccacttccccggaaaccgaaacaaccccatcggcaacaacgacctcacgatccaccgcctaagcggatacctagcccgatgggtcctagaacaatacaaagaaaacgaagacgagagccaacgcgaactcatcaaaaccaccgtcatcaaccccatcgccgaaagcaacggcgtccgatgggaaaacggcgccgaagtctacctcagcttcttcccaggcacagaaatgttcctcgaaaccttcaaattctaccccctaacaataggcatataccgcgtcaaacaaggaatgatggacccacaatacctcaaaaaagcactcagacaacgatacggaaccctcaccgcagacaaatggatgagccaaaaagtaacagccatcgccaaatccctaaaagaagtagaacaactcaaatggggccgcggaggactaagcgacaccgcccgcacattcctacaaaaattcgggatccgactcccctaa

SEQ ID NO: 8193 - RNA, 708 nt, synthetic construct
  misc_feature 1..708: note = derived and/or modified CDS sequence (opt11) from INKV__Z68496.1__N
  source 1..708: mol_type = other RNA
atgggcgacctcgtattctacgacgaagcctccaccggcgccaacggattcgacccagacgcaggcttcgtcgccttcatggcagaccacggcgaatctatcaacctcgccgccgtccgcatcttcttcctcaacgccgccaaagccaaagccgccctcgcccgcaaacccgaaagaaaagccacccccaaattcggcgaatggcaagtcgaaatcgtcaacaaccacttccccggcaaccgcaacaaccctatcggcaacaacgacctaaccatccaccgcctctccggctacctcgcccgctgggtcctcgaacacttcaccgaagacgacgacgaatcccaaagagaactcatccgctccaccatcatcaacccaatagccgaatccaacggtatccactggaacaacggccccgaaatatacctatccttcttccccggcaccgaaatgttcctcgaagtcttcaaattctaccccctcacaatcggcatctaccgcgtcaaacacggcatgatggacccccaatacctcaaaaaagccctacgccaaagatacggaaccctcaccgccgaaaaatggatggcccaaaaaaccgtcctcatcgcaaaatccctcaaagacgtcgaacaactcaaatggggccgcggcggcctcagcgacgccgcccgcacattcctcatcaaattcggcgtcaaactcccctaa

SEQ ID NO: 8194 - RNA, 708 nt, synthetic construct
  misc_feature 1..708: note = derived and/or modified CDS sequence (opt11) from INKV(KN3641)__U47137.1__N
  source 1..708: mol_type = other RNA
atgggcgacctcgtcttctacgacgtcgcaagcaccggcgcaaacggtttcgacccagacgctggcttcgtcgccttcatggccgaccacggcgaatccataaacctcgcagccgtccgcatattcttcctaaacgccgccaaagccaaagccgccctcgcccgcaaacccgaacgaaaagccaccccaaaattcggcgaatggcaagtcgaaatcgtaaacaaccacttccccggcaaccgaaacaaccccatcggcaacaatgacctcaccatccaccgcctctccggctacctcgcccgctgggtcctcgaacacttcacggaagacgacgacgaatcccaacgcgagctcatccgctcaaccatcatcaacccaatcgccgaatccaacggcatccactggaacaacggccccgaaatctatctatccttcttccccggcaccgaaatgttcctcgaagtcttcaaattctaccccctcaccatcggcatctaccgagtcaaacacggcatgatggacccccaatacctaaaaaaagcactccgccaacgctacggcaccctcaccgccgaaaaatggatggcccaaaaaaccgtcctcatcgccaaatccctcaaagacgtcgaacaactaaaatggggccgaggcggcctctccgacgcagcccgcaccttcctcatcaaattcggagtcaaactcccctaa

SEQ ID NO: 8195 - RNA, 708 nt, synthetic construct
  misc_feature 1..708: note = derived and/or modified CDS sequence (opt11) from INKV(Lovanger)__KU302751.1__N
  source 1..708: mol_type = other RNA
atgggcgacctcgtcttctacgacgtcgcctcaacaggcgccaacggcttcgaccccgacgccggattcgtcgccttcatggccgaccacggcgaatccatcaacctcgccgccgtccgcatcttcttcctaaacgccgccaaagccaaagccgccctagcccgcaaacccgaacgcaaagcaaccccaaaattcggcgaatggcaagtcgaaatcgtcaacaaccacttccccggtaaccgaaacaaccccatcggcaacaacgacctcaccatccaccgcctctccggatacctcgcccgctgggtcctagaacacttcaccgaagacgacgacgaaagccaacgagaactcatccgatccaccatcatcaacccaatcgccgaatcaaacggcatccactggaacaacggccccgaaatctacctctccttcttcccaggaaccgaaatgttcctcgaagtcttcaaattctaccccctcaccataggcatctaccgtgtcaaacacggcatgatggacccccaatacctaaaaaaagccctccgacaacgctacggcaccctaaccgccgaaaaatggatgacccaaaaaaccgtcctcatcgccaaatccctaaaagacgtcgaacaactcaaatggggccgaggaggcctatcagacgccgcccgcacattcctcatcaaattcggcgtcaaactaccctga

SEQ ID NO: 8196 - RNA, 708 nt, synthetic construct
  misc_feature 1..708: note = derived and/or modified CDS sequence (opt11) from INKV(SW AR 83-161)__U47138.1__N
  source 1..708: mol_type = other RNA
atgggtgacctcgtcttctacgacgtcgcctccacaggagccaacggcttcgaccccgacgccggcttcgtcgcattcatggccgaccacggagaatcaatcaacctcgccgccgtacgcatcttcttcctcaacgccgcaaaagccaaagccgcactcgcccgaaaacccgaacgcaaagccacccccaaattcggcgaatggcaagtcgaaatcgtcaacaaccacttccccggaaaccgaaacaaccccatcggcaacaacgacctcaccatccacagactctccggatacctggcccgctgggtactcgaacacttcaccgaagacgacgacgaatcccaacgagaactcatccgctccaccatcatcaaccccatcgccgaatccaacggcatccactggaacaacggcccagaaatatacctctcattcctcccaggcaccgaaatgttcctagaagtcttcaaattctaccccctcaccatcggcatctaccgcgtcaaacacggcatgatggacccccaatacctaaaaaaagccctccgccaacgatacggcaccctcaccgccgaaaaatggatggcccaaaaaaccgtcctcatcgccaaatccctcaaagacgtcgaacaactcaaatggggacgcggcggcctatcagacgccgcccgcacattcctcataaaattcggcgtcaaactcccctaa

SEQ ID NO: 8197 - RNA, 708 nt, synthetic construct
  misc_feature 1..708: note = derived and/or modified CDS sequence (opt11) from LUMV__X73468.1__N
  source 1..708: mol_type = other RNA
atgtccgacctcgtcttctacgacgtcgcatccaccggcgccaacggcttcgaccccgacgccggctacgtcgacttctgcgtcaaacacggcgaatccatcaacctccactccgtccgcatcttcttcctcaacgccgccaaagccaaagccgccctagcccgaaaacccgaacgcaaagcctcacccaaattcggcgaatggcaagtcgaaatcgtcaacaaccacttcccaggcaaccgcaacaaccccatcgacaacaacgacctcaccatccaccgcctctccggatacctagcccgctgggtcctagaacaattcaaagaaaacgaagacgccgcccaacgcgaactcatcaaaaccacagtcatcaaccccatcgccgaatcaaacggcatacgctgggacaacggcgcagaaatctacctcgccttcttccccggcacagaaatgttcctcgaaaccttcaacttctatcccctcaccatcggcatctacagagtcaaacacggcatgatggacccacaatacctcaaaaaagccctcagacgccgatacggcagcctcaccgcagacaaatggatgtcccaaaaaaccgtcgccatcgccaaatccctcaaagacgtagaacaactcaaatggggccgtggcggcctctccgacacagcccgcgtcttcctacaaaaattcggcatcaaactcccctaa

SEQ ID NO: 8198 - RNA, 708 nt, synthetic construct
  misc_feature 1..708: note = derived and/or modified CDS sequence (opt11) from LUMV(SAAr 1881)__KX817326.1__N
  source 1..708: mol_type = other RNA
atgtccgacctcgtcttctacgacgtcgcctcaaccggagccaacggcttcgaccccgacgccggctacgtcgacttctgcgtcaaacacggagaatccatcaacctccactccgtccgcatattcttcctcaacgccgccaaagccaaagccgcactcgcccgcaaacccgaacgcaaagcctcacccaaattcggcgaatggcaagtcgaaatcgtcaacaaccacttccccggcaaccgcaacaaccccatcgacaacaacgacctcacaatccaccgactgtccggctacctcgcccgctgggtgctagaacaattcaaagaaaacgaagacgccgcccaacgcgaactcataaaaaccaccgtcatcaaccccatcgcagaatccaacggaatccgctgggacaacggcgccgaaatctacctcgccttcttccccggcaccgaaatgttcctcgaaaccttcaacttctaccccctcaccatcggcatctaccgagtcaaacacggcatgatggacccccaatacctcaaaaaagccctccgacaacgctacggcagcctcaccgccgacaaatggatgtcccaaaaaaccgtcgccatcgcaaaaagcctcaaagacgtcgaacaactcaaatggggccgaggcggcctctccgacaccgcacgcgtcttcctccaaaaattcggcatcaaactcccataa

SEQ ID NO: 8199 - RNA, 708 nt, synthetic construct
  misc_feature 1..708: note = derived and/or modified CDS sequence (opt11) from MELV(TRVL 9375)__KX817329.1__N
  source 1..708: mol_type = other RNA
atgggcgacctcatcttctacgacgtcgcctcaaccggcgccaacggcttcgaccccgacgcaggctacctcgccttcaccatagcccacggcgaagccatcaacctctcagccgtccgcatattcttcctcaacgcagccaaagcaaaagccgcactatcccgaaaacccgagcgcaaagcaacccccaaattcggcgactggcaagtcgaaatcgtcaacaaccacttcccaggcaaccgcaacaaccccatcggcaacaacgacctcaccatacaccgcctctccggctacctcgcccgctgggtcctcgacctcttcaaagaaaacgaagacgaatcccaaaaagaactcatccaatccaccatcatcaaccccatagccgaatccaacggcatccactgggcaaacggcgtcgaaatctacctctccttcttccccggcaccgaaatgttcctcgaagccttccgattctaccccctcaccatcggcatctaccgggtcaaacacggcctcatggacccccaatacctcaaaaaagccctaagacaacgctacggcaccctcaccgccgacaaatggatggcccaaaaaaccaccatgatcgccaaatccctaaaagacgtcgaacaactcaaatggggcaaaggcggcctatccgacgccgcccgaaccttcctccaaaaattcggcgtccgactaccctaa

SEQ ID NO: 8200 - RNA, 708 nt, synthetic construct
  misc_feature 1..708: note = derived and/or modified CDS sequence (opt11) from MBV__U31989.1__N
  source 1..708: mol_type = other RNA
atgagcgacctcgtcttctacgacgtcgcatcaaccggcgccaacggcttcgaccccgacgccggctacgtcgacttctgcgccaaacacggcgaatcaatcaacctcgccgccgtccgcatcttcttcctcaacgccgcaaaagccaaagccgccctctcccgcaaacccgaacgcaaagcaaacccaaaattcggcgaatggcaagtcgaaatcgtcaacaaccacttccccgccaaccgaaataaccccataggaaacaacgacctcacaatccaccgcatctccggatacctagcccgctgggtcctcgaacaataccgagaaaacgaagacgaaagccaacgagaactcgtcaaaaccaccgtcataaaccccatcgccgaatccaacggcatccgctgggaaaacggccccgaaatctacctcgccttcttcccaggcacagaaatgttcctagaaaccttcaaattctaccccctcaccataggcatataccgagtaaaacacggcatgatggacccccagtacctcaagaaagccctccgccaacgctacggcagcctaaccgccgaaaaatggatgtcccagaaaacaggcatgatcgccaaatccctcaaagaagtagaacaactcaaatgggggcgcggaggactaagcgacaccgcccgaaccttcctccaaaaattcggaatccgcctcccataa

SEQ ID NO: 8201 - RNA, 708 nt, synthetic construct
  misc_feature 1..708: note = derived and/or modified CDS sequence (opt11) from SAV(VR723)__U47139.1__N
  source 1..708: mol_type = other RNA
atgtccgaactcgtattctacgacgtcgcctccaccggcgccaatggcttcgacccagacgccggctacctcgccttctgcgtcaaacacggcgaatccatctccctctcctcagtccgcatcttcttcctcaacgccgccaaagccaaagccgccctctcccgcaaaccagaacgaaaagccaaccccaaattcggagaatggcaagtcgaaatcgtcaacaaccacttccccggaaaccgcaacaaccccatagacaacctagacctcaccatccaccgcctctccggctacctagcccgatgggtcctcgaacaattcatcgagaacgaagacgaatcccaacgagaacttataaaaacaaccgtaatcaaccccatagccgagagcaacggcatcaaatgggaaaacggcgccgaaatctacctctccttcttcccaggcaccgaaatgttcctagaaatcttcaaattctaccccctgaccatcggcatctaccgcgtcaaacaaggcatgatggacccacaatacctcaagaaagccctccgccaacgctacggatcactcaccgccgacaaatggatgtcccaaaaagtcggcgccatagccaaatccctcaaagacatcgaacaactcaaatggggcaaaggaggcctctccgacaccgcccgcaccttcctccaaaaattcggcatcaaactcccataa

SEQ ID NO: 8202 - RNA, 708 nt, synthetic construct
  misc_feature 1..708: note = derived and/or modified CDS sequence (opt11) from SDNV(BeAr 103645)__U47140.1__N
  source 1..708: mol_type = other RNA
atgggcgacctcgtattctacgacgtcgcatcaacaggagccaacggcttcgaccccgacgccggcttcgtcgccttcatggccggacacggcgaatccatcaacctcaccgccgtccgaatcttcttcctcaacgccgccaaagccaaagccgccctcagccgcaaaccagaacgaaaagccacccccaaattcggcgactggcaagtcgagatcgtcaacaaccacttccccggcaaccgaaacaacccaatcggcaacaacgacctcacgatccaccgcatctcaggctacctcgcccgctggaccctcgagcacttccgagaaggcggagacgaagcccaaaaagaactcatccgcaccaccatcatcaaccccatcgcagaaagcaacggcatccactgggccaacggcgccgaaatctacctctccttcttccccggcacagaaatgttcctcgaagccttcaaattctaccccctaaccatcggcatataccgcgtcaaacacggaatgatggacgcccaatacctaaaaaaagccctccgccaaagatacggcacccttaccgccgacgaatggatggcccaaaaaaccgtactaatcaccaaatccctcaaagacgtagaacaactcaaatggggccgcggcggcctctccgacgccgcccgcaccttcctctccaaattcggagtcaaactcccatga

SEQ ID NO: 8203 - RNA, 708 nt, synthetic construct
  misc_feature 1..708: note = derived and/or modified CDS sequence (opt11) from SDNV(BeAr 103645)__KX817335.1__N
  source 1..708: mol_type = other RNA
atgggcgacctcgtcttctacgacgtcgcctccaccggcgccaacggcttcgaccccgacgcaggcttcgtcgcattcatggccggccacggcgaatcaatcaacctcaccgccgtccgcatcttcttcctcaacgccgccaaagccaaagccgccctctcacgcaaacccgaacgcaaagcaacccccaaattcggcgactggcaagtcgaaatcgtcaacaaccacttccccggaaaccgcaacaaccccatcggcaacaacgacctcaccatccaccgaatctccggctacctagcccgctggacactagaacacttccgcgaaggcgaagacgaagcccaaaaagaactcatccgcacgaccatcatcaaccccatcgccgaatccaacggcatccactgggccaacggcgcagaaatctacctctcattcttccccggcaccgaaatgttcctcgaagccttcaaattctaccctctcaccatcggcatctaccgagtcaaacacggaatgatggacgcacaatacctcaaaaaagccctacgccaacgctacggcaccctcaccgccgacaaatggatggcccaaaaaaccgtcctcatcaccaaatcactcaaagacgtcgaacaactcaaatggggccgaggcggcctctccgacgccgccagaaccttcctctccaaattcggcgtcaaactcccctaa

SEQ ID NO: 8204 - RNA, 708 nt, synthetic construct
  misc_feature 1..708: note = derived and/or modified CDS sequence (opt11) from SSHV__EU294510.1__N
  source 1..708: mol_type = other RNA
atgagcgacctagtgttctacgacgtggcctcgaccggggccaacggcttcgaccccgacgcgggctacatggcgttctgcgtcaaatacgcggaatcggtcaacctcgcggccgtgcgcatattcttcctcaacgccgcaaaagcgaaagcggcactaagcaggaaaccggaaagaaaagcgaacccgaaattcggcgagtggcaggtcgaagtcgtgaacaaccacttccccgggaacagaaacaaccccataaactcagacgacctcacgatccaccgcctgagcgggtacctggccagatgggtgctcgagcaatacaaagagaacgaggacgagagcaggcgcgagctcataaaaacgaccataatcaatcccatagccgaaagcaacggcgtacgctgggactcaggcgcggaaatatacctgagcttcttcccgggcacagaaatgttcttagaaacgttcaaattctaccccctgaccataggcatatacagggtcaaacaaggaatgatggacccgcaatacctcaagaaagcgctcaggcaaaggtacgggagcttaaccgcagacaaatggatgagccagaaagtgaccgcgatcgcaaaatcgctcaaggaagtagaacagctaaagtgggggcgcgggggcctgagcgacaccgcgcgatcgttcctgcaaaagttcgggatcaggctaccgtga

SEQ ID NO: 8205 - RNA, 708 nt, synthetic construct
  misc_feature 1..708: note = derived and/or modified CDS sequence (opt11) from SSHV(F10838)__KM215563.1__N
  source 1..708: mol_type = other RNA
atgagcgacctcgtgttctacgacgtagcctcaaccggggccaacggcttcgacccggacgcgggctacatggcgttctgcgtcaagtacgcggaatcggtcaacctcgcggccgtgcgcatattcttcctcaacgccgcaaaagcgaaagcggccctgagcagaaaaccggaaaggaaagcaaacccgaaattcggcgaatggcaggtcgaggtcgtgaacaaccacttccccgggaacagaaacaaccccataaactcagacgacctcacgatacaccgcctaagcgggtacctagccaggtgggtactcgagcaatacaaagaaaacgaggacgagagcaggcgcgagctcataaaaacgaccataatcaaccccatcgccgagagcaacggcgtgagatgggactcgggcgcggaaatatacctgagcttcttcccaggcacggaaatgttcctagaaacgttcaagttctaccccctaaccataggcatatacagggtcaagcaaggaatgatggacccgcaatacctcaagaaagcgctcaggcaaagatacggaagcctgaccgcggacaagtggatgagccaaaaagtgaccgcaatcgcgaaatcgctcaaggaagtggaacagctcaagtggggacgcggaggcctaagcgacaccgcgcgatcgctcctacaaaaattcgggatcaggctcccatga

SEQ ID NO: 8206 - RNA, 708 nt, synthetic construct
  misc_feature 1..708: note = derived and/or modified CDS sequence (opt11) from SORV(SORV-252)__GU018050.2__N
  source 1..708: mol_type = other RNA
atgggcgaccttgtattctacgacgtcgcctccaccggcgccaacggcttcgaccccgacgcaggcttcgtcgccttcatggcagaccacggcgaatccatttccctctcagccgtccgcatattcttcctcaacgccgccaaagccaaagccgcactcgcccgaaaacccgaacgcaaagcaaaccccaaattcggagaatggcaagtcgaaatcgtaaacaaccacttccccggcaaccgcaacaaccccataggcaacaacgacctcaccatccaccgcctctccggctacctcgcccgctgggtcctcgaacacttcaccgaagacgaagacgaatcccaacgcgaactaatacgctccaccatcatcaacccaatcgccgaatccaacggcatccgctggaacaacggcccagaaatctacctctccttcttccccggcaccgaaatgttcctagaagccttcaaattctaccccctcaccatcggcatctaccgcgtcaaacacggactcatggacccccaatacctcaaaaaagccctacgccaaagatacggcaccctcaccgccgaaaaatggatggcccaaaaaaccgtcctgatcgccaaatccctaaaagacgtcgaacaactcaaatggggccgcggaggcctctccgacgccgcccgcaccttcctaataaaattcggagtcaaactcccctaa

SEQ ID NO: 8207 - RNA, 708 nt, synthetic construct
  misc_feature 1..708: note = derived and/or modified CDS sequence (opt11) from SORV(NJO 94F)__U47141.1__N
  source 1..708: mol_type = other RNA
atgggcgacctagtattctacgacgtagcatcaaccggagccaacggcttcgaccccgacgccggcttcgtagccttcatggccgaccacggcgaatcaatcaacctcagcgcagtccgcatcttcttcctcaacgcagccaaagccaaagccgccctcgcccgcaaaccagaacgaaaagccaacccaaaattcggcgaatggcaagtcgaaatcgtcaacaaccacttccccggcaaccgcaacaacccaatcggaaacaacgacctcaccatccaccgcctctccggctacctcgcacgctgggtcctagaacacttcaccgaagacgaagacgaatcccaacgcgaactcatccgcagcaccatcataaaccccatcgccgaatccaacggcatccactggaacaacggccccgaaatctacctcagcttcttccccggcaccgaaatgttcctcgaagccttcaaattctaccccctaaccatcggcatctaccgcgtcaaacacggaatgatggacccacaatacctcaaaaaagcactacgacaacgatacggcaccctcaccgccgaaaaatggatggcccaaaaaaccgtcctaatcgccaaatcactcaaagacgtcgaacaactcaaatggggacgcggaggcctatccgacgccgcccgcacattcctaatcaaattcggagtcaaactcccctaa

SEQ ID NO: 8208 - RNA, 708 nt, synthetic construct
  misc_feature 1..708: note = derived and/or modified CDS sequence (opt11) from SORV(NJO-94F)__KX817338.1__N
  source 1..708: mol_type = other RNA
atgggcgacctcgtcttctacgacgtcgcctcaaccggcgcgaacggcttcgaccccgacgccggcttcgtcgcattcatggccgaccacggcgaatccatcaacctctccgcagtccgcatcttcttcctcaacgccgccaaagccaaagccgccctcgcccgcaaacccgaacgcaaagccaaccccaaattcggcgaatggcaagtcgaaatcgtaaacaaccacttccccggcaaccgcaacaaccccatcggcaacaacgacctcacaatccaccgactctccggctacctagcccgatgggtactcgagcacttcaccgaagacgaagacgaaagccaacgcgaactaatcagatccaccatcatcaacccaatcgctgaatccaacggcatccactggaacaacggccccgaaatctacctatcattcttccccggcaccgaaatgttcctcgaagccttcaaattctaccccctaaccatcggcatctaccgcgtcaaacacggcctcatggacccacaatacctcaaaaaagccctccgacaacgctacggaaccctaacagccgaaaaatggatggcacaaaaaaccgtcctaatcgccaaatccctcaaagacgtcgaacaactaaaatggggccgaggcggcctatccgacgccgcccgcaccttcctcataaaattcggcgtcaaactcccctaa

SEQ ID NO: 8209 - RNA, 708 nt, synthetic construct
  misc_feature 1..708: note = derived and/or modified CDS sequence (opt11) from TAHV__Z68497.1__N
  source 1..708: mol_type = other RNA
atgagcgacctcgtcttctatgacgtcgcctccaccggagccaacggcttcgaccccgacgccggctacgtcgacttctgcatcaaacacggggaagccataaacctccactccgtacgcatcttcttcctaaacgccgccaaagcaaaagccgccctcgcccgcaaacccgaacgcaaagccagccccaaattcggcgaatggcaagtcgaagtcgtaaactaccacttccccggaaaccgcaacaaccccatcgacaacaacgacctcaccatccaccgactctacggctacctcgcacgatgggtcctcgaacaattcaaagaaaacgaagacgccgcccaacgcgaactcatcaaaaccaccgtcatcaaccccatcgccgaatccaacggcatccgctgggacaacggcgccgaaatctacctagccttcttccccggcaccgaaatgttcctagaaaccttcaacttctaccccctcaccatcggcatctaccgcgtcaaacaaggcatgatggacccacaatacctcaaaaaagccctacgccaacgctacggctccctaaccgccgacaaatggatgtcccaaaaaaccaccgccatcgcaaaatccctcaaagacgtcgaacaactcaaatggggccgcggcggccttagcgacaccgcccgaaccttcctccaaaaattcggcatccgcctcccctaa

SEQ ID NO: 8210 - RNA, 708 nt, synthetic construct
  misc_feature 1..708: note = derived and/or modified CDS sequence (opt11) from TAHV(22595-6)__HM036217.1__N
  source 1..708: mol_type = other RNA
atgtccgacctcgtcttctacgacgtcgcatccactggcgccaacggcttcgaccccgacgccggctacgtcgacttctgcatcaaacacggcgaagccatcaacctccactccgtccgcatcttcttcctcaacgccgccaaagcaaaagccgccctcgcccgcaaacccgaacgcaaagcctcccccaaattcggcgaatggcaagtcgaagtcgtaaacaaccacttccccggcaaccgaaacaaccccatcgacaacaacgacctcaccatccaccgcctcagcggctacctagcccgctgggtcctcgaacaattcaaagaaaacgaagacgccgcccaacgagaactaatcaaaaccaccgtcatcaaccccatcgccgaatccaacggcatccgctgggacaacggcgccgaaatatacctcgccttcttcccaggcaccgaaatgttcctcgaaaccttcaacttctaccccctaaccataggcatctaccgcgtcaaacaaggaatgatggaccctcaatacctcaaaaaagccctccgccaacgatacggctccctaaccgccgacaaatggatgtcccaaaaaaccaccgccatcgccaaatccctcaaagacgtcgaacaactcaaatggggacgcggaggcctctccgacaccgcccgaaccttcctccaaaaattcggcatccgcctcccataa

SEQ ID NO: 8211 - RNA, 708 nt, synthetic construct
  misc_feature 1..708: note = derived and/or modified CDS sequence (opt11) from TAHV(NM08003)__HQ541823.1__N
  source 1..708: mol_type = other RNA
atgtcagacctagtcttctacgacgtagcctccaccggagccaacggcttcgaccccgacgcaggctacgtcgacttctgcatcaaacacggcgaagccatcaacctccactcagtacgcatcttcttcctcaacgccgccaaagccaaggccgccctcgcccgcaaaccagaacgcaaagccagccccaaattcggagaatggcaagtcgaagtcgtcaacaaccacttccccggcaacagaaacaaccccatcgacaacaacgacctaaccatccaccgcctctccggatacctagcccgctgggtcctagaacaattcaaagaaaacgacgacgccgcccaacgcgaactcatcaaaaccaccgtaatcaaccccatagcagaatccaacggaatccgctgggacaacggcgccgaaatctacctcgccttcttccccggcaccgaaatgttcctcgaaacattcaacttctaccccctcacaatcggcatctaccgcgtcaaacaaggcatgatggacccccaatacctcaaaaaagccctccgccaacgctacggctcactcaccgccgacaaatggatgtcacaaaaaaccaccgccatcgccaaatccctcaaagacgtcgaacaactcaaatggggccgcggcggcctctccgacaccgccagaacattcctccaaaaattcggcatacgcctcccctag

SEQ ID NO: 8212 - RNA, 708 nt, synthetic construct
  misc_feature 1..708: note = derived and/or modified CDS sequence (opt11) from TAHV(XJ0625)__EU622820.2__N
  source 1..708: mol_type = other RNA
atgtccgacctcgtcttctacgacgtagcctccaccggagccaacggcttcgacccagacgccggctacgtagacttctgcgtcaaatacggcgaagccatcaacctccactccgtccgcatcttcttcctaaacgccgccaaagccaaagccgccctcgcccgcaaacccgaacgcaaagcctcccccaaattcggagaatggcaagtcgaagtcgtcaacaaccacttccccggcaaccgcaacaaccccatcgacaacaacgacctcaccatccaccgactatccggctacctcgcacgctgggtcctcgaacaattcaaagaaaacgaagacgccgcccaacgtgaactcatcaaaacaaccgtaatcaaccccatcgccgaatccaacggcatccgctgggacaacggcgccgagatctacctcgccttcttccccggcaccgaaatgttcctcgaaaccttcaacttctaccccctcaccatcggcatctaccgagtcaaacaaggcatgatggacccccaatacctcaaaaaagccctccgacaacgctacggccccctaaccgcagacaaatggatgtcccaaaaaaccgtcgccatcgccaaatccctaaaagacgtcgaacaactcaaatggggcagaggaggcctatccgacaccgcacgaaccttcctccaaaaattcggcatacgcctcccctaa

SEQ ID NO: 8213 - RNA, 708 nt, synthetic construct
  misc_feature 1..708: note = derived and/or modified CDS sequence (opt11) from TAHV(XJ0708)__HM243139.1__N
  source 1..708: mol_type = other RNA
atgtccgacctcgtcttctacgacgtcgcctccacaggcgccaacggcttcgaccccgacgccggctacgtcgacttctgcgccaaatacggcgaagccatcaacctccactcagtccgcatcttcttcctaaacgcagcaaaagccaaagccgccctagcccgcaaaccagaacgcaaagcctcccccaaattcggcgaatggcaagtcgaagtcgtcaacaaccacttccccggcaaccgcaacaaccccatcgacaacaacgacctcacaatccaccgcctctcaggctacctagcccgctgggtcctcgaacaattcaaagaaaacgaagacgccgcacaacgcgaactcataaaaacaaccgtcatcaaccccatcgccgaatccaacggcatccgatgggacaacggcgccgaaatctacctcgccttcttccccggcaccgaaatgttcctcgaaaccttcaacttctaccccctcaccatcggcatctaccgcgtaaaacaaggcatgatggacccccaatacctcaaaaaagccctccgccaacgctacggccccctcacagccgacaaatggatgtctcaaaaaactgtcgccatcgccaaatccctcaaagacgtagaacaactcaaatggggccgcggcggcctctccgacacagcccgcaccttcctccaaaaattcggaatccgcttaccctaa

SEQ ID NO: 8214 - RNA, 708 nt, synthetic construct
  misc_feature 1..708: note = derived and/or modified CDS sequence (opt11) from TVTV(AR42)__KX891323.1__N
  source 1..708: mol_type = other RNA
atgagcgaactcgtattctacgacgccccctccaccggggccaacggattcgaccccgacgccggctacgtcgccttcatcgccgcacacgcaggctcatacgacctctcagccgtccgcatattcttcctcaacgccgcaaaagcaaaaaacgccctcagccgcaaacccgaaggcaaagtcagcatcaaattcggcgaatggtcagtcgaagtcgtaaacaaccacttccccggcaaccgaaacaaccccatcggcaacaacgacctcaccatccaccgaatctccggctacctcgccagatgggtcctcgaagaattcaaaggacaagacgacgaagcacaaaaagacatcatccgctcaaccatcgtcaaccccatcgccgaaagcaacggcatacactgggactccggcgcggacgcatacctatccttcttcccgggcaccgaaatgttcctcgaatccttcgacttcctccccctagccatcggcatctacagagtcaaaaacggcatgatggacgtgcaatacctcaaaaaagcgctcagacaacgctacggcaccatgaccgccgacaaatggatgagcacaaaaacaaccgtcatcgccaaaaccctcaaacgcgtagaatcattcaaatggggaaaaggcggcctcagcgaagccgcacgcgccttcctctccaaattcaacgtcaaaatcccataa

SEQ ID NO: 8215 - RNA, 708 nt, synthetic construct
  misc_feature 1..708: note = derived and/or modified CDS sequence (opt11) from TVTV(ND3374)__KM215564.1__N
  source 1..708: mol_type = other RNA
atgagcgaactcgtattctacgacgcaccctcgacaggggcaaacggcttcgacccggacgccggctacgtcgcgttcatagccgcacacgcgggctcatacgacctctcggccgtgcgcatattcttcctcaacgccgcaaaagccaaaaacgcactaagcagacgcccagaaggaaaagtaagcataaaattcggcgaatggtcagtcgaagtcgtaaacaaccacttccccggcaacagaaacaaccccataggcaacaacgacctcaccatacaccgaatcagcggatacctagcaaggtgggtgctcgaagagttcaaaggacaagacgacgaagcccaaaaagacatcatacgctcaaccatagtcaacccaatagcagaaagcaacggcatacactgggactcgggcgcggacgcatacctcagcttcttccccggcaccgaaatgttcctagaatcgttcgacttcctacccctagccatcggcatatacagagtcaagaacggaatgatggacgtgcaatacctaaagaaagcactcagacaaaggtacggcaccatgaccgcggacaaatggatgagcacaaaaaccaccgtaatcgcgaaaacactaaagcgcgtagaatcattcaaatggggcaaagggggcctaagcgaagccgcacgagcattcctgagcaagttcaacgtcaaaatcccataa

SEQ ID NO: 8216 - RNA, 708 nt, synthetic construct
  misc_feature 1..708: note = derived and/or modified CDS sequence (opt11) from JCV(3324-04)__HM007356.1__N
  source 1..708: mol_type = other RNA
atgggcgacctcgtattctacgacgtcgcctccaccggcgccaacggcttcgaccccgacgccggcttcgtcgccttcatggccgaccacggcgaatccgtctccctctcagccgtacgaatcttcttcctcaacgccgccaaagcaaaagccgccctcgcccgcaaacccgaacgcaaagccacccccaaattcggcgaatggcaagtagaaatagtcaacaaccacttccccggcaaccgaaacaaccccatcggaaacaacgacctcaccatccaccgcctatccggctacctcgcccgctgggtcctcgaacacttcaccacagacgacgacgaatcacaacgcgaactcatacgatccaccatcatcaaccccatcgccgaatcaaacggcatccactggaacaacggccccgaaatctacctctcattcttccccggcaccgaaatgttcctggaaatcttcaaattctaccccctcaccataggcatataccgcgtcaaacacggcatgatggacccccaatacctcaaaaaagccctacgccaacgctacggcaccctcaccgccgaaaaatggatggcccaaaaaaccgtcctcatcgccaaatccctcaaagacgtcgaacaactcaaatggggccgaggcggcctctccgacgccgcccgcaccttcctaatcaaattcggcgtcaaactaccctaa

SEQ ID NO: 8217 - RNA, 708 nt, synthetic construct
  misc_feature 1..708: note = derived and/or modified CDS sequence (opt11) from JCV(61v2235)__U12796.1__N
  source 1..708: mol_type = other RNA
atgggcgacctagtattctacgacgtagcctccaccggcgcaaacggcttcgacccagacgccggcttcgtcgccttcatggccgaccacggcgaatccatcaacctcagcgcagtccgaatattcttcctaaacgccgccaaagccaaagccgccctagcccgcaaacccgaacgaaaagcaacccccaaattcggcgaatggcaagtcgaaatcgtcaacaaccacttctcaggcaaccgcaacaaccccatcggcaacaacgacctcaccatccaccgactctccggctacctcgcacgctgggtcctcgaacacttcaactccgacgacgacgaatcccaacgcgaactaatccgctccaccatcatcaaccccatcgcagaatccaacggcatccactggaacaacggcccagaaatctacctctcattcttccccggcaccgaaatgttcctcgaaatcttcaaattctaccccctcaccatcggcatctaccgcgtcaaacacggcatgatggacccccaatacctcaaaaaagcactccgtcaacgctacggcaccctcaccgcagaaaaatggatggcccaaaaaaccgtcctaatcgccaaatcactcaaagacgtcgaacaactcaaatggggacgcggcggactcagcgacgccgcccgaacattcctcatcaaattcggcgtcaaactaccataa

SEQ ID NO: 8218 - RNA, 708 nt, synthetic construct
  misc_feature 1..708: note = derived and/or modified CDS sequence (opt11) from JCV(1064-03)__EF681816.1__N
  source 1..708: mol_type = other RNA
atgggcgacctcgtcttctacgacgtcgcctccaccggagccaacggcttcgaccccgacgcaggcttcgtcgccttcatggccgaccacggcgaagccataaacctcgcagcagtacgcatcttcttcctcaacgccgcaaaagccaaagccgccctcgcacgcaaacccgaacgaaaagccaccccaaaattcggagaatggcaagtcgaaatcgtcaacaaccacttcccaggcaaccgaaacaaccccatcggcaacaacgacctcaccatccaccgcctatccggctacctcgcccgctgggtcctcgaacacttcaccgaagacgacgacgaatcccaacgcgaactcatccgcagcaccatcatcaaccccatcgccgagtccaacggcatacactggaacaacggccccgaaatctacctatccttcttccccggcaccgaaatgttcctcgaagtcttcaaattctaccccctaaccatcggcatctaccgagtcaaacacggaatgatggacccccaatacctcaaaaaagccctacgccaacgatacggcaccctcaccgcagaaaaatggatggcccaaaaaaccgtcctcatcgccaaatcactcaaagacgtagaacaactcaaatggggacgcggaggcctctccgacgccgcccgcaccttcctcatcaaattcggcgtcaaactcccataa

SEQ ID NO: 8219 - RNA, 708 nt, synthetic construct
  misc_feature 1..708: note = derived and/or modified CDS sequence (opt11) from JCV(33909)__EF681853.1__N
  source 1..708: mol_type = other RNA
atgggcgacctagtattctacgacgtcgcctccaccggcgccaacggcttcgaccccgacgccggcttcgtcgcattcatggccgaccacggagaagtcatcaacctagccgccgtacgcatcttcttcctcaacgcagccaaagccaaagcagccctcgcccgcaaacccgaacgcaaagcaaccccaaaattcggagaatggcaagtcgaaatcgtcaacaaccacttccccggcaaccgaaacaaccccatcggcaacaacgacctcaccatccaccgtctatccggctacctagcccgatgggtcctcgaacacttcaccgaagacgacgacgagtcccaacgcgaactaatccgctccaccatcatcaacccaatcgccgaatccaacggcatccactggaacaacggcccagaaatctacctctccttcttccccggcaccgaaatgttcctagaggtcttcaaattctaccccctcacaatcggcatctaccgcgtcaaacacggcatgatggacccccaatacctcaaaaaagccctccgacaacgctacggcaccctcacagccgaaaaatggatggcccaaaaaacagtcctcatcgccaaatccctcaaagacgtcgaacaactcaaatggggccgcggcggactctccgacgcagcccgcaccttcctaatcaaattcggggtcaaactcccataa

SEQ ID NO: 8220 - RNA, 708 nt, synthetic construct
  misc_feature 1..708: note = derived and/or modified CDS sequence (opt11) from JCV(2179-00)__EF681808.1__N
  source 1..708: mol_type = other RNA
atgggcgaccttgtcttctacgacgtcgcctccaccggagcaaacggcttcgacccagacgccggcttcgtcgcattcatggccgaccacggcgaatccgtctccctctccgccgtccgcatcttcttcctcaacgcagccaaagccaaagccgccctagcccgcaaacccgaacgcaaagcaactcccaaattcggcgaatggcaagtcgaaatcgtcaacaaccacttccccggcaacagaaacaaccccatcggcaacaacgacctcaccatccaccgcctatccggatacctcgcccgatgggtcctcgaacacttcaccaccgacgacgacgaatcccaacgcgaactcatccgatccaccataatcaaccccatcgccgaatcaaacggcatccactggaacaacggccccgaaatctacctctccttcttccccggcacagaaatgttcctcgaaatattcaaattctaccctctcaccatcggcatttaccgcgtaaaacacggcatgatggacccccaatacctaaaaaaagccctccgacaacgctacggcatcctaaccgccgaaaaatggatggcccaaaaaaccgtactcatcgccaaatccctcaaagacgtcgaacaactcaaatggggccgcggcggactatccgacgcagccagaaccttcctaatcaaattcggagtaaaactcccctaa

SEQ ID NO: 8221 - RNA, 708 nt, synthetic construct
  misc_feature 1..708: note = derived and/or modified CDS sequence (opt11) from JCV(2989-06)__EF681849.1__N
  source 1..708: mol_type = other RNA
atgggcgacctcatcttctacgacgtcgccagcaccggcgccaacggcttcgacccagacgccggcttcgtcgccttcatggccgaccacggagaatccgtctccctctccgccgtccgaatcttcttcctcaacgccgccaaagcaaaagccgccctcgccagaaaacccgaacgaaaagcaaccccaaaattcggcgaatggcaagtcgaaatcgtcaacaaccacttcccgggcaaccgcaacaaccccatcggcaacaacgacctcaccatccaccgcctatccggctacctagcccgctgggtcctcgaacatttcaccaccgacgacgacgaatcccaaagagagcttatccgatcaaccatcatcaaccccatcgccgaatcaaacggaatccactggaacaacggcccagaaatctacctaagcttcttccccggcaccgaaatgttcctcgaaatcttcaaattctaccccctaaccataggcatctacagagtcaaacacggcatgatggacccccaatacctcaaaaaagccctccgacaacgctacggcaccctcaccgccgaaaaatggatggcccaaaaaacagtactcatcgcaaaatccctcaaagacgtcgaacaactcaaatggggccgaggcggcctctccgacgccgcccgcaccttccttataaaattcggcgtcaaactcccctaa

SEQ ID NO: 8222 - RNA, 708 nt, synthetic construct
  misc_feature 1..708: note = derived and/or modified CDS sequence (opt11) from JCV(5592-02)__EF681804.1__N
  source 1..708: mol_type = other RNA
atgggcgacctcgtcttctacgacgtcgcctccaccggcgccaacggcttcgaccccgacgcaggattcgtagccttcatggccgaccacggcgaatccgtcagcctctcagccgtccgcatcttcttcctaaacgctgcaaaagccaaagccgccctagcccgcaaacccgaacgcaaagccacccccaaattcggcgaatggcaagtcgaaatagtcaacaaccacttcccaggcaaccgcaactcccccatcggcaacaacgacctcaccatccaccgcctctccggctacctcgcccgctgggtcctcgaacacttcaccaccgacgacgacgaatcccaacgcgaattaatccgctccaccatcatcaaccccatcgccgaatcaaacggaatacactggaacaacggccccgaaatctacctctcattcttccccggcaccgaaatgttcctcgaaatcttcaaattctaccccctcaccataggaatctaccgcgtcaaacacggcatgatggacccacaatacctcaaaaaagccctcagacaacgctacggaaccctcaccgccgaaaaatggatggcccaaaaaaccgtcctcatagccaaatccctcaaagacgtcgaacaactcaaatggggccgcggcggcctctccgacgccgcccgcaccttcctcatcaaattcggagtcaaactcccataa

SEQ ID NO: 8223 - RNA, 708 nt, synthetic construct
  misc_feature 1..708: note = derived and/or modified CDS sequence (opt11) from JCV(F5609)__KM215546.1__N
  source 1..708: mol_type = other RNA
atgggcgacctagtcttctacgacgtcgcctccaccggcgccaacggcttcgaccccgacgccggcttcgtcgcattcatggccgaccacggagaatcagtctccctctccgccgtccgcatcttcttcctcaacgccgccaaagccaaagcagccctagcacgcaaacccgaacgcaaagccacacccaaattcggcgaatggcaagtcgaaatagtcaacaaccacttccccggcaaccgcaacaaccccatcggcaacaacgacctcaccatccaccgcctctccggctacctcgcccgctgggtcctcgaacacttcaccaccgacgacgacgaatctcaacgcgaacttatccgcagcaccataatcaacccaatcgccgaatccaacggcatccactggaacaacggccccgaaatctacctaagcttcttccccggaaccgaaatgttcctagaaatcttcaaattctaccccctcaccatcggcatctaccgcgtcaaacacggcatgatggacccccaatacctcaaaaaagccctccgacaacgctacggcaccctcacagccgaaaaatggatggcccaaaaaaccgtcctcatcgccaaatcactcaaagacgtcgaacaactaaaatggggccgcggaggtctctccgacgccgcccgcacattcctcaccaaattcggcgtcaaactcccataa

SEQ ID NO: 8224 - RNA, 708 nt, synthetic construct
  misc_feature 1..708: note = derived and/or modified CDS sequence (opt11) from JCV(F6577)__KM215557.1__N
  source 1..708: mol_type = other RNA
atgggcgacctcgtcttctacgacgtcgcatccaccggcgccaacggattcgaccccgacgccggcttcgtcgccttcatggccgaccacggcgaatccgtctccctatcagccgtccgcatcttcttcctcaacgccgccaaggccaaagccgccctctcccgcaaacccgaacgcaaagccacaccaaaattcggagaatggcaagtcgaaattgtcaacaaccacttccccggcaacagaaacaaccccatcggcaacaacgacctcaccatccaccgactctccggctacctcgcccgctgggtcctcgaacacttcaccaccgacgacgacgaatcacaacgcgaactaatccgctcaaccatcatcaaccccatcgccgaatccaacggcatccactggaacaacggccccgaaatctacctctccttcttccccggcaccgaaatgttcctcgaaatcttcaaattctacccactcactatcggaatctaccgcgtcaaacacggcatgatggacccccaatacctcaaaaaagcactacgccaacgatacggcacactcaccgcagaaaaatggatggcccaaaaaacagtcctaatagccaaatccctcaaagacgtcgaacaactcaaatggggccgaggcggcctctcagacgccgcccgcaccttcctcatcaaattcggcgtaaaactgccctaa

SEQ ID NO: 8225 - RNA, 708 nt, synthetic construct
  misc_feature 1..708: note = derived and/or modified CDS sequence (opt11) from JCV(W13135)__KM215552.1__N
  source 1..708: mol_type = other RNA
atgggcgacctcgtattctacgacgtcgcctccacaggcgccaacggcttcgaccccgacgccggcttcgtcgccttcatggcagaccacggagaatccgtcaacctctccgcagtaagaatcttcttcctcaacgccgccaaagccaaagccgcactcgcccgaaaacccgaaagaaaagcaacccccaaattcggcgaatggcaagtcgaaatcgtaaacaaccacttccccggcaaccgcaacaaccccatcggcaacaacgacctcaccatccaccgcctctccggctacctcgcccgatgggtcctcgaacacttcaccaccgacgacgacgaatcccaacgcgaactcatccgctcaaccatcatcaacccaatcgccgaatccaacggcatccactggaacaacggcccagaaatctacctctccttcttccccggaaccgaaatgttcctcgaaatcttcaaattctaccccctcaccatcggaatctaccgcgtcaaacacggcatgatggacccccaatacctcaaaaaagccctacgccaacgctacggaaccctcaccgccgaaaaatggatggcacaaaaaaccgtcctcatcgcaaaatccctcaaagacgtcgaacaactcaaatggggccgcggcggcctctccgacgccgcccgcacattcctcatcaaattcggcgtcaaactcccataa

SEQ ID NO: 8226 - RNA, 708 nt, synthetic construct
  misc_feature 1..708: note = derived and/or modified CDS sequence (opt11) from JCV(W18393)__KM215559.1__N
  source 1..708: mol_type = other RNA
atgggcgacctcgtcttctacgacgtcgcctccaccggagccaacggattcgaccccgacgccggcttcgtcgcattcatggccgaccacggcgaatccataaacctctccgcagtccgcatcttcttcctcaacgccgccaaagcaaaagccgccctcgcccgcaaacccgaacgcaaagccaccccaaaattcggcgaatggcaagtcgaaatcatcaacaaccacttccccggcaaccgcaacaaccccatcggcaacaacgacctaaccatccaccgcctctctggctacctcgcccgctgggtcctcgaacacttcaccgccgacgacgacgaatcccaacgcgaactcatccgctccaccatcatcaaccccatcgccgaatccaacggcatacactggaacaacggccccgaaatctacctctccttcttcccaggcaccgaaatgttcctcgaaatcttcaaattctaccccctcaccatcggaatctaccgcgtaaaacacggaatgatggacccacaatacctcaaaaaagccctcagacaacgctacggcacactcaccgccgaaaaatggatggcccaaaaaaccgtcctcatagccaaatccctcaaagacgtcgaacaactcaaatggggccgcggcggcctatccgacgccgccagaaccttcctaatcaaattcggcgtcaaactcccctaa

SEQ ID NO: 8227 - RNA, 708 nt, synthetic construct
  misc_feature 1..708: note = derived and/or modified CDS sequence (opt11) from KEYV(KEYV/Ochlerotatus atlanticus/USA/KEYVLK01/2005)__KT630290.1__N
  source 1..708: mol_type = other RNA
atgggcgacctcgtattctacgacgtcgcctccaccggcgccaacggcttcgaccccgacgccggctacgtcgccttcatggccaaccacggcgaatcaatctccctatccaccgtacgcatcttcttcctaaacgccgccaaagccaaagcagccctcacccgcaaacccgaacgcaaagccaccccaaaattcggagaatggcaagtagaaatcgtcaacaaccacttccccggcaaccgaaacaaccccatcggcaacaacgacctaactctccaccgaatctccggctacctagcccgctgggtcctagaacacttcggcgaaggcgaagacgaatcccaaaaagagctcatcaaatccaccgtcatcaaccccatagccgaaagcaacggcatccgatggggcaacggcgtcgaaatctacctctccttcttcccaggcacagaaatgttcctcgaactcttcaaattctacccccttacaataggcatctacagagtcaagcacggcatgatggacgcacaatacctaaaaaaagccctccgccaacgctacggcaccctcacagccgacaaatggatggcccaaaaaaccagcatgatcaccaaatccctaaaagacgtcgaacaactcaaatggggaaaaggcggcctaagcgacaccgcccgcgccttcctcgccaaattcggcgtccgcctcccctaa

SEQ ID NO: 8228 - RNA, 708 nt, synthetic construct
  misc_feature 1..708: note = derived and/or modified CDS sequence (opt11) from KEYV(KEYV/Ochlerotatus atlanticus/USA/KEYVLK02/2005)__KT630293.1__N
  source 1..708: mol_type = other RNA
atgggagacctcgtcttctacgacgtcgcatcaaccggcgcaaacggattcgaccctgacgccggctacgtcgccttcatggccaaccacggcgaatccatctccctctccaccgtccgcatcttcttcctcaacgccgccaaagccaaagccgccctcacccgaaaatccgaacgcaaagcaacccccaaattcggcgaatggcaagtcgaaatcgtcaacaaccacttccccggcaaccgcaacaaccccatcggaaacaacgaccttaccctccaccgcatctccggatacctcgcccgctgggtcctcgaacacttcggcgaaggcgaagacgaatcccaaaaagaactaatcaaatccaccgtcatcaaccccatcgccgaatccaacggcatccgctggggcaacggcgtcgaaatctacctatccttcttcccaggcaccgaaatgttcctcgaactcttcaaattctaccccctcaccatcggcatctaccgagtcaaacacggcatgatggacgcacaatacctcaaaaaagccctccgccaacgctacggcaccctcaccgccgacaaatggatggcccaaaaaacctcaatgatcaccaaatcactaaaagacgtcgaacaactcaaatggggcaaaggcggactctccgacacagccagagccttcctagccaaattcggcgtccgcctcccctaa

SEQ ID NO: 8229 - RNA, 708 nt, synthetic construct
  misc_feature 1..708: note = derived and/or modified CDS sequence (opt11) from KEYV(C14031-33)__U12801.1__N
  source 1..708: mol_type = other RNA
atgggcgacctcgtattctacgacgtcgccagcaccggagccaacggcttcgaccccgacgccggctacgtcgcattcatggccaaccacggcgaatccatctccctctcaacagtccgcatcttcttcctaaacgccgccaaagccaaagccgccctcactcgcaaacccgaacgcaaagccacccccaaattcggagaatggcaagtcgaaatcgtaaacaaccacttccccggcaaccgcaacaaccccatcggcaacaacgacctcacactccaccgcatcagcggctacctcgcccgctgggtcctagaacacttcggcgaaggcgaagacgaatcccaaaaagaactcataaaatccaccgtaatcaaccccatcgccgaatccaacggaatccgctggggcaacggcgtcgaaatctacctctcattcttccccggcaccgaaatgttcctcgaactcttcaaattctaccccctcaccataggcatctaccgcgtcaaacacggaatgatggacgcccaatacctcaaaaaagccctacgacaacgctacggcacactcaccgccgacaaatggatggcccaaaaaaccagcatgatcacaaaatcactcaaagacgtcgaacaactcaaatggggcaaaggaggcctctccgacaccgcccgagccttcctagccaaattcggcgtccgactcccctaa

SEQ ID NO: 8230 - RNA, 708 nt, synthetic construct
  misc_feature 1..708: note = derived and/or modified CDS sequence (opt11) from LACV(Human/78)__NC_004110.1__N
  source 1..708: mol_type = other RNA
atgtccgacctcgtattctacgacgtagcctcaacaggcgccaacggattcgacccagacgccggatacatggacttctgcgtcaaaaacgccgaactcctcaacctcgccgccgtccgcatcttcttcctcaacgccgccaaagccaaagcagccctatcccgcaaacccgaacgaaaagccaaccccaaattcggcgaatggcaagtcgaagtcatcaacaaccacttccccggcaaccgcaacaacccaatcggcaacaacgacctcaccatacaccgactttccggctacctcgcccgatgggtcctcgaccaatacaacgaaaacgacgacgaatcccaacacgaactaatacgcacaaccatcatcaaccccatcgccgagtccaacggcgtcggctgggactccggacccgaaatatacctctccttcttccccggcacagaaatgttcctagaaaccttcaaattctacccactcactatcggcatccacagagtaaaacaaggaatgatggacccccaatacctcaaaaaagccctacgacaacgctacggaacccttaccgccgacaaatggatgtcacaaaaagtcgccgccatcgccaaatccctcaaagacgtagaacaactcaaatggggaaaaggcggcctctcagacaccgccaaaaccttcctccaaaaattcggcatccgactcccataa

SEQ ID NO: 8231 - RNA, 708 nt, synthetic construct
  misc_feature 1..708: note = derived and/or modified CDS sequence (opt11) from LACV__KP271107.1__N
  source 1..708: mol_type = other RNA
atgtccgacctagtcttctacgacgtcgcctccactggcgcaaacggcttcgacccagacaccggctacatggacttctgcgtcaaaaacgccgaatccctcaacctcgcagccgtacgcatcttcttcctcaacgccgccaaagcaaaagccgccctctcccgcaaacccgaacgcaaagccaaccccaaattcggcgaatggcaagtcgaagtcatcaacaaccacttcccaggcaaccgcaacaaccccataggaaacaacgacctcaccatccaccgcctatccggctacctcgcccgctgggtcctcgaccaatacaacgaaaacgacgacgaatcccaacacgaactcatccgcaccaccatcatcaaccccatcgccgaatccaacggcgtcggctgggactcaggcccagaaatctacctctctttcttcccaggcaccgaaatgttcctcgaaaccttcaaattctaccccctaacaatcggcatccaccgagtaaaacaaggaatgatggacccccaatacctcaaaaaagccctacgccaacgctacggcaccctcaccgccgacaaatggatgtcccaaaaagtcgccgccatcgcaaaatccctcaaagacgtcgaacaactaaaatggggcaaaggcggcctctccgacaccgcaaaaaccttcctacaaaaattcggcatccgactaccctaa

SEQ ID NO: 8232 - RNA, 708 nt, synthetic construct
  misc_feature 1..708: note = derived and/or modified CDS sequence (opt11) from LACV(BEN2_Lafayette_WI_2007)__GU596386.1__N
  source 1..708: mol_type = other RNA
atgtcagacctcgtcttctacgacgtcgcctccacaggcgcaaatggcttcgaccccgacgccggatacatggacttctgcgtcaaaaacgcagaatcactcaacctcgccgcagtccgcatcttcttcctcaacgccgccaaagccaaagccgccctctcacgcaaacccgaacgcaaagccaaccccaaattcggcgaatggcaagtcgaagtcatcaacaaccacttccctggcaacagaaacaacccaatcggcaacaacgacctaacaatccaccgcctctccggctacctcgcccgatgggtcctcgaccaatacaacgaaaacgacgacgaaagccaacacgaactaatacgcaccaccatcatcaaccccatcgccgaatccaacggcgtaggctgggactccggccccgaaatctacctctccttctttcccggcaccgaaatgttcctcgaaaccttcaaattctaccctctcaccatcggcatacaccgagtcaaacaaggcatgatggacccccaatacctcaaaaaagccctccgtcaacgatacggcaccctcaccgccgacaaatggatgtcccaaaaagtcgccgccatcgcaaaatccctcaaagacgtcgaacagctcaaatggggaaaaggcggcctctccgacaccgccaaaaccttcctccaaaaattcggcatccgcctcccctaa

SEQ ID NO: 8233 - RNA, 708 nt, synthetic construct
  misc_feature 1..708: note = derived and/or modified CDS sequence (opt11) from LACV(Dallas/TX/2009)__GU591164.1__N
  source 1..708: mol_type = other RNA
atgtccgacctcgtcttctacgacgtagcctccaccggcgccaacggcttcgacccagacgccggctacatggacttctgcgtcaaaaacgccgaatcactaaacctcgccgccgtccgcatcttcttcctcaacgccgccaaagccaaagcagcactctcccgcaaacccgaacgcaaagccaaccccaaattcggcgaatggcaagtagaagtcgtcaacaaccacttccccggcaaccgcaacaaccccatcggcaacaacgacctcaccatccaccgcctatccggatacctggccagatgggtcctcgaccaatacaacgaaaacgacgacgaatcacaacgcgaactcatccgaaccaccatcatcaaccccatcgcagaatccaacggcgtccgctgggactccggaccagaaatctacctctccttcttcccaggcaccgaaatgttcctcgaaaccttcaaattctaccccctcaccatcggcatccaccgcgtcaaacaaggcatgatggacccccaatacctcaagaaagccctccgccaacgatacggcaccctcaccgccgacaaatggatgtcccaaaaagtcgccgccatcgccaaatccctcaaagacgtcgaacaactaaaatggggaaaaggcggcctctccgacaccgccaaaaccttcctccaaaaattcggcatccgcctaccctaa

SEQ ID NO: 8234 - RNA, 708 nt, synthetic construct
  misc_feature 1..708: note = derived and/or modified CDS sequence (opt11) from LACV(Fort Bend County/TX/2009)__GU591167.1__N
  source 1..708: mol_type = other RNA
atgtcagacctcgtcttctacgacgtcgcctccaccggcgccaacggattcgaccccgacgccggctacatggacttctgcgtcaaaaacgcagaatcactcaacctagcagccgtccgcatcttcttcctcaacgccgcaaaagccaaagcagcactcagccgaaaaccagaacgaaaagccaaccccaaattcggcgaatggcaagtagaagtcatcaacaaccacttccccggcaaccgcaacaaccccatcggcaacaacgatctcaccatccaccgcctctccggctacctagcccgatgggtcctcgaccaatacaacgaaaacgacgacgaatcccaacgagaactcatacgcaccaccatcatcaaccccatcgcagaatcaaacggagtccgatgggactccggccccgaaatctacctctccttcttcccaggcaccgaaatgttcctcgaaacattcaaattctaccccctcaccataggcatccaccgagtcaagcaaggcatgatggacccccaatacctcaagaaagccctcagacaacgctacggcacactcaccgccgacaaatggatgtcacaaaaagtcgccgccatcgccaaatccctcaaagacgtcgaacaactcaaatggggcaaaggcggcctatccgacaccgcaaaaaccttcctacaaaaattcggcatccgactcccctaa

SEQ ID NO: 8235 - RNA, 708 nt, synthetic construct
  misc_feature 1..708: note = derived and/or modified CDS sequence (opt11) from LACV(LACV/95/OH-H (CCH-MB96))__GU206135.1__N
  source 1..708: mol_type = other RNA
atgtccgacctcgtcttctacgacgtcgcctccaccggcgccaacggcttcgacccagacgccggctacatggacttctgcgtcaaaaacgcagaatccctcaacctcgccgcagtacgcatcttcttcctcaacgccgccaaagccaaagccgccctctcaagaaaacccgaacgaaaagccaaccccaaattcggagaatggcaagtcgaagtcgtcaacaaccacttccccggcaaccgcaacaaccccatcggcaacaacgacctcaccatccaccgcctctcaggctacctcgcccgctgggtcctcgaccaatacaacgagaacgacgacgaatcccaacacgaactcatcaaaacaaccataatcaaccccatagcagaatccaacggcgtcggctgggactccggccccgaaatctacctctccttcttccccggcaccgaaatgttcctcgaaaccttcaaattctaccccctcaccatcggcatccaccgcgtcaaacaaggcatgatggacccccaatacctcaagaaagcactccgacaacgatacggcaccctaaccgccgacaaatggatgagccaaaaagtcgcagccatcgccaaatccctcaaagacgtcgaacaactcaaatggggaaaaggcggcctctccgacacagccaaaacattcctacaaaaattcggcatccgcctcccctaa

SEQ ID NO: 8236 - RNA, 696 nt, synthetic construct
  misc_feature 1..696: note = derived and/or modified CDS sequence (opt11) from OROV(BeAn19991)__NC_005777.1__N
  source 1..696: mol_type = other RNA
atgtcagaattcatattcaacgacgtccctcaacgaaccacctccaccttcgaccccgaagccgcctacgtcgccttcgaagcccgctacggccaagtcctcaacgccggcgtagtccgcgtcttcttcctcaaccaaaaaaaagccaaagacgtcctccgcaaaacctcccgcccaatggtagacctcaccttcggcggcgtccaattcgcaatggtcaacaaccacttcccacaattccaaagcaaccccgtcccagacaacggcctcaccctacaccgcctctccggatacctagcccgctgggccttcacccaaatgcgctcccccatcaaacaagcagaattccgcgcaaccgtcgtcgtccccctagccgaagtaaaaggctgcacctggaatgacggcgacgccatgtacctcggcttcgccgccggcgccgaaatgttcctccaaaccttcaccttcttccccctcgtcatcgaaatgcaccgcgtcctaaaagacggcatggacgtcaacttcatgaaaaaagtcctcagacaacgctacggccaaaaaacagccgaacaatggatgcgagaagaaatcgtcgccgtccgagccgccttcgaagccgtcggcaccctcgcctgggcccgcaccggcttctcccccgccgcccgcgacttcctccgccaattcggcatcgacatctaa

SEQ ID NO: 8237 - RNA, 696 nt, synthetic construct
  misc_feature 1..696: note = derived and/or modified CDS sequence (opt11) from OROV(AR136921)__HQ830443.1__N
  source 1..696: mol_type = other RNA
atgtccgaattcatcttcaacgacgtcccacaacgcacaacctcaaccttcgaccccgaagcagcctacgttgccttcgaagcccgctacggccaagtcctcaacgccggcgtcgtccgcgtcttcttcctcaaccaaaaaaaagcaaaagacgtactacgcaaaacctcccgccccatggtcgacctcaccttcggcggagtccaattcgccatggtcaacaaccacttcccacaattccaatccaaccccgtccccgacaacggcctcaccctacaccgcctctccggctacctcgcccgctgggccttcacccaaatgcgctcccccatcaaacaagccgaattccgagccaccgtcgtcgtccccctcgccgaagtcaagggctgcacctggaacgacggcgacgccatgtacctaggcttcgccgcgggcgccgaaatgttcctccaaaccttcaccttcttccccctagtcatcgaaatgcaccgcgtcctcaaagacggcatggacgtaaactttatgaaaaaagtcctccgccaacgctacggccaaaaaaccgccgaacaatggatgagagaagaaatcgtcgccgtccgcgccgccttcgaagccgtcggcaccctcgcctgggcccgcaccggcttctcccccgccgcccgcgacttcctccgccaattcggcataggcatctaa

SEQ ID NO: 8238 - RNA, 696 nt, synthetic construct
  misc_feature 1..696: note = derived and/or modified CDS sequence (opt11) from OROV(AR366927)__HQ830448.1__N
  source 1..696: mol_type = other RNA
atgtccgaattcttcttcaacgacgtcccccaacgcaccacctccaccttcgaccccgaagcagcctacgtcgcattcgaagcccgctacggccaagtcctcaacgcaggcgtcgtccgagtattcttcctcaatcaaaaaaaagccaaagacgtcctccgcaaaacctcacgtcccatggtcgaccttaccttcggcggcgtccaattcgccatggtcaacaaccacttcccccaatttcagtccaaccccgtccccgacaacggcctcaccctccaccgcctctccggctacctagcccgctgggccttcacacaaatgcgctcccccataaaacaagccgaattccgcgccacagtcgtcgtccccctcgccgaagtcaaaggctgcacctggaacgacggcgacgccatgtacctcggcttcgccgccggcgccgaaatgttcctccaaaccttcaccttcttccccctcgtcatcgaaatgcaccgagtcctcaaagacggcatggacgtcaacttcatgaaaaaagtactccgccaaaaatacggccaaaaaaccgccgaacaatggatgcgcgaagaaatcgtcgccgtccgcgccgcattcgaagccgtcggcaccctcgcctgggcccgaacaggcttctcccccgccgcccgcgacttcctacgccaattcggcatcggcatctaa

SEQ ID NO: 8239 - RNA, 696 nt, synthetic construct
  misc_feature 1..696: note = derived and/or modified CDS sequence (opt11) from OROV(BeAn 206119)__AY993909.1__N
  source 1..696: mol_type = other RNA
atgtccgaattcattttcaacgacgtcccccaacgaaccacatccaccttcgaccccgaagccgcctacgtcgccttcgaagcccgctacggccaagtactaaacgccggcgtcgtccgcgtcttcttcctcaaccaaaaaaaagccaaagacgtactccgcaaaacctcacgcccaatggtcgacctcaccttcggcggcgtccaattcgccatggtcaacaaccacttcccccaattccaatccaaccccgtacccgacaacggcctcaccctccaccgcctctcaggctacctcgcccgctgggccttcacccaaatgcgctcccccatcaaacaagccgaattccgcgccgccgtcgtagtcccactcgtcgaagtcaagggctgcacctggaacgacggcgacgccatgtacctcggcttcgccgcaggcgccgaaatgttcctccaaaccttcaccttcttccccctcgtcatcgaaatgcaccgagtcctaaaagacggcatggacgtaaacttcatgaaaaaagtcctccgccaacgctacggccaaaaaacagcagaacaatggatgcgcgaagaaatcgtcgccgtccgagccgccttcgaaaccgtaggaaccttcgcatgggcccgcaccggcttctcccccgccgcacgagacttcctacgccaattcggcatcggcatctaa

SEQ ID NO: 8240 - RNA, 696 nt, synthetic construct
  misc_feature 1..696: note = derived and/or modified CDS sequence (opt11) from OROV(BeAn 208819)__AY993911.1__N
  source 1..696: mol_type = other RNA
atgtccgaattcatcttcaacgacgtcccacaacgcaccacctcaaccttcgaccccgaagccgcctacgtagccttcgaagcccgctacggccaagtcctcaacgccggcgtcgtacgcgtcttcttcctcaaccaaaaaaaagccaaagacgtcctccgcaaaacctcacgccccatggtagacctcaccttcggaggcgtccaattcgccatggtcaacaaccacttcccccaattccaatccaaccccgtcccagacaacggcctcaccctccaccgcctctctggttacctcgcccgatgggccttcacccagatgcgctcacccataaaacaagccgaattccgcgccaccgtcgtcgtccccctcgtcgaagtcaaaggctgcacctggaacgacggcgacgccatgtacctaggcttcgccgccggcgcagaaatgttcctccaaaccttcaccttcttccccctcgtcatcgaaatgcaccgcgtcctcaaagacggcatggacgtcaacttcatgaaaaaagtcctccgccaacgctacggccaaaaaaccgccgaacaatggatgcgagaagaaatcgtcgccgtccgcgccgcattcgaagccgtcggcacactcgcctgggcccgcaccggcttctcccctgccgcccgcgacttcctccgccaattcggcataggcatctaa

SEQ ID NO: 8241 - RNA, 696 nt, synthetic construct
  misc_feature 1..696: note = derived and/or modified CDS sequence (opt11) from OROV(BeAn 208823)__AY993912.1__N
  source 1..696: mol_type = other RNA
atgtccgaattcatcttcaacgacgtcccccaacgaaccacctcaaccttcgacccagaagcagcctacgtcgccttcgaagcccgctacggccaagtcctaaacgcaggcgtcgtccgagtcttcttcctaaaccaaaaaaaagccaaagacgtcctccgaaaaacctcccgccccatggtcgaccttaccttcggcggcgtccaattcgccatggtcaacaaccatttcccacaattccaatccaaccccgtccccgacaacggcctaaccctccaccgcctctccggctacctcgcccgctgggcattcacccaaatgcgctccccaatcaaacaagccgaattccgcgcaaccgtcgtagtccccctagtcgaagtaaaaggctgcacctggaacgacggcgacgccatgtacctaggcttcgccgccggcgccgaaatgttcctccaaaccttcaccttcttccccctcgtcatcgaaatgcaccgcgtcctcaaagacggcatggacgtcaacttcatgaaaaaagtcctccgccaacgctacggccaaaaaaccgccgaacgctggatgcgtgaagaaatcgtcgccgtacgcgccgccttcgaagccgtcggcaccctagcctgggcccgaaccggcttctcccccgccgccagagacttcctacgccaattcggcatcggcatctaa

SEQ ID NO: 8242 - RNA, 696 nt, synthetic construct
  misc_feature 1..696: note = derived and/or modified CDS sequence (opt11) from OROV(H244576)__HQ830444.1__N
  source 1..696: mol_type = other RNA
atgagcgaattcttcttcaacgacgtcccccaacgcaccacctccaccttcgaccccgaagccgcctacgtcgccttcgaagcacgatacggccaagtcctcaacgccggagtcgtccgcgtcttcttcctcaaccaaaaaaaagccaaagacgtactacgcaaaacctcccgacccatggtcgacctcaccttcggcggcgtccaattcgccatggtcaacaaccacttcccccaattccaatcaaaccccgtccccgacaacggcctcaccttccaccgcctctccggctacctcgcacgctgggccttcacacaaatgcgctcccccatcaaacaagccgaattccgcgccacagtcgtagtccccctagcagaagtcaaaggatgcacctggaacgacggcgacgccatgtacctcggcttcgccgccggcgccgaaatgttcctacaaaccttcaccttcttccccctcgtcatcgaaatgcaccgcgtcctcaaagacggcatggacgtcaacttcatgaaaaaagtcctccgccaaaaatacggacaaaaaaccgccgaacaatggatgcgcgaagaaatcgtcgccgtccgcgccgccttcgaagccgtcggaaccctagcttgggcccgaaccggcttctccccagcagcccgcgacttcctccgccaattcggcatcggcatctag

SEQ ID NO: 8243 - RNA, 696 nt, synthetic construct
  misc_feature 1..696: note = derived and/or modified CDS sequence (opt11) from OROV(H355186)__HQ830446.1__N
  source 1..696: mol_type = other RNA
atgtccgaattcatcttctccgacgtcccacaacgcaccacctccaccttcgaccccgaagccgcatacgtcgccttcgaagcccgctacggccaagtcctcaacgccggcgtcgtacgcgtattcttcctcaaccaaaaaaaagcaaaagacgtactccgcaagacctcccgccccatggtcgacctcacattcggcggcgtacaattcgcaatggtcaacaaccacttcccccaattccaatccaaccccgtccccgacaacggcctcaccctacaccgcctctccggctacctcgcacgatgggccttcacacaaatgcgctcccccatcaaacaagcagaattccgcgccaccgttgtcgtccccctagcagaagtaaaaggctgcacctggaacgacggcgacgccatgtacctcggcttcgccgccggcgccgaaatgttcctccaaaccttcaccttcttccccctagtcatagaaatgcaccgagtcctcaaagacggaatggacgtcaacttcatgaaaaaagtcctccgacaacgctacggccaaaaaaccgccgaacaatggatgcgcgaagaaatcgtagccgtccgagccgccttcgaagccgtcggaaccctagcatgggcccgcaccggcttcagccccgccgcccgagacttcctacgccaattcggcatcggaatataa

SEQ ID NO: 8244 - RNA, 696 nt, synthetic construct
  misc_feature 1..696: note = derived and/or modified CDS sequence (opt11) from OROV(H356898)__HQ830447.1__N
  source 1..696: mol_type = other RNA
atgtcagaattcatcttcaacgacgtcccccaacgcacaacatccaccttcgaccccgaagccgcatacgtatccttcgaagcccgctacggccaagtcctcaacgccggcgtcgtccgcgtcttcttcctcaaccaaaaaaaagccaaagacgtcctccgcaaaaccagccgccccatggtcgacctcaccttcggcggcgtccaattcgccatggttaacaaccacttcccccaattccaatcaaaccccgtccccgacaacggcctaaccctacaccgactctccggctacctagcccgctgggccttcactcaaatgcgctcacccatcaaacaagccgaattccgcgcaaccgtcgtcgtccccctagcagaagtcaaaggctgcacctggaacgacggcgacgccatgtacctcggcttcgccgccggcgccgaaatgttcctccaaaccttcaccttcttccccctcgtcatcgaaatgcaccgagtcctcaaagacggcatggacgtcaacttcatgaaaaaagtactccgccaacgctacggccaaaagaccgccgaacaatggatgcgcgaagaaatcgtcgccgtccgcgccgccttcgaagccgtcggcacactcgcctgggcccgaaccggcttctcacccgccgcacgcgacttcctccgccaattcggcatcggaatctaa

SEQ ID NO: 8245 - RNA, 696 nt, synthetic construct
  misc_feature 1..696: note = derived and/or modified CDS sequence (opt11) from OROV(H389865)__HQ830453.1__N
  source 1..696: mol_type = other RNA
atgagcgaattcatcttcaacgacgtcccccaacgcaccacctcaaccttcgatcccgaagcagcctacgtcgccttcgaagcccgctacggccaagtcctcaacgcaggcgtcgtccgcgtcttcttcctcaaccaaaaaaaagccaaagacgtcctccgcaaaacctcccgccccatggtcgacctcaccttcggcggcgtccaattcgccatggtaaacaaccacttcccccaattccaatcaaaccccgtccccgacaacggcctcacccttcaccgcctatccggctacctcgcccgatgggcattcacccacatgcgatcccccatcaaacaagccgaattccgagccacagtcgtcgttcccctcgccgaagtcaaaggctgcacctggaacgacggcgacgccatgtacctcggcttcgcagccggcgccgaaatgttcctccaaaccttcaccttcttccccctcgtcatcgaaatgcaccgagtcctaaaagacggcatggacgtaaacttcatgaaaaaatttctccgccaacgctacggccaaaaaaccgccgaacaatggatgcgcgaagaaatcctcgccgtcaaagccgccttcgaatccgtcggcaccctcgcctgggcccgcaccggattctcccccgcagcacgcgacttcctccgccaattcgccatcggcatctaa

SEQ ID NO: 8246 - RNA, 696 nt, synthetic construct
  misc_feature 1..696: note = derived and/or modified CDS sequence (opt11) from OROV(H472433)__HQ830455.1__N
  source 1..696: mol_type = other RNA
atgtcagaattcatcttcaacgacgtcccgcaacgcaccacctccacattcgaccccgaagccgcctacgtcgccttcgaagcccgctacggacaagtactcaacgccggcgtcgtccgcgtcttcttcctcaaccaaaaaaaagccaaagacgtactccgcaaaacctcacgacccatggtagacctaaccttctcaggcgtccaattcgctatggtcaacaaccacttcccccaattccaatccaacccagtcccagacaacggcctcaccctccaccgcctatccggctacctcgcccgctgggccttcacccaaatgcgctcccccatcaaacaagccgaattccgagccaccgtcgtcgtaccactcgccgaagtaaaaggctgcacctggaacgacggcgacgccatgtacctcggcttcgccgcaggcgcagaaatgttcctccaaacattcaccttcttccccctagtcatcgaaatgcaccgcgtcctcaaagacggcatggacgtcaacttcatgaaaaaagtcctccgccaacgatacggccaaaaaacagccgaacaatggatgcgcgaagaaatagtcgcagtccgcgccgccttcgaagccgtaggcaccctagcctgggcccgcaccggcttctcccccgccgcccgcgatttcctccgacaattcggcatcggaatataa

SEQ ID NO: 8247 - RNA, 696 nt, synthetic construct
  misc_feature 1..696: note = derived and/or modified CDS sequence (opt11) from OROV(H532490)__HQ830463.1__N
  source 1..696: mol_type = other RNA
atgtccgaattcatattcaacgacgtaccccaacgcaccacatccaccttcgaccccgaagccgcttacgtatccttcgaagcacgttacggacaagtcctcaacgccggcgtcgtccgcgtattcttcctaaaccaaaaaaaagccaaagacgtcctccgcaaaacctcatcacccatggtcgatctcaccttcggcggagtccaattcgccatggtcaacaaccacttcccacaattccaatccaaccccgtccccgacaacggcctcaccctccaccgactctccggctacctagcccgctgggccttcacccaaatgcgcagccccatcaaacaagccgaattccgcgccaccgtcgtcgtccccctcgccgaagtcaaaggctgcacatggaacgacggcgacgccatgtacctcggcttcgcagccggcgccgaaatgttcctccaaaccttcacattcttccccctcgtcatcgaaatgcaccgagtcctcaaagacggcatggacgtcaacttcatgaaaaaagtcctccgccaacgctacggccaaaaaaccgccgaacaatggatgcgcgaagaaatcgtcgcagtcagagccgccttcgaagccgtcggcaccctcgcctgggctcgcaccggcttctcccccgccgcccgtgacttcctccgccaattcggcatcggcatctaa

SEQ ID NO: 8248 - RNA, 696 nt, synthetic construct
  misc_feature 1..696: note = derived and/or modified CDS sequence (opt11) from OROV(H543629)__HQ830467.1__N
  source 1..696: mol_type = other RNA
atgtccgaattcctcttcaacgacgtcccccaacgaaccacatccaccttcgaccccgaagccgcctacgtcgccttcgaagcacgctacggccaagtcctaaacgccggagtcgtccgcgtcttcttcctcaaccaaaaaaaagcaaaagacgtcctccgcaaaacctcccgccctatggtcgacctcaccttcggcggagtccaattcgccatggtcaacaaccacttcccccaattccaatccaaccccgtccccgacaacggcctcacactccaccgcctctcaggctacctcgcccgctgggccttcacccaaatgcgctccccaatcaaacaagcagaattccgcgcaaccgtcgtcgtccccctcgcagaagtcaaaggctgcacctggaacgacggcgacgccatgtacctcggcttcgccgcaggagccgaaatgttcctccaaaccttcaccttcttccccctcgtcatcgaaatgcaccgcgtactaaaagacggaatggacgtcaacttcatgaaaaaagtcctccgacaacgctacggccaaaaaaccgccgaacaatggatgcgcgaagaaatcgtcgccgttcgagccgccttcgaagccgtcggcaccctcgcctgggcccgcaccggtttctcaccagccggccgcgacttcctccgccaattcggcatcggcatctag

SEQ ID NO: 8249 - RNA, 696 nt, synthetic construct
  misc_feature 1..696: note = derived and/or modified CDS sequence (opt11) from OROV(H543638)__HQ830468.1__N
  source 1..696: mol_type = other RNA
atgtccgaattcctcttcaacgacgtcccccaacgcaccacctcaaccttcgaccccgaagccgcctacgtagccttcgaagcacgctacggacaagtcctcaacgccggcgtcgtccgagtattcttcctcaaccaaaaaaaagcaaaaaacgtcctccgcaaaacctcccgccccatggtcgacctcaccttcggcggagtccaattcgccatggtaaacaaccacttcccccaattccagtccaaccccgtccccgacaacggcctaaccctccaccgactctccggctacctcgcccgctgggccttcacacaaatgcgctcaccaatcaaacaagccgaattccgcgccaccgtcgtcgtccccctcgccgaagtcaaaggatgcacctggaacgacggagacgccatgtacctcggattcgccgccggcgccgaaatgttcctccaaaccttcaccttcttcccactcgtcatcgaaatgcaccgcgtcctcaaagacggcatggacgtcaacttcatgaaaaaagtcctccgtcaacgatacggccaaaaaaccgccgaacaatggatgcgcgaggaaatagtcgccgtccgcgccgccttcgaagccgtaggcaccctagcatgggcccgcacaggcttctcccccgccggccgagacttcctccgacaattcggcatcggaatctaa

SEQ ID NO: 8250 - RNA, 696 nt, synthetic construct
  misc_feature 1..696: note = derived and/or modified CDS sequence (opt11) from OROV(H706890)__HQ830473.1__N
  source 1..696: mol_type = other RNA
atggctgaattcatcttcaacgacgtcccacaacgaacaacctccaccttcgacccagaagccgcctacgtagccttcgaagcaagatacggccaagtcctcaacgcaggcgtcgtccgcgtcttcttcctcaaccaaaaaaaagccaaagacgtcctccgcaaaacctcccgtcccatggtcgacctcacattcggaggcgtccaattcgccatggtcaacaaccacttcccccaattccaatccaacccagtccccgacaacggcctaaccctccaccgcctctccggctacctcgcccgctgggccttcacccaaatgcgctcccccatcaaacaagccgaattccgcgccaccgtcgtcgtccccctagccgaagtcaaaggctgcacatggaacgacggcgacgccatgtatctcggcttcgccgccggagccgaaatgttcctccaaaccttcaccttcttccccctcgtaatcgaaatgcaccgcgtcctcaaagacggcatggacgtcaacttcatgaaaaaggtcctccgccaacgatacggccaaaaaacagccgaacaatggatgcgcgaagaaatcgtcgccgtccgcgcagccttcgaagccgtcggaaccctcgcctgggcccgcaccggcttctccccagcagcacgcgacttcctccgccaattcggcatcggcatataa

SEQ ID NO: 8251 - RNA, 696 nt, synthetic construct
  misc_feature 1..696: note = derived and/or modified CDS sequence (opt11) from OROV(H758669)__HQ830479.1__N
  source 1..696: mol_type = other RNA
atgtcagaattcatcttcaacgacgtcccccaacgcaccacctccaccttcgaccccgaagcagcctacgtcgccttcgaagcccgatacggccaagtcttaaacgccggcgtcgtccgcgtcttcttcctcaaccaaaaaaaagccaaggacgtcctccgcaaaacctcccgccccatggtcgacctcaccttcggcggcgtccaattcgccatactcaacaaccacttcccccaattccaaagcaaccccgtcccagacaacggcctcaccctccaccgcctctccggctacctagcacgctgggccttcacacaaatgcgctcacccatcaaacaagccgaattccgcgccaccgtcgtcgtacccctcgccgaagtcaaaggctgcacctggaacgacggcgacgccatgtacctcggcttcgccgccggcgccgaaatgttcctccaaaccttcaccttcttccccctcgtcatcgaaatgcaccgagtcctcaaagacggcatggacgtcaacttcatgaaaaaagtcctcagacaacgctacggccaaaaaaccgccgaacaatggatgcgcgaagaaatcgtcgccgtccgcgccgcctttgaagccgtcggcaccctcgcctgggcccgaaccggattctcccccgccgcccgcgacttcctacgccaattcggcatcggcatctaa

SEQ ID NO: 8252 - RNA, 696 nt, synthetic construct
  misc_feature 1..696: note = derived and/or modified CDS sequence (opt11) from OROV(H758687)__HQ830478.1__N
  source 1..696: mol_type = other RNA
atgtccgaattcatcttcaacgacgtcccccaacgaaccaccagcaccttcgaccccgaagccgcatacgtcgccttcgaagcccgctacggccaagtcctcaacgccggcgtcgtcagagtcttcttcctcaatcaaaaaaaagccaaagacgtcctccgcaaaacatcacgccccatggtcgacctcaccttcggaggcgtccaattcgccatggtcaacaaccacttcccccaattccaatccaacccagtccccgacaacggcctcaccctacaccgcctctccggctacctcgcccgatgggccttcacacaaatgcgctcccccatcaaacaagccgaattccgagcaaccgtcgtcgtccccctcgccgaagtaaaaggctgcacctggaacgacggcgacgccatgtacctcggcttcgccgccggagccgaaatgttcctccaaaccttcacctttttccccttcgtcatagaaatgcaccgcgtcctcaaagacggaatggacgtaaacttcatgaaaaaagtcctccgacaacgctacggacaaaaaaccgccgaacaatggatgcgagaagaaatcgtcgccgtccgcgccgccttcgaagccgtcggaaccctcgcctgggcccgcaccggcttctcccccgccgcacgcgacttcctccgccaattcggcataggcatctaa

SEQ ID NO: 8253 - RNA, 696 nt, synthetic construct
  misc_feature 1..696: note = derived and/or modified CDS sequence (opt11) from OROV(H759041)__HQ830488.1__N
  source 1..696: mol_type = other RNA
atgtcagaattcatcttcaacgacgtaccacaacgaaccacctcaaccttcgaccccgaagccgcctacgtcgcattcgaagcacgctacggccaagtcctcaacgcaggagtcgtacgcgtcttcttcctcaaccaaaaaaaagccaaagacgtcctccgcaaaacctcccgacccatggtcgacctcaccttcggcggcgtccaattcgccatggtaaacaaccacttcccccaattccaatccaaccccgtccccgacaacggcctcaccctccaccgcctctcaggctacctcgcccgctgggccttcacccaaatgcgaagccccatcaaacaagccgaattccgcgcaacagtagtcgtccccctcgccgaagtcaaaggatgcacctggaacgacggcgacgccatgtacctcggcttcgccgccggcgccgaaatgttcctgcaaaccttcaccttcttccccctcgtcatagaaatgcaccgcgtcctaaacgacggcatggacgtcaacttcatgaaaaaagtcctccgccaacgctacggccagaaaaccgccgaacaatggatgcgagaagaaatcgtagcagtccgcgccgccttcgaagccgtcggcaccctcgcctgggcacgcaccggcttctcccccgccgcccgcgacttcctacgccaattcggcatcggcatctaa

SEQ ID NO: 8254 - RNA, 696 nt, synthetic construct
  misc_feature 1..696: note = derived and/or modified CDS sequence (opt11) from OROV(BeAr473358)__AF164539.1__N
  source 1..696: mol_type = other RNA
atgtcagaattcatcttcaacgacgtcccccaacgaaccacctccaccttcgaccccgaagccgcctacgtcgccttcgaagcccgctacggccaagtcctgaacgcaggcgtcgtccgcgtcttcttcctcaaccaaaaaaaagccaaagacgtcctccgcaaaacctccagacccatggtcgacctaaccttcggcggcgtccaattcgccatggtcaacaaccacttcccccaattccaatccaaccccgtccccgacaacggcctcaccctccacagactctccggctacctcgcccgctgggccttcacccacatgcgctcccccatcaaacaagccgaattccgcgccaccgtcgtcgtccccctcgcagaagtcaaaggctgcacctggaacgacggcgacgccatgtacctcggcttcgccgccggcgccgaaatgttcctccaaaccttcacattcttcccactcgtcatcgaaatgcaccgagtcctcaaagacggaatggacgtcaacttcatgaaaaaaatcctccgccaaagatacggccaaaaaaccgccgaacaatggatgcgcgaagaaatcatcgccgtcaaaactgccttcgaaaccgtcggcaccctcgcctgggccatcaccggcttctcccccgccgcccgcaacttcctacgacaattcgaaatcgacatctag

SEQ ID NO: 8255 - RNA, 696 nt, synthetic construct
  misc_feature 1..696: note = derived and/or modified CDS sequence (opt11) from OROV(BeH 521086)__AY704559.1__N
  source 1..696: mol_type = other RNA
atgtcagaattcctcttcaacgacgtcccacaaagaacaacctccacattcgacccagaagccgcctacgtcgccttcgaatcacgctacggccaagtcctcaacgccggcgtcgtccgcgtcttcttcctaaaccaaaaaaaagccaaagacgtcctccgcaaaacctcccgcccaatggtcgacctaacattcggaggcgtccaattcaccatggtcaacaaccacttcccacaattccaatcaaacccagtccccgacaacggcctcaccctacaccgcctctccggctacctcgcccgctgggccttcacccaaatgaggagccccatcaaacaagccgaattccgcgccaccgtcgtcgtccccctcgccgaagtcaaaggctgcacctggaacgacggcgacgccatgtacctgggcttcgccgccggcgccgaaatgttcctccaaacattcaccttcttccccctcgtcatcgaaatgcaccgcgtccttaaagacggcatggacgtcaacttcatgaaaaaagtcctccgccaacgatacggccaaaaaaccgccgaacaatggatgcgagaagaaatcgtcgccgttcgcgccgcattcgaagccgtcggcacactcgcatgggcacgcaccggcttctcccccgccgcccgcgacttcctccgccaatccggcatcggcatataa

SEQ ID NO: 8256 - RNA, 696 nt, synthetic construct
  misc_feature 1..696: note = derived and/or modified CDS sequence (opt11) from OROV(BeH121923)__HM470110.1__N
  source 1..696: mol_type = other RNA
atgtccgaattcatcttcaacgacgtcccccaacgcaccacctcctccttcgaccctgaagccgcctacgtcgccttcgaagcccgctacggccaagtcctcaacgcctgcgtcgtccgcgtcttcttcctaaaccaaaaaaaagccaaagacgtactccgtaaaacctcatggccaatggtcgacctcaccttcggccgcgtccaattcgccatggtcaacaaccacttcccccaattccaatccaaccccgtccccgacaacggcctcgccctccaccgactctccggctacctagcccgatgggccttcacccaaatgcgctcccccatcaaacaagccgagttccgcgccaccgtcgtcgtccccctcgccgaagtcaaaggctgcacctggaacgacggcgacgccatgtacctcggcttcgccgcaggcgccgaaatgttcctccaaaccttcacattcttccccctcgtcatcgaaatgcaccgcgtcctcaaagacggcatggacgtcaacttcatgaaaaaagtcctccgccaacgatacggccaaaaaacagccgaacaatggatgcgcgaagaaatcgtagccgtcagagccgccttcgaagcagtcggcaccctcgcctgggcccgcaccggcttctcccccgccgcccgcgacttcctccgccaattcggcattgacatctaa

SEQ ID NO: 8257 - RNA, 696 nt, synthetic construct
  misc_feature 1..696: note = derived and/or modified CDS sequence (opt11) from OROV(BeH379693)__AF164534.1__N
  source 1..696: mol_type = other RNA
atgtccgaattcatcttcaacgacgtcccacaacgcacaacatccaccttcgaccccgaagccgcctacgtagccttcgaagcccgctacggccaagtcctcaacgccggcgtcgtacgcgtattcttcctcaaccaaaaaaaagccaaagacgtcctccgccgaacctcccgccccatggtcgacctcaccttcggcggagtacaattcgccatggtcaacaaccacttcccccaattccaatccaacccagtccccgacaacggcctcaccctacaccgcctctccggctacctcgcccgctgggccttcacccaaatgcgctcacccatcaagcaagccgaattccgcgccaccgtcgtcgtccccctcgccgaagtcaaaggctgcacctggaacgacggcgacgccatgtacctcggcttcgctgccggcgccgaaatgttcctccaaaccttcacattcttccccctagtcatcgaaatgcaccgcgtcctcaaagacggcatggacgtcaacttcatgaaaaaagtcctccgccaacgctacggccaaaaaaccgccgaacaatggatgcgcgaagaaatcgtcgccgtccgcgccgccttcgaagccgtcggcacactcgcctgggcccgcaccggattctcgcccgccgcccgcgacttcctccgacaattcggcatcggaatctaa

SEQ ID NO: 8258 - RNA, 696 nt, synthetic construct
  misc_feature 1..696: note = derived and/or modified CDS sequence (opt11) from OROV(BeH381114)__AF164535.1__N
  source 1..696: mol_type = other RNA
atgtctgaattcatcttcaacgacgtcccccaacgcaccacctccaccttcgaccccgaagccgcctacgtcgccttcgaagcccgatacggccaagtcctaaacgccggagtagtacgcgtcttcttcctcaaccaaaaaaaagccaaagacgtcctccgcaaaacatcacgccccatggtcgacctcaccttcggcggcgtccaattcgccatggtcaacaaccacttcccccaattccaatccaaccccgtccccgacaacggcctcaccctacaccgcctctcaggctacctcgcccgctgggccttcacccaaatgcgctcacccatcaaacaagccgaattccgcgccaccgtcgtcgtccccctcgccgaagtaaaaggctgcacatggaacgacggcgacgccatgtacctcggattcgccgccggcgcagaaatgttcctccaaacattcaccttcttccccctcgtcatcgaaatgcaccgcgtccttaaagacggcatggacgtcaacttcatgaaaaaagtactccgccaacgctacggccaaaaaaccgccgaacaatggatgcgcgaagaaatcgtcgccgtacgcgcagccttcgaagccgtcggcacactcgcctgggcccgaaccggcttctcccccgccgcccgcgacttcctacgccaattcggcatctgcatctag

SEQ ID NO: 8259 - RNA, 696 nt, synthetic construct
  misc_feature 1..696: note = derived and/or modified CDS sequence (opt11) from OROV(BeH390233)__AF164536.1__N
  source 1..696: mol_type = other RNA
atgtccgaattcatcttcaacgacgtcccccaacgcaccacctccaccttcgaccccgaagccgcctacgtcgccttcgaagcccgctacggccaagtactcaacgccggcgtagtccgcgtcttcttcctcaaccaaaaaaaagccaaagacgtcctccgcaaaacatcccgcccaatggtcgacttaaccttcggaggcgtccaattcgccatggtcaacaaccacttcccccaattccaatccaaccccgtccccgacaacggcctaaccctccaccgcctctccggctacctcgcccgctgggcattcacccaaatgcgctcccccatcaaacaagccgaattccgcgccaccgtcgttgtacccctcgccgaagtcaaaggctgcacctggaacgacggcgacgccatgtacctcggcttcgccgccggagccgaaatgttcctccaaaccttcaccttcttccccctcgtcatcgaaatgcaccgcgtcctcaaagacggcatggacgtcaacttcatgaaaaaagtcctaagacaacgctacggacaaaaaaccgccgaacaatggatgcgcgaagagatagtcgccgtacgcgccgcattcgaagccgtcggcaccctcgcctgggcacgcaccggcttctccccagccgcccgcgacttcctcggccaattcggcatcggcatctaa

SEQ ID NO: 8260 - RNA, 696 nt, synthetic construct
  misc_feature 1..696: note = derived and/or modified CDS sequence (opt11) from OROV(BeH472204)__AF164538.1__N
  source 1..696: mol_type = other RNA
atgagcgaattcatcttcaacgacgtcccccaacgcaccacctccaccttcgacccagaagccgcctacgtcgccttcgaagcccgctacggccaagtcctcaatgccggcgtcgtccgcgtcttcttcctcaaccaaaaaaaagcaaaagacgtcctccgcaaaacctcccgaccaatggtcgacctaaccttcggcggcgtccaatttgcaatggtcaacaaccacttcccccaattccaatcaaaccccgtccccgacaacggcctcaccctccaccgcctgtccggctacctagcccgatgggccttcacccaaatgcgctcccccatcaaacaagccgaattccgcgccacagtcgtcgtccccctcgccgaagtcaaaggctgcacatggaacgacggcgacgccatgtacctcggcttcgccgccggcgcagaaatgttcctccaaaccttcaccttcttccccctagtaatcgaaatgcaccgcgtcctaaaagacggcatggacgtcaacttcatgaaaaaagtcctccgccaacgctacgtccaaaaaaccgccgaacaatggatgcgagaagaaatcgtcgccgtccgcgccgccttcgaagccgtaggcaccctagcctgggcccgcaccggcttctcacccgccgcacgagacttcctccgccaattcggcatcggcatctaa

SEQ ID NO: 8261 - RNA, 696 nt, synthetic construct
  misc_feature 1..696: note = derived and/or modified CDS sequence (opt11) from OROV(BeH505442)__AF164542.1__N
  source 1..696: mol_type = other RNA
atgtcagaattcatcttcaacgacgtcccccaacgcaccacctccaccttcgacccagaagccgcatacgtcgccttcgaagcccgctacggccaagtactcaacgccggcgtcgtccgagtcttcttcctaaaccaaaaaaaagccaaagacgtcctacgaaaaaccagccgcccaatggtcgacctcaccttcggcggcgtacaattcgccatggtcaacaaccacttcccccaattccaaagcaaccccgtccccgacaacggcctcacactgcaccgcctctcaggctacctcgcccgctgggccttcacccaaatgcgcagccccataaaacaagcagaattccgcgccaccgtcgtagtccccctcgccgaagtcaaaggctgcacctggaacgacggcgacgccatgtacctcggcttcgccgccggcgccgaaatgttcctccaagccttcaccttcttccccctagtcatcgaaatgcaccgcgtccttaaagacggcatggacgtaaacttcatgaaaaaagtcctccgccaacgctacggacaaaaaaccgccgaacaatggatgcgcgaagaaatcgtcgccgtcagagcagccttcgaagccgtcggcaccctagcctgggcccgcaccggcttctcccccgccgcccgcgacttcctacgccaattcggcatcgacatctaa

SEQ ID NO: 8262 - RNA, 696 nt, synthetic construct
  misc_feature 1..696: note = derived and/or modified CDS sequence (opt11) from OROV(BeH541863)__AF164544.1__N
  source 1..696: mol_type = other RNA
atgagcgaattcatcttctcagacgtcccccaacgcaccacctccactttcgaccccgaagccgcctacgtcgccttcgaagcccgctacggccaagtactcaacgccggcgtcgtccgagtcttcttcctcaaccaaaaaaaagccaaagacgtcctccgaaaaacctcccgccccatggtcgacctcaccttcggcggcgtacaattcgccatggtcaacaaccacttcccccaattccaatccaacccagtccccgataacggcctaaccctacaccgactttccggctacctcgcacgctgggccttcacccaaatgcgctcccccatcaaacaagcagaattccgcgccaccgtcgtcgtacccctcgccgaagtcaaaggctgcacctggaacgacggtgacgccatgtacctcggtttcgccgccggcgccgaaatgttcctccaaacattcaccttcttccctctcgtcatcgaaatgcaccgcgtcctcaaagacggcatggacgtcaacttcatgaaaaaagtcctacgacaacgctacggccaaaaaaccgccgaacaatggatgcgcgaagaaatcgtcgcagtacgagccgccttcgaagccgtcggaaccctcgcctgggcccgcacaggcttctcccccgcagcccgcaacttcctccgccaattcggcatcggaatctaa

SEQ ID NO: 8263 - RNA, 696 nt, synthetic construct
  misc_feature 1..696: note = derived and/or modified CDS sequence (opt11) from OROV(BeH543033)__AF164545.1__N
  source 1..696: mol_type = other RNA
atgtccgaattcatcttcaacgacgtcccacaacgcaccacctccaccttcgaccccgaagccgcctacgtcgccttcgaagcccgatacggacaagtcctcaacgccggagtcgtccgcgtcttcttcctaaaccaaaaaaaagccaaagacgtcctccgcaaaacctcacgccccatggtagacctaacattcggcggcgtccaattcgccatggtcaacaaccacttcccacaattccaatccaacccagtccccgacaacggcctcaccctccaccgcctctccggctacctcgcccgctgggccttcacacaaatgcgctcacccatcaaacaggccgaattccgcgccaccgtcgtcgtccccctcgcagaagtcaaaggctgcacctggaacgacggcgacgccatgtacctcggcttcgccgccggcgcagaaatgtttctccaaaccttcacattcttccccctcgtaatcgaaatgcaccgcgttctcaaagacggcatggacgtcaacttcatgaaaaaagtcctccgccaacgatacggccaaaaaaccgccgaacaatggatgcgagaagaaatcgtcgccgtccgcgccgccttcgaagccgtcggcaccctcgcctgggcccgcaccggcttctcccccgccgcccgcgaattcctccgccaattcggcatcggcatctaa

SEQ ID NO: 8264 - RNA, 696 nt, synthetic construct
  misc_feature 1..696: note = derived and/or modified CDS sequence (opt11) from OROV(BeH543618)__AF164548.1__N
  source 1..696: mol_type = other RNA
atgcaagaattcatcttcaacgacgtcccccaacgaaccacctccaccttcgaccccgaagccgcctacgtcgccttcgaagcccgctacggacaagtcctaaacgccggcgtcgtacgagtcttcttcctaaaccaaaaaaaagccaaagatgtactccgcaaaaccagccgaccaatggtcgacctcacattcggcggcgtacaattcgcaatggtcaacaaccacttcccccaattccaatccaaccccgtccccgacaacggcctcaccctccaccgcctctccggctacctcgcccgctgggccttcacccaaatgcgctccccaatcaaacaagccgaattccgagccaccgtcgtcgtccccctcgcagaagtcaaaggctgcacctggaacgacggcgacgccatgtacctcggcttcgccgccggcgccgaaatgttcctacaaaccttcaccttcttccccctcgtaatcgaaatgcaccgcgtcctcaaagacggcatggacgtcaacttcatgaaaaaagtcctccgccaacgctacggccaaaaaaccgccgaacaatggatgagagaagaaatcgtcgccgtccgcgccgccttcgaagccgtcggcaccctagcctgggcccgcacaggcttctcccccgcagcccgcgactttctccgccaattcggcatcggcatctaa

SEQ ID NO: 8265 - RNA, 696 nt, synthetic construct
  misc_feature 1..696: note = derived and/or modified CDS sequence (opt11) from OROV(BeH544552)__AF164546.1__N
  source 1..696: mol_type = other RNA
atgtccgaattcatattcaacgacgtcccccaacgcaccacatccacattcgaccccgaagccgcctacgtcgccttcgaagcccgctacggacaagtcctcaacgccggcgtcgtccgcgtcttcttcctcaaccaaaaaaaagcaaaagacgtcctccgcaaaacctcccgccccatggtcgacctcaccttcggcggcgtccaattcgcaatggtaaacaaccacttcccccaattccaatccaaccccgtccccgacaacggcctcaccctccaccgcctctcaggctacctagcccgctgggccttcacccaaatgcgctcacccatcaaacaagccgaattccgcgccaccgtagtcgtacccctcgccgaagtaaaaggctgcacctggaacgacggcgacgcaatgtacctcggcttcgccgccggcgccgaaatgttcctccaaaccttcaccttcttccccctcgtcatagaaatgcaccgagtactcaaagacggaatggacgtcaacttcatgaaaaaagtcctacgccaacgctacggccaaaaaaccgccgaacaatggatgcgcgaagaaatcgtcgccgtcagagccgccttcgaagccgtcggcaccctcgcctgggcccgcaccggcttctcacccgccgcccgcgacttcctaagacaaatcggcataggcatctaa

SEQ ID NO: 8266 - RNA, 696 nt, synthetic construct
  misc_feature 1..696: note = derived and/or modified CDS sequence (opt11) from OROV(GML444911)__AF164556.1__N
  source 1..696: mol_type = other RNA
atgtccgaattcatcttcaacgacgtcccccaacgcaccacctccaccttcgaccccgaagcagcctacgtcgccttcgaagcccgctacggccaagtcctcaacgccggcgtagtccgcgtcttcttcctcaaccaaaaaaaagccaaagacgtcctccgcaaaacctcccgccccatggtcgacctcaccttcggcggcgtccaattcgccatggtcaacaaccacttcccccaattccaatccaaccccgtccccgacaacggcctcacactccaccgcctctcaggctacctagcacgatgggcattcacccaaatgcgatccccaatcaaacaagcagaattccgcgccacagtagtagtccccctcgccgaagtcaaaggctgcacatggaacgacggcgacgccatgtacctaggcttcgccgccggcgccgaaatgttcctccaaaccttcaccttcttccccctcgtcatcgaaatgcaccgagtcctcaaagacggcatggacgtcaacttcatgaaaaaagtcctccgccaaagatacggccaaaaaaccgccgaacaatggatgcgcgaagaaatcgtcgccgtccgagccgcattcgaagcagtcggaacactcgcctgggcccgcaccggcttctcccccgcagcccgcgacttcctacgccaattcggcatctacatctaa

SEQ ID NO: 8267 - RNA, 696 nt, synthetic construct
  misc_feature 1..696: note = derived and/or modified CDS sequence (opt11) from OROV(IQT4083)__AF164552.1__N
  source 1..696: mol_type = other RNA
atgtccgaattcatcttcaacgacgtcccccaacgcaccacatcaaccttcgaccccgaagccgcctacgtagccttcgaagcccgctacggccaagtcctcaacgccggcgtcgtccgcgtctttttcctaaaccaaaaaaaagccaaagacgtcctccgcaaaacctcccgccccatggtcgacctcaccttcggcggcgtacaattcgccatggtcaacaaccacttcccccaattccaatccaaccccgtccccgacaacggactaaccctccaccgactatccggctacctcgcccgctgggccttcacccaaatgcgatcccccatcaaacaagccgaattccgcgccaccgtcgtcgtccccctcgccgaagtcaaaggctgcacctggaatgacggcgacgccatgtacctaggcttcgccgccggcgccgaaatgttcttacaaactttcaccttcttcccactagtcatcgaaatgcaccgagtcctcaaagacggcatggacgtaaacttcatgaaaaaagtcctccgccaacgctacggaaaaaaaaccgccgaacaatggatgcgcgaagaaatagtagcagtccgagccgccttcgaagccgtcggcaccctcgcctgggcccgcaccggcttctcacccgccgcccgcgacttcctacgccaattcggaatagacatctaa

SEQ ID NO: 8268 - RNA, 696 nt, synthetic construct
  misc_feature 1..696: note = derived and/or modified CDS sequence (opt11) from OROV(PPS 522 H 669314)__EF467370.1__N
  source 1..696: mol_type = other RNA
atgtcagaattcatctccaacgacgtcccacaccgcaccacctccaccttcgacccagaagccgcctacgtcgccttcgaagccagatacggccaagtcctcaacgccggcgtcgtccgcgtattcttcctcaaccaaaaaaaagccaaagacgtcctacgcaaaacctcccgacccatggtcgacctaaccttcggcggcgtccaattcgccatggtcaacaaccacttcccacaattccaatccaacccagtccccgacaacggcctcaccctccaccgcctatccggctacctagcccgctgggccttcacccaaatgcgctcccccatcaaacaagccgaattccgcgccaccgtcgtagtccccctcgccgaagtcaaaggctgcacctggaacgacggcgacgccatgtacctcggcttcgccgccggcgccgaaatgttcctccaaaccttcaccttcttccccctcgtcatcgaaatgcaccgcgtcctcaaagacggcatggacgtaaacttcatgaaaaaagtcctccgccaacgctacggccaaaaaaccgccgaacaatggatgagagaagaaatcgtcgccgtccgcgcagccttcgaagccgtcggcaccctcgcctgggcccgaaccggcttctcccccgcagcccgcgacttcctacgccaattcggcatatgcatctaa

SEQ ID NO: 8269 - RNA, 696 nt, synthetic construct
  misc_feature 1..696: note = derived and/or modified CDS sequence (opt11) from OROV(TVP-19254/GML-480914)__KP795083.1__N
  source 1..696: mol_type = other RNA
atgtccgaattcatcttcaacgacgtcccccaacgaacaacatccaccttcgaccccgaagccgcctacgtcgccttcgaagcacgctacggccaagtcctctccgccggcgtcgtccgagtattcttcctcaaccaaaaaaaagccaaagacgtcctccgcaaaacatcccgcccaatggtcgacctcaccttcggcggcgtacaattcgccatggtcaacaaccacttcccccaattccaatcaaaccccgtccccgacaacggcctaaccctacaccgtctctccggttacctcgcccgctgggccttcacccaaatgcgatcccccatcaaacaagccgaattccgcgccaccgtagtagtccccctcgccgaagtcaaaggctgcacctggaacgacggcgacgccatgtacctcggattcgccgccggcgccgaaatgttcctccaaaccttcacgttcttccccctcgtcatcgaaatgcaccgcgtcctaaaagacggcatggacgtcaacttcatgaaaaaagtcctacgccaacgctacggccaaaaaaccgccgaacaatggatgcgagaagaaatcgtagcagtccgcgccgccttcgaagccgtcggcaccctagcctgggcccgcaccggcttctcccccgccgcccgagacttcctccgccaattcggcatcgacatctaa

SEQ ID NO: 8270 - RNA, 696 nt, synthetic construct
  misc_feature 1..696: note = derived and/or modified CDS sequence (opt11) from OROV(TVP-19256/IQE-7894)__KP795086.1__N
  source 1..696: mol_type = other RNA
atgtccgaattcatcttcaacgacgtaccccaacgcaccacctcaaccttcgaccccgaagccgcctacgtcgccttcgaagcccgatacggccaggtcctcaacgccggcgtagtcagagtcttcttcctcaaccaaaaaaaagccaaagacgtcctacgcaaaacctcacgccccatggtcgacctcactttcggcggcgtccaattcaccatggtcaacaaccacttcccacaattccaatcaaaccccgtcccagacaacggactaaccctccaccgcctctccggctacctcgcccgctgggccttcacacaaatgcgctcacccatcaaacaagccgaattccgagccaccgtcgtcgtcccactggccgaagtcaaaggctgcacctggaacgacggcgacgccatgtacctcggattcgccgccggcgctgaaatgttcctccaaaccttcacattcttccccctcgtcatcgaaatgcaccgcgtcctcaaagacggcatggacgtcaacttcatgaaaaaagtcctccgccaacgatacggccaaaaaaccgccgaacaatggatgcgcgaagaaatcgtcgcagtccgcgctgccttcgaagccgtcggcaccctagcctgggcacgcaccggcttctcccccgccgcccgcgacttcctacgccaattcggaatcgacatctaa

SEQ ID NO: 8271 - RNA, 696 nt, synthetic construct
  misc_feature 1..696: note = derived and/or modified CDS sequence (opt11) from OROV(TVP-19258/IQT-4083)__KP795092.1__N
  source 1..696: mol_type = other RNA
atgtccgaattcatcttcaacgacgtaccccaacgcaccacctccaccttcgaccccgaagcagcctacgtcgccttcgaagcccgatacggccaagtcctcaacgccggagtcgtccgcgtattcttcctcaaccaaaaaaaagccaaagacgtcctacgaaaaacctcacgacccatggtagacctaaccttcggtggcgtccaattcgccatggtcaacaaccacttcccacaattccaaagcaaccccgtccccgacaacggcctcaccctccaccgcctctccggatacctcgcccgatgggccttcacccaaatgcgctcccccatcaaacaagccgaattccgcggaaccgtcgtcgtccccctagccgaagtcaaaggatgcacctggaacgacggcgacgccatgtacctcggcttcgccgccggcgccgaaatgttcctccaaactttcaccttcttcccactcgtcatcgaaatgcaccgcgtcctcaaagacggcatggacgtcaacttcatgaaaaaagtcctccgacaacgctacggacaaaaaaccgccgaacaatggatgagagaagaaatcgtcgccgtccgagccgccttcgaagcggtcggcaccctcgcctgggcccgcaccggcttctcccccgccgcccgcgacttcctcagacaattcggcatcgacatctga

SEQ ID NO: 8272 - RNA, 699 nt, synthetic construct
  misc_feature 1..699: note = derived and/or modified CDS sequence (opt11) from OROV/FPV(Aus Ch 16129)__AF362400.1__N
  source 1..699: mol_type = other RNA
atgacagacttcgtcttcaacgacgtcccccaacgagccacctcaacattcgacccagaagcagcctacgtcgccttcgaaaaccgcttccgcgccaacctcaccgtcgacgtcgcccgcatcttcttcctcaaccaaaaaaaagcaaaagaccgcctcgcaaaaaccgcccgcgccaccgtagacataacattcggcggcgtcgtcttccccgtcgtaaacaatcactaccccgaataccaacgcaaccccgtaccagacgacggcctcaccctacaccgcctatccggctacctagcccgatggctcatcgaccaatgcaacgcatcccccgtccgcatgaccgaaatacgcacaaaagtaatcatccccctcgccgaagtcaaaggctgcacctggaacgacggcgccagcatgtacctcggcttcgccgcaggcgccgaaatgttcctccaatccttcaccttctaccccctcgtcatagaaatgcaacgcgtcctaaaagacggcatggacgtcaacttcatgcgcaaagtcctcagacaacgctacggcaccaaaaccgccgaacaatggatgcgcgacgacatagtcgccgtcaaaaccgcattcgaagccatcaacaccatctcctgggcccgctcaggcttctcccccgccgcccgcgaattcctccgccaattcggcatcaacatctaa

SEQ ID NO: 8273 - RNA, 696 nt, synthetic construct
  misc_feature 1..696: note = derived and/or modified CDS sequence (opt11) from OROV/IQTV(IQE3728/PER/06)__KF150535.1__N
  source 1..696: mol_type = other RNA
atgtccgaattcatcttcaacgacgttccccaacgcaccacctccaccttcgacccagaagcagcctacgtcgccttcgaagcccgctacggacaagtcctcaacgcaggcgtcgtccgcgtattcttcctaaaccaaaaaaaagccaaagacgtcctccgcaaaacctcccgccccatggtcgacctcaccttcggcggcgtccaattcgccatggtcaacaaccacttcccccaattccaatccaaccccgtccccgacaacggcctcaccctccaccgactctcaggatacctcgcccgctgggctttcacacaaatgagatcccccatcaaacaagccgaattccgcgccaccgtcgtcgtacccctcgccgaagtcaaaggctgcacctggaacgacggcgacgccatgtacctaggcttcgcagccggcaccgaaatgttcctccaaaccttcaccttcttccccctcgtcatcgaaatgcacagagtcctcaaagacggcatggacgtcaacttcatgaaaaaagtcctccgccaacgatacggccaaaaaaccgcagaacaatggatgcgagaagaaatcgtcgccgtccgcgccgccttcgaagccgtcggcaccctcgcctgggcccgcacaggcttctcccccgccgccagagacttcctacgccaattcggaatcggaatctaa

SEQ ID NO: 8274 - RNA, 699 nt, synthetic construct
  misc_feature 1..699: note = derived and/or modified CDS sequence (opt11) from OROV/UTIV(Be An 84785)__KF697156.1__N
  source 1..699: mol_type = other RNA
atggccgaattcgtcttcaacgacgtgccccaacgctccacctcaaccttcgaccccgaagtcgcctacgccacattcgaagccgcattccgccaaaccctcaacgtcaacgtcgtccgagtcttcttcctcaaccaaaaaaacgccaaaaacgtcctccgcaaaacatcccgccccaacgtcgacctcaccttcggaggcgccaccttccccatagtcaacaaccacttcccccaattccaatccaaccccgtccccgacaacggcctcaccctccaccgcctcagcggctacctcgcccgctggtccatggaccaaatgcgcacaaaccccatccgccaagccgaattccgcgccgccgtcgtagtccccctcgccgaaatcaaaggctgcacctggaacgacggcgacgccatgtacctcgccttcgccgcaggagcagaaatgttcctcaacaccttcaccttcttccccctcgtcatcgaaatgcaccgagtcctcaaagacggcatggacgtcaacttcatgcgcaaagtcctccgccaacgctacggcaccaaaaccgccgaacaatggatgaaagacgaaataatccccatcaaagccgccttcgaagccgtcggaatgctatcatgggcccgcaccggcttctcccccgcagcccgcgacttcctccgccaattcggcatcaacgtctaa

SEQ ID NO: 8275 - RNA, 738 nt, synthetic construct
  misc_feature 1..738: note = derived and/or modified CDS sequence (opt11) from HRTV(TN)__KJ740146.1__N
  source 1..738: mol_type = other RNA
atgaccgactggtcggccatagccgtggaaataggcaacgaaccgctagacgtcccggccctggtcgagttcgcgaaagagatcgcgtacgagggcctggacccggccgtgatcttgggcttgctcagggaaaggggcggagaaaattggaggaacgacgtcaaatacataatcgtgttcgcgctcacgcgcgggaacaagatagtgaaagcgtgcgggaaaatgagtaagaaaggggccgagcgaatgaccaacctcgcgcgcgtgtacgagctcaaggaaaatgccgtggacaggatggcggtcacgcccgtgcgtgtggcccagtgcctacccacatggacgtgcgcagccgcggccgcgatcaaggaatacctcccggtcgggcccgcgatcatgcacaacaaaatacaagggtacccactagagatgatgtgcatggccttcggctcgctcataccccaggccgacgtctcgatcgaggtcataaaagatttcatggacgcgtactcgctctggcaagatacctttgccaggaccataaacgtagaccagcgcaagatgacgaaagcggaagtatacgcgaaattccgcgacccactgcacgcggccgtgaacagcctcttcttcccaaacgcaaccaggatctcgtggctgcaagcgaaagggctcctgaccgcaaccaaggaagcgtcggggagcgtgaaagcggccgcggccgcgtacaggaacatgtga

SEQ ID NO: 8276 - RNA, 738 nt, synthetic construct
  misc_feature 1..738: note = derived and/or modified CDS sequence (opt11) from HRTV(Patient1)__JX005842.1__N
  source 1..738: mol_type = other RNA
atgaccgactggtcggccatagcagtggaaataggcaacgaaccgctcgacgtcccagccctggtcgagttcgcaaaagagattgcgtacgagggcctggacccggccgtgatcttcggcttgctcagggaaaggggcggagaaaactggaggaacgacgtcaaatacataatcgtgttcgcgctcacgcgagggaacaagatcgtaaaagcgtgcggaaaaatgagcaagaaaggagcagaacgcatgacaaatctagcgcgagtgtacgagctcaaggaaaacgccgtggacaggatggcagtcacgcccgtgcgagtggcacagtgcttgcccacgtggacatgcgcggccgcggccgcgatcaaggaatatctcccagtcgggcccgcgataatgcacaacaaaatacaagggtacccgctcgagatgatgtgcatggcctttggctcgctcataccacaggccgacgtatcgatcgaggtcataaaagacttcatggacgcgtactcgctctggcaagacacctttgccaggacaataaacgtggaccagcgcaagatgacgaaagcggaagtctacgcgaaattccgcgacccactgcacgcggcagtgaactcactctttttcccgaacgcgaccaggatctcgtggctgcaagcaaaagggctcctgaccgcgaccaaggaagcgagcgggagcgtgaaagcggccgcggccgcgtacagaaacatgtga

SEQ ID NO: 8277 - RNA, 738 nt, synthetic construct
  misc_feature 1..738: note = derived and/or modified CDS sequence (opt11) from HRTV(Patient2)__JX005843.1__N
  source 1..738: mol_type = other RNA
atgaccgactggtcggcaatagccgtggaaataggcaacgaaccactcgacgtaccggccttggtcgagttcgcgaaagagatcgcgtacgagggcttagacccggccgtgatattgggcctgctcagggaaaggggcggagaaaactggaggaacgacgtcaagtacataatcgtattcgcgctaacgcgcgggaacaagatcgtgaaagcgtgcgggaaaatgagcaagaaaggggccgagcgaatgaccaatctcgcacgagtgtacgagctcaaagaaaacgccgtggacagaatggcggtcacgcccgtacgagtggcccagtgcctgcccacatggacatgcgcggcagcggccgccatcaaggaatacctcccggtcgggcccgcaatcatgcacaacaaaatacaagggtacccgctcgagatgatgtgcatggccttcggctcgctcataccccaggccgacgtctcgatcgaagtcataaaagacttcatggacgcgtactcactatggcaagacacattcgccaggaccataaacgtagaccagcgcaagatgacgaaagcagaagtgtacgcgaaatttcgcgaccccctgcacgcggccgtaaactcactcttcttcccgaacgcgaccagaatctcgtggctgcaagcgaaagggctcctgaccgcgaccaaggaagcgagcggaagcgtcaaagcggccgcggccgcgtaccggaacatgtga

SEQ ID NO: 8278 - RNA, 732 nt, synthetic construct
  misc_feature 1..732: note = derived and/or modified CDS sequence (opt11) from PTV(PAN472868)__NC_027202.1__N
  source 1..732: mol_type = other RNA
atgtcctacgaagaaatcgccgtccaattcgcatccgaatcaatcgacgaacaagcagtcgccggctgggtaaccgacttcgcataccaaggcttcgacgccaaacgcgtcatcgcccttgtcaaagaccgcggcggcgaagactggaaacaagacgtcaaaaaaatgatagtcctatcactcacacgcggcaacaaaccaaacaaaatggtcctcaaaatgtccgacaaaggcaaagccatggtcaacgaactcgtcctaaaatacaaactcaaatccggcaacccctcccgcgacgacctcaccctatcccgcataaccgccgcattcgccggctggacctgccaagccgccgactacgtccaagaatacctacccgtcaccggccgcgccatggacgcaatctcctcatcctacccccgagcaatgatgcaccccagcttcgccggcctcatcgaccaagaactccccgccgacgtcctttcagaaatcacacaagcacactgcctcttcatgatacaattctccaaaaccatcaacccctccctccgcggcctctccaaagacgaaatcgtctcatccttcgaacgccccatgcaagccgccatctcatccaccttcctcacctctgcaaaccgccgagcaatgctcaaaaccctcggcatcatcaacgacaacctaaaaccctcctcctccaccgtttcagccgccaaagtcttccgctccctctaa

SEQ ID NO: 8279 - RNA, 732 nt, synthetic construct
  misc_feature 1..732: note = derived and/or modified CDS sequence (opt11) from PTV(Adames)__KR912210.1__N
  source 1..732: mol_type = other RNA
atgtcttacgaagaaatcgccgtacaattcgccagcgaatccatcgacgaacaagcagttgcaggatgggtcaccgacttcgcctaccaaggcttcgacgcaaaacgagtcatcgccctcgtcaaagagcgcggcggcgaagactggaaacaagacgtcaagaaaatgatcgtcctctcactcacccgaggcaacaaacccaacaaaatggtcctaaaaatgtccgacaaaggcaaagccatggtcaacgaactcgtcctcaaatacaaactcaaatccggcaacccctcccgagacgacctaaccctctcccgcatcaccgcagccttcgccggctggacatgccaagccgccgactacgtacaagaatacctccccgtaaccggccgcgccatggacaccatctcctcaggctacccacgtgccatgatgcacccctcattcgccggcctcatcgaccaagaactacccgccgacgtcctctccgaaatcacccaagcccactgcctcttcatgatccaattctccaaaaccatcaacccctccctccgaggactctctaaagacgaaatcgtctcctcattcgaacgccccatgcaagccgccatctcatccaccttcctaacctccgccaaccgacgcgccatgctcaaaaccctcggaatcatcaacgacaacctaaaaccctcatcatccaccgtctcagccgccaaagtcttccgctccctctaa

SEQ ID NO: 8280 - RNA, 732 nt, synthetic construct
  misc_feature 1..732: note = derived and/or modified CDS sequence (opt11) from PTV(Balliet)__KR912211.1__N
  source 1..732: mol_type = other RNA
atgtcatacgaagaaatcgccgtccaattcgcttccgaatccatcgacgaacaaaccgtagccggctgggtcaccgacttcgcataccaaggcttcgacgcaaaaagagtaatcgccctcgtcaaagaccgcggcggagaagactggaaacaagacgtcaaaaagatgatcgtactctccctcacccgcggcaacaaacctaacaaaatgattctcaaaatgtccgacaaaggcaaagccatggtcaacgaactcgtcctaaaatacaaactcaaatccggcaacccctcccgcgacgacctcacactctcccgaatcaccgcagccttcgccggctggacctgccaagccgcagactacgtccaagaatacctcccagtcaccggccgcgccatggacgccatctcctcctcctacccccgcgccatgatgcacccctccttcgccggcctcatcgaccaagaactccccgccgacgtcttctccgaaatcacacaagcccactgcctcttcatgatccaattctccaaaaccatcaacccctccctccgcggcctcagcaaagacgaaatcgtctcctccttcgaaagacccatgcaagccgccatctcctccaccttcctcacctccgccaaccgccgcgccatgctaaaaaccctcggaatcatcaacgacaacctcaagccctcctccagcaccgtctccgccgccaaagtcttccgctccctataa

SEQ ID NO: 8281 - RNA, 732 nt, synthetic construct
  misc_feature 1..732: note = derived and/or modified CDS sequence (opt11) from PTV(PaAR2381)__KP272006.1__N
  source 1..732: mol_type = other RNA
atgtcctacgaagaaatcgccgtccaattcgccagcgaatccatcgacgaacaagccgtcgccggatgggtcaccgacttcgcctaccaaggattcgacgccaaacgagtcatcgccctagtcaaagaccgaggcggcgacgactggaaacaagacgtcaagaaaatgatcgtcctatccctcacacgcggcaacaaaccaaacaaaatggtcctaaaaatgagcgacaaaggcaaagccatggtcaacgaactcgtcctcaaatacaaactcaaatccggcaacccctcccgagacgacctcaccctatcccgcataaccgccgccttcgccggctggacctgccaagcagccgactacgtccaagaatacctccccgtcaccggccgcgccatggacgccatctcctcatcctaccccagagccatgatgcacccctcattcgccggcctcatcgaccaagaactcccagccgacgtcctttccgaaatcacccaagcacactgcctcttcatgatccaattctccaaaaccatcaaccccagcctccgcggcctctcaaaagacgaaatcgtctcctccttcgaacgacccatgcaagccgccatctcctccaccttcctaacatccgccaaccgacgcgccatgctaaaaaccctcggcatcatcaacgacaacctaaaacccagctcctcaaccgtcagcgccgccaaagtcttccgctccctctaa

SEQ ID NO: 8282 - RNA, 732 nt, synthetic construct
  misc_feature 1..732: note = derived and/or modified CDS sequence (opt11) from PTV(GML902876)__KP272012.1__N
  source 1..732: mol_type = other RNA
atgtcatacgaagaaatcgcagtccaattcgcctccgaatccatcgacgaacaagccgtcgccggctgggtaaccgacttcgcctaccaaggcttcgacgccaaacgcgtaatagcactagtcaaagaccgcggcggagacgactggaaacaagacgtcaaaaaaatgatcgtcctttccctcacccgcggcaacaaacccaacaaaatggtcctcaaaatgtccgacaaaggcaaagcaatggtaaacgaactagtcctcaaatacaaactcaaatctggcaacccatcacgagacgacctcaccctatcccgcatcaccgccgcattcgccggctggacctgccaagcagccgactacgtccaagaatacctccccgtcaccggccgtgcaatggacgccatctcctcctcctacccccgcgcaatgatgcacccatccttcgccggcctcatcgaccaagaactccccgcagacgtcctatccgaaatcacccaagcacactgcctcttcatgatccaattctccaaaaccatcaacccatccctccgcggcctctccaaagacgaaatagtctcctccttcgaacgccccatgcaagccgccatctcctcaaccttcctcacatccgccaaccgccgcgccatgctcaaaaccctcggaatcataaacgacaacctcaaaccctccagctccaccgcctccgccgcaaaagtcttcagatccctataa

SEQ ID NO: 8283 - RNA, 732 nt, synthetic construct
  misc_feature 1..732: note = derived and/or modified CDS sequence (opt11) from PTV(Adames)__KP272030.1__N
  source 1..732: mol_type = other RNA
atgtcatacgaagaaatcgccgtacaattcgcctccgaatcaatcgacgaacaagccgtcgccggctgggtcacacacttcgcctaccagggcttcgacgccaaacgagtcatcgcactcgtcaaagaacgcggcggcgaagactggaaacaagacgtcaaaaaaatgatcgtactctccctcacacgcggcaacaaacccaacaaaatggtactcaaaatgtccgacaaaggcaaagccatggtcaacgaactcgtcctcaaatacaaactaaaatccggcaacccctcccgcgacgacctcacactctcccgcatcacagccgccttcgcaggatggacctgccaagccgccgactatgtacaagagtacctaccagtcaccggacgcgccatggacaccatttcctctggctacccccgagccatgatgcacccctccttcgccggactcatagaccaagaactccccgccgacgtcctttcagaaatcacccaagcccactgcctgttcatgatccaattctccaaaaccatcaacccctccctccgcggcctctcaaaagacgaaatcgtctcctccttcgaacgccccatgcaagccgccatctcctccaccttccttacctccgccaaccgccgcgccatgctcaaaaccctaggcatcatcaacgacaacctcaaaccctcctcatccaccgtctcagccgccaaagtcttccgctccctctaa

SEQ ID NO: 8284 - RNA, 735 nt, synthetic construct
  misc_feature 1..735: note = derived and/or modified CDS sequence (opt11) from Phlebovirus(CoAr171616)__HM566153.1__N
  source 1..735: mol_type = other RNA
atgagctacgaagaaatcgccgtcaacttcgcatcagaatccatcgacgaatccaccatctccgcctgggtctccgacttcgcctaccaaggcttcgacgcaaaacgcgtcatcgccctcatcaaagaacgcggcggcgaaaactggaaagaagacgtcaaaaaaatgatcgtcctatccctcacccgaggcaacaagcccgccaaaatgatcctcaaaatgtccgacaaaggcaaaaaagaagtcaacgacctcatcacacgctacaaactaaaaagcggcaacccatcccgagacgacctcaccctctcacgtgtcgcagccgccttcgcaggctggacatgccaagccgccgaatacgtccaagaatacctccccgtcaccggccgagccatggacgcattctccgccgacttcccccgcgccctcatgcaccccagcttcgccggcctcatcgaccaagaactcccctcctccgccatgacagacatcgtccacgcccactgcctattcatgatccaattctccaaaaccatcaaccccaccatccgctcagcctcaaaagacgaaatcgtcgcctctttcgacagacccatgcaagccgcaatcaactccaccttcctcacctccgcccaacgccgcgccatgctcaaaaccctcggcgtcatcaacgacaacctaaaagtcagcaccgccgtctcatccgccgccaaagcattcaagaaactccaataa

SEQ ID NO: 8285 - RNA, 735 nt, synthetic construct
  misc_feature 1..735: note = derived and/or modified CDS sequence (opt11) from Phlebovirus(CoAr171616)__EF201836.1__N
  source 1..735: mol_type = other RNA
atgagctatgaagaaatagccatccacttcgcctcagaatccatcgacgaatccaccatctcagcctgggtcagcgacttcgcataccaaggcttcgacgccaaacgcgtcattgccctcataaaagaacgcggcggcgaaaactggaaagaagacgtcaaaaaaatgatcgtcctatccctcacccgcggcaacaaaccagccaaaatgatcctcaaaatgtccgacaaaggcaaaaaagaagtcaacgacctcatcacccgatacaaactcaaatccggaaacccctcacgagacgacctaaccctaagccgagtcgccgccgccttcgctggctggacctgccaagccgccgaatacgtccaagaatacctacccgtcaccggccgcgcaatggacgcattctccgccgacttcccccgagccctaatgcacccctccttcgccggcctaatcgaccaagaactccccagctccgcaatgaccgacatcgttcacgcccactgcctcttcatgatccaattcagcaaaaccataaaccccaccatccgctccgcctcaaaagacgaaatcgtcgcatccttcgacagacccatgcaagccgccatcaactccaccttcctcacctccgcccaacgccgcgccatgctcaaaaccctcggcgtcatcaacgacaacctcaaagtctcaaccgccgtttcctccgccgcaaaagccttcaaaaaactccaataa

SEQ ID NO: 8286 - RNA, 732 nt, synthetic construct
  misc_feature 1..732: note = derived and/or modified CDS sequence (opt11) from Phlebovirus(CoAr170255)__EF201840.1__N
  source 1..732: mol_type = other RNA
atgtcctacgaagaaatcgccatccaattcgcctcagaatccgtcgacgcaaccaccatcgccgcctgggtatccgaattcgcctaccaaggattcgacgcaagacaagtcataaacctcgtcaaacaacgcggcggcgacgactggaaagaagacgtcaaaaaaatgatcgtcctctcgctcacccgcggaaacaaaccctcaaaaatgctcaacaaaatgtccgaatccggccaaaaaatcgtcaacgacctcatctccaaatacaaactcaaatcaggcaaccccggccgcaacgacctcaccctctcccgcatcgccgccgccttcgccggctggacctgccaagccgcagaagtcgtccaagactacctacccgtcaccggccgagccatggacgcaatctcggataaattcccccgcgccctcatgcacccctccttcgccggcctcgtcgaccccaccctccccgaaggagtcgtcgaagacatcgtccacgcccactgcctattcatgatccaattctcaaaaacaatcaacccctcgctccgctcctcatccaaaagcgaagtcgtcagctcattcgaccgccccatgcaagccgccataaactcccccttccttacagccggaaaccgccgagacatcctcatgtccctcggcctaatcaacagcaacctcaagccctcacccgccgtcatcgcagcagccaaagtctaccgcaagctctaa

SEQ ID NO: 8287 - RNA, 732 nt, synthetic construct
  misc_feature 1..732: note = derived and/or modified CDS sequence (opt11) from Buenaventura virus(CoAr3319)__KP272003.1__N
  source 1..732: mol_type = other RNA
atgtcctacgaagaaatcgccatacaattcgcatccgaatccgtcgacgccaccacaatcgccgcctgggtctccgaattcgcctaccaaggattcgacgcccgccaagtcatcaacctcgtaaaacaacgcggcggcgacgactggaaagaagacgtcaaaaaaatgatcgtactctccctcacccgcggcaacaaaccctccaaaatgctcaacaaaatgtccgaatccggccaaaaaatcgtcaacgacctcatatcgaaatacaaattaaagtctggcaaccccggccgaaacgacctaaccctctcccgcatcgccgccgccttcgccggctggacctgccaagccgctgaagtcgtccaagactacctccccgtcaccggccgcgccatggacgccatctccgacaaattccctcgcgccctaatgcacccctccttcgccggcctcgtcgaccccaccctcccagaaggcgtcgtcgaagacatcgtccacgcccactgcctattcatgatccaattctcaaaaaccatcaacccctccctccgttcctcctcaaaatccgaagtagtctcatccttcgaccgccccatgcaagccgcaatcaactcacccttcctcaccgccggcaaccgccgcgacatcctcatgtcactcggcctaatcaactccaacctaaaaccctcacccaccgtcgtcgccgcggccaaagtctaccgcaaactctaa

SEQ ID NO: 8288 - RNA, 732 nt, synthetic construct
  misc_feature 1..732: note = derived and/or modified CDS sequence (opt11) from Cocle virus(GML244915)__KP272035.1__N
  source 1..732: mol_type = other RNA
atgtcctacgaagaaatcgccgtccaattcgcctccgaatccatcgacgaacaagccgtcgccggatgggttaccgacttcgcataccaaggcttcgacgcccgccgcgtcatcgcacttgtcaaagaccgcggcggcgaagactggaaacaagacgtcaagaaaatgatcgtactatcactcacccgcggaaacaaacccaacaaaatggtcctcaaaatgtccgacaaaggcaaagccatggtcaacgaactcgtcctcaaatacaaactcaaatcaggcaacccctcccgcgacgacctcacactctcccgcatcaccgccgcattcgccggatggacctgccaggccgccgactacgtccaagaatacctccccgtcaccggccgcgccatggacgccatctcctcaggctacccccgagccatgatgcacccatccttcgccggcctcatcgaccaagaactccccgccgacgtcctctccgaaatcacacaagctcactgcctattcatgatacaattctccaaaaccatcaacccctccctccgaggcctcggcaaagacgaaatcgtctcctcattcgaacgtcccatgcaagccgcaatatcctccaccttcctcacctcagccaaccgccgcgccatgctcaaaaccctaggcatcatcaacgacaatctcaaaccatcaagctccaccgtctccgcagccaaagtattccgatcactctaa

SEQ ID NO: 8289 - RNA, 732 nt, synthetic construct
  misc_feature 1..732: note = derived and/or modified CDS sequence (opt11) from Capira virus(VP-366G)__KP272044.1__N
  source 1..732: mol_type = other RNA
atgtcctacgaagaaatcgccatccaattcgcctccgaatccatcgacgaatccaccatcgcagcatgggtctccgacttcgcctaccaaggattcgacgccaaacaagtcataatcctcatcaaaaaacgcggaggcgaaaactggaaagaagacgtcaaaaaaatgatagtcctctccctaacccgaggcaacaaaccttccaaaatggtcaacaaaatgtccgacgaaggcaaaaaagtcgtcaacgaactcatctccaaatacaaactcaaaactggcaacccagcccgcgacgaccttaccctctcccgcatcgccgccgccttcgccggctggacctgccaagccgccgaatacgtccaagactacctccccgtaaccggccgcgccatggacgccctctcagacaaatacccccgcgccctaatgcacccctccttcgccggactcatcgaccccaccctcccagacgacgccgtcaaagacatcgtccacgcccactgcctcttcatgatccaattctccaaaaccatcaacccctccctccgctcatccaccaaaaccgaaatagtcaactccttcgaccgcccaatgcaagccgccatcaactctcccttcctaaccgccgaaaaccgccgcgccatgctaaccaccctcggcgtcatcaactctaacctaaaaccctccgccgccgtcgtcgcagccgccaaggcctaccgcaaactataa

SEQ ID NO: 8290 - RNA, 732 nt, synthetic construct
  misc_feature 1..732: note = derived and/or modified CDS sequence (opt11) from Campana virus(VP-334K)__KP272042.1__N
  source 1..732: mol_type = other RNA
atgtcctacgaagaaatcgccatacaattcgcctccgaatccgtcgacgccaccaccatcgccgcctgggtctccgaattcgcctaccaaggcttcgacgcccgccaagtaatcaacctagtcaaacaaagaggcggcgacgactggaaagaagacgtcaaaaaaatgatagtcctatcactcacccgcggcaacaaaccctcccgcatggtcacaaaaatgtcagaatccggccaaaaaatagtcaacgacctcatctccaaatacaaactcaaatccggcaacccaggccgcaacgacctcaccctctcccgcgtagccgccgccttcgccggctggacctgccaggccgccgaagtcgtacaagactacctccccgtcaccggccgcgccatggacgccctatccgacaaattcccccgcgccatcatgcacccctccttcgccggcctcatagacccaaccctacccgaaaacgtcgtcgaagacatagtacacgcccactgcctcttcatgatccaattctccaaaaccataaacccctccctccgatcctcctccaaatccgaagtcgtatcctcattcgaccgccccatgcaagccgccatcaactcacccttcctcaccgccgccaaccgccgagacatgctaatgtccctcggcctcatctcgtccaacctcaaaccctccgcagccgtcacagccgccgcaaaagcctaccgcaaactctaa

SEQ ID NO: 8291 - RNA, 738 nt, synthetic construct; identical to SEQ ID NO: 7599
  misc_feature 1..738: note = derived and/or modified CDS sequence (opt11) from RVFV(ZH-548)__DQ380151.1__N
  source 1..738: mol_type = other RNA

SEQ ID NO: 8292 - RNA, 738 nt, synthetic construct; identical to SEQ ID NO: 7600
  misc_feature 1..738: note = derived and/or modified CDS sequence (opt11) from RVFV(OV 35/74)__EF530207.1__N
  source 1..738: mol_type = other RNA

SEQ ID NO: 8293 - RNA, 762 nt, synthetic construct
  misc_feature 1..762: note = derived and/or modified CDS sequence (opt11) from SFNV(Toscana)__NC_006318.1__N
  source 1..762: mol_type = other RNA
atgtcggacgagaactaccgcgacatcgcgctcgcgttcttagacgaaagcgcagactcgggcacaatcaacgcctgggtcaacgagttcgcctaccaagggttcgacccaaagcgcatagtccagctcgtaaaagaaagagggacagccaaagggagagactggaagaaagacgtcaagatgatgatagtgctcaacctcgtgcgagggaacaagccagaggcaatgatgaagaaaatgagcgagaaaggagcatcgatagtggccaacctcataagcgtgtaccagctcaaggaagggaacccgggcagggacacgataacgctatcgcgcgtaagcgcggcattcgtcccgtggacggtccaggccctgcgcgtactctcagaatcgctcccggtatcaggcacgaccatggacgcaatcgcgggcgtgacatacccaagggccatgatgcacccatcgttcgcgggcataatcgacctagacctcccgaacggggcaggggccacgatagcggacgcgcacgggctattcatgatagagttcagcaagaccataaacccgagcttgcgcacgaaacaggccaacgaagtggcagcgacattcgaaaagcccaatatggcggccatgagcgggcgcttcttcacgcgcgaagacaagaagaaactactgatcgcggtcggaatcatagacgaggacctggtcctggcctcggccgtggtaaggagcgcggaaaaatacagggccaaggtcgggaaatag

SEQ ID NO: 8294 - RNA, 762 nt, synthetic construct
  misc_feature 1..762: note = derived and/or modified CDS sequence (opt11) from SFNV__HM566170.1__N
  source 1..762: mol_type = other RNA
atgtccgaagaaaactaccgagaaatcgccctcgccttcctagacgaagccgccgactcaggcaccatcaccgcctgggtaaacgaattcgcctaccaaggcttcgacccaaaacgaatcgtccagctcgtcaaagaacgcggcaccgcaaaaggccgcgactggaaaaaagacgtcaaaatgatgatcgtactcaacctcgtacgcggcaacaaacccgaagcaatgatgaaaaaaatgtccgaaaaaggcgccggcatcgtcgcccaactcatcagcgtctaccaactcaaagaaggcaaccccggccgcgacaccatcaccctctcccgcgtctccgccgccttcgtcccctggacaatccaagccctccgcgtcctctcagactcactccccgtcacaggcaccaccatggacgccatcgcaggcgtcacctacccccgagccatgatgcacccatccttcgccggaataatcgacctcgacctccccaaccgcgccggcgaagtcatcgccgacgcccacgggctattcatgctcgaattcagcaaaacaatcaaccccagcctccgcacaaaacaacccaacgaaatcgccgcaaccttcgaaaaacccaacatggccgccatgtcaggacgcttcttcacccgcgaagacaaaaaaaaactccttatggccgtcggaatactcaacgaagacctcgtcctaacccccgccatagtcaaatgcgccgaaaaatactgctccaaagtcggcaaataa

SEQ ID NO: 8295 - RNA, 735 nt, synthetic construct
  misc_feature 1..735: note = derived and/or modified CDS sequence (opt11) from SFNV(Namru)__HM566168.1__N
  source 1..735: mol_type = other RNA
atgtcctacgaagaaatcgccgtcaacttcgccagcgaatccatcgacgaatccaccatatccgcctgggtctccgacttcgcctaccaaggcttcgacgccaaacgcgtcatcgcactaataaaagaacgcggcggcgaaaactggaaagaagacgtcaaaaaaatgatcgttctctccctcacccgcggcaacaaacccgccaaaatgatcctcaaaatgtccgacaaaggcaaaaaagaagtcaacgacctaatcacccgctacaaactcaaatccggcaacccctcccgcgacgacctcaccctctccagagtcgcagccgccttcgccggctggacctgccaagcagccgaatacgtccaagaatacctgcccgtaaccggccgcgcaatggacgcattctccgccgacttcccccgagccctcatgcacccctcctttgccggcctcatcgaccaagaactcccctcctctgccatgaccgacatcgtccacgcccactgcctcttcatgatacaattctccaaaacaatcaaccccacaatacgatccgcctccaaagacgaaatagtcgcctccttcgaccgccccatgcaagccgccataaactcaaccttcctaacctccgcccaacgccgcgccatgctcaaaacactcggagtcatcaacgacaacctcaaagtatccaccgccgtatcctccgccgccaaagcattcaaaaaactacaataa

SEQ ID NO: 8296 - RNA, 762 nt, synthetic construct
  misc_feature 1..762: note = derived and/or modified CDS sequence (opt11) from SFNV(NAMRU 840055)__EF201828.1__N
  source 1..762: mol_type = other RNA
atgtcagaagaaaactaccgcgagatcgccctcgccttcctagacgaagcagccgactcaggcaccatcaccgcatgggtaaacgaattcgcctaccaaggattcgaccccaaacgaatcgtccaactcgtcaaagaacgcggcaccgcaaaaggccgagactggaaaaaagacgtcaaaatgatgatcgtactaaacttagtccgcggcaacaaacccgaagcaatgatgaaaaaaatgagcgaaaaaggcgccggcatcgtcgcccaactcataagcgtctaccaactacgcgaaggcaaccccggccgcgacacaataacactctcacgagtcagcgccgccttcgtcccatggaccatacaagccctaaaagtcctctccgactcactacccgtcaccggcaccacaatggacgcaatcgccggagtcgtctacccccgagccatgatgcacccatccttcgcaggaatcatcgacctcgacctccccaaccgagccggcgaagcaatcgccgacgcccacggactattcatgctcgaattctccaaaacaataaaccccagcctccgcacaaaacaacccaacgaaatcgccgcaaccttcgaaaaaccaaacatggcagcaatgtctggccgcttcttcacacgagaagacaaaaaaaaactcctaatggcagtcggcatcctcaacgaagacctggtactaacccccgccatcgtaaagtgcgcagaaaaataccgcagcaaagtcggaaaataa

SEQ ID NO: 8297 - RNA, 762 nt, synthetic construct
  misc_feature 1..762: note = derived and/or modified CDS sequence (opt11) from SFNV(NAMRU 840055)__EF201829.1__N
  source 1..762: mol_type = other RNA
atgtcagaagaaaactaccgcgagatcgcactcgcgttcctagacgaagcagcggactcgggaacaattacggcctgggtcaacgagttcgcctaccaagggttcgaccccaagcgaatcgtccagctcgtgaaagaacgcgggaccgcaaaagggcgagactggaagaaagacgtcaagatgatgatcgtgctaaacctcgtgcgcgggaacaagcccgaggccatgatgaagaagatgagcgagaaaggggccgggatcgtagcccagctcataagcgtgtaccagctcaaggaagggaacccgggcagggacacgatcacgctctcgcgcgtgagcgcagccttcgtcccgtggacgatccaggccctgcgcgtgctctcggactcgctcccggtaacgggcacaaccatggacgcaatcgcgggcgtgacataccccagggccatgatgcacccatcattcgcgggcataatcgacctagacctcccgaacagagccggtgaagcgatcgcagacgcgcacggactcttcatgttggagttcagcaagaccataaacccgagcctgcgcacgaaacagcccaacgaaatcgccgcaacattcgaaaagcccaacatggcggccatgagcgggcgcttcttcacgagagaagacaagaaaaagctactgatggcagtcgggatcctgaacgaggacttggtcctaaccccggccatagtcaagtgcgcggaaaagtactgcagcaaggtcgggaaataa

SEQ ID NO: 8298 - RNA, 762 nt, synthetic construct
  misc_feature 1..762: note = derived and/or modified CDS sequence (opt11) from SFNV(P-7101795)__EF201830.1__N
  source 1..762: mol_type = other RNA
atgtcagaagaaaactaccgcgagatcgcgctcgcgttcctgaacgaggccgcagactcgggcaccatcacggcctgggtaaacgagttcgcataccaagggttcgacccaaagcgcatagtacagctcgtaaaagaacgcgggaccgccaaagggcgcgactggaagaaagacgtcaaaatgatgatcgtactcaacctcgtacgcgggaacaagcccgagaccatgatgaagaaaatgagcgagaaaggggccgggatcgtggcccagctcataagcgtgtaccagctcaaggaagggaacccgggcagggacacgatcacgctctcgcgagtaagtgcggccttcgtcccgtggacggtccaggcattgcgcgtactctcggactcactcccggtcacgggcacaaccatggacgcgatcgcgggcgtaacataccccagggccatgatgcacccatcattcgcgggaatcatcgacctagacctaccaaacagggccggggaaacgatcgcggatgcgcacggactattcatgctagagttcagtaagacaataaacccgagcctacgcacgaaacagccaaacgaaatagccgcgaccttcgaaaagcccaacatggcggccatgagcggacgattcttcacgcgcgaagacaagaaaaagctcttgatggcggtcggggtcctgaacgaagacctggtactgacaccagccatagtcaaatgcgcggaaaaatacaggagcaaagtcgggaaatag

SEQ ID NO: 8299 - RNA, 762 nt, synthetic construct
  misc_feature 1..762: note = derived and/or modified CDS sequence (opt11) from SFNV(P-7101795)__EF201832.1__N
  source 1..762: mol_type = other RNA
atgtccgaagaaaactaccgagaaatcgccctcgccttcctcgacgaagccgcagactccggaaccatcaccgcctgggtcaacgaattcgcctaccaaggcttcgaccccaaacgcatcgtacaactcgtaaaagaacgcggcaccgcaaaaggcagagactggaaaaaagacgtcaaaatgatgatagtcctcaacctcgtccgcggcaacaaacccgaagcaatgatgaaaaaaatgtccgaaaaaggcgccggcatcgtagcccaactcatctccgtctaccaactacgcgaaggcaaccccggccgcgacacaatcaccctctcacgcgtaagcgcagccttcgtcccctggaccatccaagccctcaaagtactctccgactccctccccgtaacaggcacaaccatggacgccatcgccggcgtcatgtacccccgagccatgatgcacccctccttcgccggcatcatcgacctcgacctccccaaccgcgccggcgaagccatcgccgacgcacacggcctcttcatgctcgaattctccaaaaccatcaacccctccctccgaacaaaacaacccaacgaaatcgccgcaaccttcgaaaaacccaacatggccgcaatgtccggccgattcttcacccgagaagacaaaaaaaaactcctcatggccgtcggcatcctaaacgaagacctcgtcctcacccccgccatcataaaatgcgccgaaaaataccgatccaaagtcggcaaataa

SEQ ID NO: 8300 - RNA, 762 nt, synthetic construct
  misc_feature 1..762: note = derived and/or modified CDS sequence (opt11) from Arrabida virus(PoSFPhlebV/126/2008)__KP863801.1__N
  source 1..762: mol_type = other RNA
atgtccgaagacaactaccgcaccatcgccctcgccttcctcgacgaatccgccgactcaaccaccatcaacgcatgggtcaacgaattcgcctaccaaggtttcgaccccaaacgcatagtccaactagtaaaagaacgcggcaccgcaaaaggacgcgactggaaaaaagacgtcaaaatgatgatcgtcctcaacctcgtccgcggcaacaaacccgaatccatgatgaaaaaaatgtccgaaaaaggcgccgccatcgtaacacaactcatctccacctaccaactaaaagaaggcaaccccggcagagacaccatcaccctctcccgcgtcagcgccgcattcgtcccctggaccgtccaagccctaaaaacactctcagaatcactcccagtcaccggcaccaccatggactcaatcgccggcaccacctaccccagatgcatgatgcacccaagcttcgccggcatcatcgacctcgaactacccaacaacaccggcgccatgctcgccgacgcccacggcctcttcatgctcgaattctccaaaacaatcaacccgtccctccgcaccaaacaacccaatgaaatcgccgcaacattcgaaaaacccaacatggcagccatgacaggccgcttcttcacccgcgacgacaaaaaaaaactcctcatcgccatcggcgtactagacgaagacctcgtcccaaacccagcaatcgaaaaatgcgccgaaaaatacaaagccaaagtcggcaaataa

SEQ ID NO: 8301 - RNA, 765 nt, synthetic construct
  misc_feature 1..765: note = derived and/or modified CDS sequence (opt11) from Gordil virus(Dak ANBr 496d)__KF297902.1__N
  source 1..765: mol_type = other RNA
atgtcggaagaaaactaccgcgagatcgcaatggcgttcgcgaacgacagcgcagacttcaacatgatctcggtttgggccaatgacttcgcctaccaaggattcgacccaaagcgcatagtcgagctcgtgcgccagcgcgggctagcgaaagcgcgcaactggaagcaagacgtcaagatgatgatcgtgctcaacctcatgcgcgggaacaagcccgaagcaatggtcaggaaaatgcaagagaaagggcaaaggatcgtgctcgagctcataagcgtgtacgagctaaaagaaggaaacccgggaagggacacaatcacgctatcgcgcgtgtccgcggccttcgtcccgtggacgatcatggccttgcgccagctcgcggaaaacatcccggtcacgggctcaatcatggactcgatcctggacggggccgtgtacccgcgcgcgatgatgcacccgagcttcgccgggatcatagacctggaactacccgaaggcaggggcgcggaactagccgacgcccacggcctattcatgatcgagttctcgaaaacaatcaacccctcactccggaccaagagcgcgatagagatcgcagcctcgttcgagaaaccaaacatggccgcgatgacaggcaacttcttcaccaaggacgataaaaggaaattgctaaagcaaataggaatactagacagcgacctcaagctcacgcccgtgatcgagaaagcggccgcgctctaccgctcaaaaacgaacaagtga

SEQ ID NO: 8302 - RNA, 762 nt, synthetic construct
  misc_feature 1..762: note = derived and/or modified CDS sequence (opt11) from Granada virus(GR25)__GU135608.1__N
  source 1..762: mol_type = other RNA
atgtccgaagacaactaccgaaccatcgccctcgccttcctagacgaaagcgcagactccaccaccatcaacgcctgggtcaacgaattcgcctaccaaggcttcgaccccaagcgcatcgtccaactcgtcaaagaacgcggcaccgcaaaaggccgcgattggaaaaaagacgtcaaaatgatgatcgtactaaacctcgtccgaggcaacaagccagaaagcatgatgaaaaaaatgagcgaaaaaggcgccgccatcgtcacccaactcataagcacgtaccaactaaaagaaggcaaccccggcagagacaccatcacactctcccgcgtcagcgccgccttcgtcccatggaccgtacaagctctaaaaacgctctccgaatcactccccgtcacaggcacaaccatggactccatagccggcaccacctacccccgctgcatgatgcacccctccttcgccggcatcatcgacctcgaactccccaacaacaccggcgccatgctcgccgacgcacacggcctcttcatgctagaattcagcaaaaccataaacccgagcctgcgcacaaaacaacccaacgaaatcgccgcaacattcgaaaaacccaacatggccgccatgaccggccgattcttcacacgagacgacaagaaaaaactcctaatcgcaatcggcgtcctcaacgaagacctagtccccaacccagccatagaaaaatgcgccgaaaaatacaaagccaaagtcggcaaataa

SEQ ID NO: 8303 - RNA, 762 nt, synthetic construct
  misc_feature 1..762: note = derived and/or modified CDS sequence (opt11) from Massilia virus(127)__KT906102.1__N
  source 1..762: mol_type = other RNA
atgtccgaagacaactaccgcaccatcgccctctccttcctcgacgaaaccgccgtatccacctccatcaacgcctgcgtcaacgaattcgcataccaaggcttcgaccccaaaagaatcgtccaactcgtcaaagaacgcggcaccgccaaaggccgcgactggaaaaaagacgtcaaaatgatgatcgtcctcaatctcgtccgcggcaacaaacccgaatccatgatgaaaaaaatgtccgaaaaaggcgccgccatcgtcacccaactcatctcaacctaccaactaaaagaaggcaacccaggccgagacacaatcaccctctcccgcgtctcagccgccttcgtcccctggacagtccaagccctaaaaacactctcggaatccctccccgtcaccggcaccaccatggactccatagccggcaccacctacccccgatgcatgatgcacccctccttcgccggcatcatcgacctcgaactaccaaacaacaccggcgccatgctcgcagacgcccacggcctcttcatgctcgaattctccaaaaccatcaaccccagcctccgcacaaaacaaccaaacgaaatcgccgccaccttcgaaaaacccaacatggccgcaatgaccggccgattcttcacccgcgacgacaaaaaaaaactcctcatcgccatcggcgtcctcgacgaagacctagtccccaaccccgccatcgaaaaatgcgcagaaaaatacaaagccaaagtcggcaaataa

SEQ ID NO: 8304 - RNA, 762 nt, synthetic construct
  misc_feature 1..762: note = derived and/or modified CDS sequence (opt11) from Massilia virus(130)__KT906103.1__N
  source 1..762: mol_type = other RNA
atgtccgaagacaactaccgcaccatcgcactctccttcctcgacgaaacagccgactccacctccatcaacgcctgcgtcaacgaattcgcctaccaaggcttcgaccccaaacgcatcgtccaactcgtcaaagaacgcggcaccgccaaaggcagagactggaaaaaagacgtcaaaatgatgatagtcctaaacctcgtccgcggcaacaaacccgaatccatgatgaaaaaaatgtccgaaaaaggcgccgccatcgtcacccaactcatctccacctaccaactcaaagaaggcaaccccggccgcgacaccatcaccctatcccgcgtcagcgccgccttcgtcccctggaccgtacaagccctcaaaaccctctccgaatccctccccgtaaccggcaccacaatggactccatcgccggcaccacctacccccgctgcatgatgcacccctcattcgccggcatcatcgacctcgaactccccaacaacaccggcgccatgctagccgacgcccacggcctcttcatgctagaattctccaaaacaatcaaccccagcctgcgcactaaacaaccaaacgaaatcgccgccaccttcgaaaaacccaacatggccgccatgaccggccgcttcttcacccgcgacgacaaaaaaaaactcctcatagccatcggagtcctcgacgaagacctagtccccaaccccgccatagaaaaatgcgccgaaaaatacaaagccaaagtaggcaaataa

SEQ ID NO: 8305 - RNA, 762 nt, synthetic construct
  misc_feature 1..762: note = derived and/or modified CDS sequence (opt11) from Naples virus(Yu 8/76)__JF920141.1__N
  source 1..762: mol_type = other RNA
atgtccgaagacgactaccacaaaatcgccctcgccttcgccgaagaatcagccgacgtctccaccatagaaagctgggtcaacgacttcgcctaccaaggcttcgacccccgcagaatagtacaactagtcaaagaacgcggcacagccaaaggccgcgactggaaaaaagacgtcaaaatgatgatcgtcctcaacctcgtacgtgggaacaaacccgaagcaatgatgaaaaaaatgtccgaaaaaggcgccgccatcgtcgcacagctcatcagcgtataccaactcaaagaaggcaaccccggacgcgacaccatcaccctatcccgagtctccgccgccttcgtcccctggacagtccaagccctacgcgtcctatcagaccacctccccgtcaccggcaccaccatggacgccatcgccggcgtaacatacccccgcgcaatgatgcacccctccttcgccggaatagtcgacctcgaactaccccgcaaaaccggcgaaatgatcgccgacgcacacggcctcttcatgctcgaattctcaaaaaccatcaacccctccctccgcaccaaacaacccaacgaaatcgccaccaccttcgaaaaaccaaacatggcagccatgtccggcaaattcttctcccgagaagacaaaaaaaaactcctaatgtccgtcggcatcataaacgacgacctcctactcacagccagcgtagtcaaatgcgccgaaaaataccgagccaaaaccggcaaataa

SEQ ID NO: 8306 - RNA, 762 nt, synthetic construct
  misc_feature 1..762: note = derived and/or modified CDS sequence (opt11) from Punique virus(P1_B4_2008)__FJ848987.1__N
  source 1..762: mol_type = other RNA
atgtcagaagaaaactaccgcgaaatagcactcgcattcctggacgaaagcgccgactccggcaccatctcaacatgggtcaacgacttcgcctaccaaggattcgaccccaaacgcatagtacagctagtaaaagaacgaggaaccgcaaaaggacgcgactggaagaaagacgtcaaaatgatgatcgtactaaacctcgtgcgcggaaacaaacccgaaagcatgatgaagaaaatgagcgagaaaggagccgcaatcgtcgcccaactaatcgccgcctaccaactaaaagaaggaaaccccggccgggacaccatcacactctcacgagtcagcgcagccttcgtcccctggacagtccaagcactccgctccctatccgactcgctcccagtcaccggcacaaccatggactccatcgcaggcgtaacatacccacgctgcatgatgcacccctcattcgcaggcataatagacctagacctacccaacgacacaggagccatgctcgcagacgcacacggcctattcatgctagagttcagcaaaaccatcaacccaagcctccgcacaaaacaagccaacgaaatagccgccaccttcgaaaaacccaacatggcggccatgaacggacgcttcttcacccgcgaagacaaaaagaaactcctaatcgccatcggcgtactaaacgaagacctgatcccagtctccgccatagccaaatgcgccgaaaaatacagagccaaagtcggcaaataa

SEQ ID NO: 8307 - RNA, 762 nt, synthetic construct
  misc_feature 1..762: note = derived and/or modified CDS sequence (opt11) from Saint Floris virus(Dak ANB512)__JF920138.1__N
  source 1..762: mol_type = other RNA
atgagcgaagaaacctacgcacaactcgccatggccttcctagcagaaccagccgactggagcacactatccgtctgggtcaacgaattcgcctaccaaggcttcgaccccaaacgaatcgtcgaactcatcatggaaagaggcaaaaaattcaaccgagaatggaaaaaagacgtcaaaatgatgatcacactaaacctcatccgaggcaacaaaccagaagccatgatgcgcaaaatgtccgacaaaggcagaagcatcgtcagcgaactaatctcagtctacgaactcaaagagggcaaccccggacgagacaccatcaccctctcccgcgtctccgccgccttcgtcccctggacggtccgcgccctagtcgccctacaaaacgacctccccgtcaccggagccgcaatggactccatatgcggcgtcacatacccccgcgccatgatgcacccctccttcgccggagtcatcgacctcgaactccccaacggcgtcggcgcccaactcgccgacgcacacggcctcttcatgctagaattcagcaagaccatcaaccccggcctccgcaccaaacaacccaacgaaatcgccgccaccttcgaaaaacccaacctcgccgccatgaccggcaaattcttcaccaaagaagacaaacgcaaagtactcatctccgtcggcgtcatcaactccgacctccaacccaactcagtagtcaaaacatgcgccgaactctaccgggcccgcgtcatgaaatag

SEQ ID NO: 8308 - RNA, 762 nt, synthetic construct
  misc_feature 1..762: note = derived and/or modified CDS sequence (opt11) from Tehran virus(I-47)__JF939848.1__N
  source 1..762: mol_type = other RNA
atgtcagaagaagactaccgagcaatcgccctctcattctccgacgaaagcgccgacgtcggaatcatcaccacctgggtcaacgaattcgcctaccaagggttcgaccccaaacgcatagtacaactagtaaaagaacgcggacaagcaaaaggccgagactggaaaaaagacgtcaaaatgatgatagtcctcaacctaatccgcggcaacaaacccgacgccatgatgaaaaaaatgtccgaaaaaggcgcagccaccgtagcccaactcgtcagcgtataccaactcaaagaagggaaccccggccgcgacaccatcacactctcccgcgtatccgccgccttcgtaccctggacagtccaagccctcaaagtcctatccgaatccctcccggtcaccggcacaaccatggacaccgtcgccggcgtaacctacccccgggccatgatgcacccctcattcgcaggcatcatagacctcgaattacccggccgagccggcgaagccatcgccgacgcccacggcctcttcatgctcgaattctccaaaacaatcaaccccagcctacgaacaaaacaacccaacgaaatcgccgcaaccttcgaaaaaccaaacatggccgccatgaccggacgcttcttcacccgagaagacaaaaaaaaactcctcatcgccgtcggaatcataaacgacgacctgctcctcacccccagcatcgccaaatgcgccgaaaagtaccgagccaaagtcgggaaataa

SEQ ID NO: 8309 - RNA, 762 nt, synthetic construct
  misc_feature 1..762: note = derived and/or modified CDS sequence (opt11) from Zerdali virus(37)__KP966618.1__N
  source 1..762: mol_type = other RNA
atgtcagaagaggactaccgagcgatcgcactatcgttctcagacgaggcagccgacgtaggcacgatcacggcctgggtcaacgagttcgcctaccaaggattcgaccccaagcgcatagtccagctcgtgcgcgaacgagggatcgcgaaaggacgcgactggaagaaagacgtcaagatgatgatcgtactcaacctcatacgcggaaacaagcccgacgccatgatgaagaaaatgtccgaaaaaggggccgcaaccgtggcccaactcgtgagcgtataccaactcaaagaagggaacccgggaagggacaccataacgccctcccgcgtaagcgccgccttcgtcccatggacagtacaggccctaaaagtgctctcagaatcgctcccagtcacgggcacgaccatggacacgatcgcgggcgtaagctaccccagagccatgatgcacccctcgttcgcgggcataatcgacctcgaactcccgcgcagggcaggagaagtcatcgccgacgcacacggactattcatgctggagttcagcaaaaccataaacccgagcctccgcacaaaacagcctaacgaaatcgccgcgaccttcgaaaagcccaacatggcagcaatgaccggacgcttctttacacgagaagacaagaaaaagctcttaatcgcggtcggaatcataaacgacgacctgctcctggccccaagcgtagccaagtgcgcggaaaagtacagggccaaagtaggaaaataa

SEQ ID NO: 8310 - RNA, 762 nt, synthetic construct
  misc_feature 1..762: note = derived and/or modified CDS sequence (opt11) from TOSV(9028)__KU904263.1__N
  source 1..762: mol_type = other RNA
atgtccgacgaaaactaccgcgacatagccctagccttcctagacgaaagcgcagactccggcaccatcaacgcctgggtcaacgaattcgcctaccaaggcttcgaccccaaacgcatcgtccaactcgtcaaagaacgcggcaccgcaaaaggacgcgactggaaaaaagacgtcaaaatgatgatcgtcctcaacctcgtccgcggtaacaagcccgaagccatgatgaaaaaaatgagcgaaaaaggcgcctccatcgtagccaacctcatcagcgtctaccaactaaaagaaggcaacccaggccgagacaccatcaccctctcacgcgtctcagcagccttcgtcccctggaccgtccaagccctccgcgtcctatccgaatccctcccagtatccggaaccaccatggacgcaatcgcaggcgtcacctacccccgagccatgatgcacccctcattcgccggaatcatcgacctcgacctcccaaacggagccggcgccaccatcgccgacgcccacggactctttatgatcgaattcagcaaaaccataaacccctccctccgcaccaaacaagcaaacgaagtcgccgccaccttcgaaaaacccaacatggccgccatgtccggccgcttcttcacgcgcgaagacaaaaaaaaactactcatcgccgtcggcatcatcgacgaagacctagtcctagcctccgccgtcgtacgcagcgcagaaaaataccgcgcaaaagtcggcaaataa

SEQ ID NO: 8311 - RNA, 762 nt, synthetic construct
  misc_feature 1..762: note = derived and/or modified CDS sequence (opt11) from TOSV(SI-121283)__JF330274.1__N
  source 1..762: mol_type = other RNA
atgtcagacgaaaactaccgcgacatagcactcgccttcctagacgaaagcgccgactcaggcacaatcaacgcctgggtcaacgaattcgcataccaaggattcgaccccaaacgaatcgtccaactagtcaaagaacgaggaaccgccaaaggccgcgactggaaaaaagacgtcaaaatgatgatcgtacttaacctcgtcagagggaacaaacccgaagccatgatgaaaaaaatgtccgaaaaaggcgcatccatcgtcgccaacctcatcagcgtctaccaactcaaagaaggcaacccaggcagagacacaatcaccctctcacgcgtctccgccgccttcgtaccatggaccgtccaggccctacgcgtactctccgaatcactccccgtctcgggcaccacaatggacgccatcgccggcgtcacctacccacgcgccatgatgcacccctccttcgccggcataatcgacctagacctccccaacggagccggagccaccatcgcagacgcacacggcctcttcatgatagaattcagcaaaaccatcaacccaagcctacgcaccaaacaagccaacgaagtagcagccaccttcgaaaaccccaacatggccgccatgtccggccgcttcttcacccgcgaagacaagaaaaaactcctaatcgccgtcggcatcatcgacgaagacctagtcctcgcctccgccgtcgtccgcagcgccgaaaaataccgagccaaagtcggcaaataa

SEQ ID NO: 8312 - RNA, 762 nt, synthetic construct
  misc_feature 1..762: note = derived and/or modified CDS sequence (opt11) from TOSV(5963930705)__KU935733.1__N
  source 1..762: mol_type = other RNA
atgtcagacgagaactaccgcgatatagcactcgcattcctggacgagagcgcggactcgggcacgatcaacgcatgggtcaacgaatttgcctaccaaggattcgaccccaagcgcatagtccagctcgtgaaagagcgagggaccgcgaaagggcgcgactggaagaaagacgtcaagatgatgatcgtgctcaacctcgtgcgcgggaacaagcccgaggccatgatgaagaaaatgagcgagaaaggagcctcgatcgtggccaacctaataagcgtgtaccagctaaaggaagggaacccgggcagggacacgataacactctcacgagtgagcgcggccttcgtcccatggacggtccaggccctacgtgtgctctcggaatcgctcccggtctcgggcacaaccatggacgcgatcgcgggagtgacataccccagggccatgatgcacccctcgttcgcgggcataatcgacctcgatctaccgaacggggccggggccacgatcgcggacgcacacgggctattcatggtagagttcagcaagacaatcaaccccagcctacgcacgaaacaggccaacgaagtcgccgcgacattcgaaaagcccaacatggcagcaatgagcggacgcttcttcacgcgcgaagacaagaaaaagctcctaatagcggtcgggatcatagacgaggacttagtcctagcctcggcagtggtcaggagcgcggaaaagtacagggccaaggtcggaaaatag

SEQ ID NO: 8313 - RNA, 762 nt, synthetic construct
  misc_feature 1..762: note = derived and/or modified CDS sequence (opt11) from TOSV(MRS2010-4319501)__KC776214.1__N
  source 1..762: mol_type = other RNA
atgtcagacgaaaactaccgcgacatcgccctcgccttcctcgacgaaagcgccgactccggcaccatcaacgcctgggtcaacgaattcgcctaccaaggcttcgaccccaaacgcatcgtccaactcgtcaaagaacgcggcaccgccaaaggacgcgactggaaaaaagacgtcaaaatgatgatcgtcctcaacctcgtccgcggcaacaaacccgaagcaatgatgaaaaaaatgtccgaaaaaggagcctccatcgtagccaacctcatcagcgtctaccaactcaaagaaggaaacccaggaagagacaccatcaccctctcccgcgtatcagccgccttcgtcccatggactgtccaagcactacgcgtcctctccgaatccctccccgtctcaggaacgaccatggacgccatcgccggcgtaacctacccccgcgccatgatgcacccctcattcgcaggcatcatcgacctccacctccccaacggcgcaggcgccaccatcgccgacgcccacggcctcttcatgatcgaattcagcaaaaccatcaacccaagcctccgcaccaaacaggccaacgaagtcgccgccacattcgaaaaacccaacatggccgccatgtccggacgcttcttcacccgcgaagacaaaaaaaaactactcatagcagtcgggatcatcgacgaagacctagtcctcgcctcagccgtagtccgctccgccgaaaaataccgcgccaaagtcggaaaataa

SEQ ID NO: 8314 - RNA, 762 nt, synthetic construct
  misc_feature 1..762: note = derived and/or modified CDS sequence (opt11) from TOSV(TOSV/Firenze.ITA/1983/2)__KM275765.1__N
  source 1..762: mol_type = other RNA
atgtcagacgaaaactaccgagacatcgccctagccttcctcgacgagtgcgcagactccggcaccatcaacgcctgggtcaacgaattcgcctaccaaggcttcgacccaaaacgaatcgtccaactcgtaaaagaacgcggaaccgcaaaaggccgcgactggaaaaaagacgtaaaaatgatgatagtcctcaacctcgtacgcggcaacaaacccgaggccatgatgaaaaaaatgagcgaaaaaggcgccagcatcgtcgccaacctaatcagcgtctaccaactcaaagaaggaaaccccggacgcgacacaatcaccctcagccgcgtctcagccgccttcgtcccctggacagtacaagcactccgagtactcagcgaatccctacccgtaagcggcacgaccatggacgccatagccggcgtcacctacccacgcgccatgatgcacccaagcttcgcaggaatcatcgacctcgacctccccaacggcgctggagccaccatagccgacgcccacggcctcttcatgatcgaattctccaaaaccatcaacccgtccctccgaaccaaacaagcaaacgaagtcgccgccacattcgaaaaacccaacatggcagccatgagcggccgcttcttcacccgcgaagacaaaaaaaaactactaatcgccgtcggcataatcgacgaagacctcgtcctagccagcgccgtcgtccgctccgcagaaaaataccgagcaaaagtcggaaaataa

SEQ ID NO: 8315 - RNA, 738 nt, synthetic construct
  misc_feature 1..738: note = derived and/or modified CDS sequence (opt11) from SFTSV(HB29)__NC_018137.1__N
  source 1..738: mol_type = other RNA
atgagcgagtggtcgcgcatagccgtggagttcggcgaacaacaactcaacctaacagaattggaagacttcgcacgcgagctagcgtacgagggcctggacccggccctaatcatcaaaaagctaaaggaaacgggaggggacgactgggtaaaagacaccaaattcataatagtgttcgcgctaacgcgcgggaacaagatcgtgaaagcgagcggaaaaatgagcaacagcgggagcaagcgcctgatggcgcttcaggaaaagtacgggctcgtggaacgggccgagaccaggctctcgataacgcccgtgcgcgtggcacagagcctgcccacgtggacatgcgcagccgcagccgcactaaaagaatacctcccggtagggccagcggtcatgaacttgaaagtagaaaactacccgcccgagatgatgtgcatggccttcggctcgctaataccaacggccggggtctcggaagcgaccacgaaaacactcatggaagcgtactcactctggcaagacgccttcaccaaaaccataaacgtaaaaatgcgaggggcctcgaaaacggaagtgtacaacagctttcgcgaccccctgcacgcggccgtgaactcggtcttcttcccgaacgatgtaagggtcaagtggctgaaagcaaaagggatcctgggcccggacggggtcccgagcagggccgcggaagtggccgcagccgcgtacaggaacctgtga

SEQ ID NO: 8316 - RNA, 738 nt, synthetic construct
  misc_feature 1..738: note = derived and/or modified CDS sequence (opt11) from SFTSV(111S)__KP339904.1__N
  source 1..738: mol_type = other RNA
atgagcgagtggtcgagaatagccgtagagttcggcgaacaacagctcaacctcacggaattggaagacttcgcgcgcgagctcgcatacgagggactagacagggccctgatcataaagaaactcaaagaaacgggcggggacgactgggtgaaagacaccaagttcataatcgtattcgcactcacgcgcggaaacaagatcgtgaaagcgagcgggaaaatgagcaacagcgggagcaagcgcctgatggcgctacaggaaaaatacgggctcgtagaacgggccgagacaaggctctcaatcacacccgtgcgcgtggcccagagcctgcccacgtggacgtgcgcagccgcggccgcgctcaaggaatacctcccagtcggacccgcagtcatgaacctgaaagtggaaaactacccgcccgagatgatgtgcatggccttcggctcgctcataccaacggccggagtctcggaagcgaccacgaaaacgctcatggaagcgtactcgctctggcaagacgccttcaccaagaccataaacgtgaaaatgcgcggagcctcgaaaacggaagtgtacaacagcttccgagaccccctacacgcggcagtgaactcggtcttcttcccgaacgacgtcagggtcaagtggctgaaagcgaaagggatcctgggcccggacggggtcccgagcagagcagcagaagtggccgcggccgcgtacagaaacctgtga

SEQ ID NO: 8317 - RNA, 738 nt, synthetic construct
  misc_feature 1..738: note = derived and/or modified CDS sequence (opt11) from SFTSV(116S)__KP339905.1__N
  source 1..738: mol_type = other RNA
atgagcgagtggtcgcgcatagccgtggagttcggcgaacaacagctcaacctcacggaattggaagactttgcgcgagaactcgcgtacgagggcctagacccggcattgatcatcaaaaagctcaaggaaacgggcggggacgattgggtgaaagacaccaagttcataatagtgttcgcgctcacgcgcgggaacaagatcgtgaaggcgagcgggaaaatgagcaacagcggaagcaagcgactgatggcgctacaggaaaagtacgggctagtagaaagagccgagaccagactctcgatcacacccgtgcgcgtggcccagagcctgcccacgtggacgtgcgcggccgcggccgcgctcaaggaatatctcccggtcgggcccgcggtcatgaacctaaaagtggaaaattacccgcccgagatgatgtgcatggcattcggctcgctcatacccacagccggggtctcggaagcgaccacgaaaacgctcatggaagcgtactcgctctggcaagatgccttcaccaagacaataaacgtgaaaatgcgcggagcatcgaaaacggaaatatacaacagctttcgcgaccccctgcacgcggccgtgaactcggtatttttcccgaacgatgtcagagtcaagtggttaaaagcaaaagggatcctgggcccggacggggtcccgagcagggccgcagaagtggccgcagccgcgtacagaaacctgtga

SEQ ID NO: 8318 - RNA, 738 nt, synthetic construct
  misc_feature 1..738: note = derived and/or modified CDS sequence (opt11) from SFTSV(132S)__KP339912.1__N
  source 1..738: mol_type = other RNA
atgagcgagtggtcgcgcatagccgtggagttcggagaacaacagctcaacctcacagaactggaagacttcgcgcgcgaactagcatacgaaggcttggacccagccctgatcatcaaaaagctcaaggaaacgggcggggacgactgggtgaaagacaccaagttcataagcgtattcgcactcacgcgagggaacaagatagtgaaggcgagcggaaaaatgagcaacagcgggagcaagcgcctgatggcactccaggaaaagtacgggctcgtagaacgagccgagaccagactctcgataacgcccgtacgagtagcccagagcctgcccacgtggacgtgcgcggccgcggccgcgctcaaggaatacctcccagtcgggcccgcggtcatgaacctgaaagtggaaaactacccacccgagatgatgtgcatggccttcggctcgctcatccccacggccggggtctcggaagcgaccacgaaaacgctcatggaagcgtactcactttggcaagacgcattcaccaagaccataaacgtgaaaatgcgcggggcctcaaaaacagaagtgtacaatagcttccgcgacccattgcacgcggccgtgaactcagtcttcttcccgaacgacgtcagggtcaagtggctgaaagcgaaagggatactaggcccggacggggtcccaagcagggcagcagaagtggccgcggccgcgtacaggaacctataa

SEQ ID NO: 8319 - RNA, 738 nt, synthetic construct
  misc_feature 1..738: note = derived and/or modified CDS sequence (opt11) from SFTSV(2014045S)__KR075923.1__N
  source 1..738: mol_type = other RNA
atgagcgagtggtcacgcatagccgtggagttcggcgaacaacagctcaacctaacggaattggaagacttcgcgcgagaactcgcgtatgagggcctagacccagccctgatcatcaaaaagctaaaggaaacaggcggggacgactgggtgaaagacaccaagttcataatagtgttcgcgctcacacgcgggaacaagatcgtgaaagcgagcgggaaaatgagcaacagcgggagcaaacgcctgatggcgctacaggaaaagtacgggctcgtagaaagggctgagaccaggctctcgatcacacccgtacgagtggcccagagcctacccacatggacgtgcgcagccgcggccgcgctcaaggaatacctcccggtcggacccgcagtcatgaacctgaaggtggaaaactacccgccagagatgatgtgcatggccttcggctcactcatccccacagccggggtatcggaagcgaccacaaaaacgctcatggaggcgtactcactatggcaagacgccttcacaaagaccataaacgtgaaaatgcgaggggcctcaaaaacggaagtgtacaacagcttccgcgaccccctacacgcggccgtgaactcggtcttcttcccgaacgacgtaagggtcaagtggctgaaagcgaaagggatcctgggcccagacggggccccgagccgggccgcggaagtagccgcggccgcatatagaaacctgtga

SEQ ID NO: 8320 - RNA, 738 nt, synthetic construct
  misc_feature 1..738: note = derived and/or modified CDS sequence (opt11) from SFTSV(2014193S)__KR075916.1__N
  source 1..738: mol_type = other RNA
atgagcgagtggtcgcgaatagccgtggagttcggcgaacaacagctcaacctcacggaattagaagacttcgcgcgcgagctcgcgtacgagggcctggacccggccttgatcatcaaaaagctaaaggaaacgggcggggacgattgggtgaaagatacaaagttcataatagtgttcgcgctaacgcgagggaacaagatcgtgaaagcaagcgggaaaatgagcaacagcggaagcaagagattaatggcactccaggaaaagtacgggctagtggaaagagccgaaaccaggctctcggtcacacccgtacgcgtggcccagagcttaccaacgtggacatgcgcggcagcggcagcgctaaaggaatatctaccggtcgggcccgcggtcatgaacctgaaagtggaaaattacccgcccgagatgatgtgcatggccttcgggtcgctaatacccacggcaggagtctcggaagcgaccacgaaaacgctcatggaagcgtactcgctctggcaagacgcctttaccaagaccataaacgtgaaaatgcgcggggcctcgaaaacagaagtgtacaatagcttccgcgatcccctgcacgcggccgtgaactcggtcttcttcccaaacgacgtcagagtaaagtggttaaaagcgaaagggatcttgggcccggacggggtcccgagcagagccgcggaagtggccgcggccgcctacaggaacctgtga

SEQ ID NO: 8321 - RNA, 738 nt, synthetic construct
  misc_feature 1..738: note = derived and/or modified CDS sequence (opt11) from SFTSV(2015SH232S)__KT736097.1__N
  source 1..738: mol_type = other RNA
atgagcgagtggtcgcgcatagccgtggagttcggcgaacaacaactcaatctcacggaactggaagatttcgcgcgcgagctcgcgtacgagggattggacccagccctgatcatcaaaaagctaaaggaaacgggcggggatgactgggtgaaagacaccaaattcataatagtgttcgcgctcacgcgagggaacaagatcgtaaaagcgtccgggaaaatgagcaacagcgggagcaagcgcctaatggcgctccaggaaaagtacgggctagtggaaagggccgagaccaggctctcgatcacgcccgtgcgcgtagcccagagcctgcccacatggacgtgcgcggccgcagccgcgctcaaggaatatctcccggtcggacccgcggtcatgaacctgaaagtggaaaactacccgcccgagatgatgtgcatggcctttggctcgctcatacccacggccggggtctcagaagcgaccacgaaaacgctcatggaagcgtactcactctggcaagatgccttcaccaagacaataaacgtgaaaatgcgcggagcctcgaaaacggaagtatacaacagtttccgcgaccccctgcacgcggccgtgaactcggtcttcttcccgaacgatgtaagggtaagatggttgaaagcgaaagggatcttgggcccggacggggtaccgagtagggccgcggaagtggccgcggccgcgtacaggaacttgtga

SEQ ID NO: 8322 - RNA, 738 nt, synthetic construct
  misc_feature 1..738: note = derived and/or modified CDS sequence (opt11) from SFTSV(2015SYSH33)__KT380653.1__N
  source 1..738: mol_type = other RNA
ctaagcgaatggtcacgcatagccgtggagttcggcgaacaacagctcaacctcacagaactggaagacttcgcgcgcgaactagcgtacgagggcctggacccggccctgatcatcaaaaagctcaaagaaacgggcggagacgattgggtaaaagataccaagttcataatagtgttcgcgctcacgcgcggaaacaagatcgtgaaagcgagcgggaaaatgagcaacagcggcagcaaacgcctgatggcgctccaggaaaagtacggactcgtagaacgagccgagacccggctatcaatcacgcccgtgcgcgtggcccagagcctgccaacgtggacatgcgcggccgcggccgctttaaaggaatacctcccggtcgggcccgcggtcatgaacttgaaagtggaaaactacccgcccgagatgatgtgcatggccttcggctcgctcatacccacggccggggtctcagaagcgaccacgaaaacgctcatggaagcatactcgctctggcaagacgccttcaccaagaccatcaacgtgaaaatgcgcggagcctcaaaaacggaagtatacaacagcttccgcgaccccctgcacgcggccgtgaactcagtcttcttcccgaacgacgtcagggtcaagtggctaaaagcgaaaggaatcctgggcccggacggagtcccgagcagggccgcggaagtggccgcagccgcatacagaaacctgtga

SEQ ID NO: 8323 - RNA, 738 nt, synthetic construct
  misc_feature 1..738: note = derived and/or modified CDS sequence (opt11) from SFTSV(2015SYSH86)__KT380657.1__N
  source 1..738: mol_type = other RNA
atgagcgagtggtcgagaatagccgtagagttcggagaacaacagctcaacctcacggaactggaagatttcgcgcgcgaactcgcgtacgaaggactagacccggccctgatcatcaaaaagctcaaggaaacaggcggggacgactgggtgaaagacaccaagtttataatagtgttcgcgctcacacgcggaaacaagatcataaaagcgagcgggaaaatgagcaacagcgggagcaaacgactgatggcgctccaggaaaagtacggactcgtggaaagggccgagaccaggctctcgatcacgcccgtgcgcgtggcccagagcctgcccacgtggacgtgcgcagcagcggcagcgctcaaggaatacctcccggtaggacccgcggtaatgaacctgaaagtggaaaactacccgcccgagatgatgtgcatggccttcggatcgctcatacccacggccggggtctcggaagcaaccacgaaaacgctcatggaagcgtactcgctctggcaagacgcatttaccaagaccataaacgtgaaaatgcgaggggcctcgaaaacagaagtatacaacagcttccgagaccccctgcacgcggccgtaaactcggtcttcttcccgaacgatgtcagggtcaagtggctaaaagcgaaagggatcctgggcccggacggcgtaccgagccgggccgcggaagtggcagcggccgcatacaggaacctgtga

SEQ ID NO: 8324 - RNA, 738 nt, synthetic construct
  misc_feature 1..738: note = derived and/or modified CDS sequence (opt11) from SFTSV(67S)__KP339890.1__N
  source 1..738: mol_type = other RNA
atgagcgagtggtcgcgcatagccgtggagttcgccgaacaacaactcaacctcacagaactggaagacttcgcgcgcgagctagcgtacgagggcctggacccggcactgatcatcaaaaagctcaaggaaacgggcggggacgactgggtcaaagacaccaagttcataatagtgttcgcgctcacgcgcgggaacaagatcgtgaaagcaagtgggaaaatgagcaacagcggaagcaagcgcctgatggcgctccaggaaaagtacgggctcgtggaaagagccgagaccagactctcgatcacgcccgtgcgcgtggcccagagcctgcccacgtggacatgcgcggccgcggccgcactcaaggaatacctaccggtcgggcccgcggtcatgaacctgaaagtggaaaattacccacccgagatgatgtgcatggccttcggctcgctcatccccacggccggggtctcggaagcgacaacgaaaacgctcatggaagcgtactcgctctggcaagacgccttcaccaagaccataaacgtgaaaatgcgcggggcctcgaaaacggaagtgtacaacagcttccgcgaccccctgcacgcggccgtaaactccgtcttcttcccgaacgatgtaagagtaaagtggctgaaagcgaaaggaatactaggcccagacggggtcccaagcagggccgcggaagtagccgcggccgcgtacaggaacttgtga

SEQ ID NO: 8325 - RNA, 738 nt, synthetic construct
  misc_feature 1..738: note = derived and/or modified CDS sequence (opt11) from SFTSV(6S)__KP339927.1__N
  source 1..738: mol_type = other RNA
atgagcgagtggtcgcgcatagcagtggaatttggcgaacaacagctaaacctcacagaactggaagacttcgcgcgcgagctcgcgtacgagggcctggacccggcactaatcatcaaaaagctcaaggaaacaggcggagacgactgggtgaaagacacaaagttcataatagtgttcgcgctcacgcgcgggaacaagatcgtaaaagcgagcgggaaaatgagcaacagcgggagcaagcgcctgatggcgctacaggaaaagtacggactcgtggaaagagccgagacaaggttctcgatcacccccgtgcgcgtggcccaaagcctgcccacgtggacgtgcgcagccgcggccgcgctaaaagaatatctcccggtcgggcccgcggtcatgaacctgaaagtggaaaactacccgcccgagatgatgtgcatggccttcggatcactcatacccacggccggggtctcggaagcgaccacgaaaacgctaatggaagcgtactcgctctggcaagacgcattcaccaagaccataaacgtgaaaatgcgcggggcctcgaaaacggaagtgtacaacagctttcgcgatcccctgcacgcggccgtgaactcggtattcttcccgaacgacgtcagggtaaagtggctaaaagcgaaagggatcttgggcccggacggggtcccgagcagggccgcggaagtggccgcggccgcgtacagaaacttgtga

SEQ ID NO: 8326 - RNA, 738 nt, synthetic construct
  misc_feature 1..738: note = derived and/or modified CDS sequence (opt11) from SFTSV(72S)__KP339891.1__N
  source 1..738: mol_type = other RNA
atgagcgaatggtcacgcatagccgtggagttcggcgaacaacagctcacgctcacggaactggaagacttcgcgcgcgaactcgcgtacgagggcctggacccggccctgataatcaaaaagctcaaggaaacaggaggggacgactgggtgaaagacactaagttcataatagtattcgcgctcacgcgcgggaacaaaatcgtgaaagcgagcgggaaaatgagcaatagcgggagtaagcgcctgatggcgctccaggaaaagtacgggctcgtggaaagagccgagaccaggctatcgatcacgcccgtacgcgtggcacagagcctgcccacgtggacgtgcgcggccgcggccgcgctcaaggaatatctaccggtcggacccgcggtcatgaacttgaaagtagaaaattacccgcccgaaatgatgtgcatggccttcggctcactcataccaacggcaggggtctcagaagcgaccacgaaaacgctcatggaagcgtactcgctctggcaagacgccttcaccaagaccataaacgtgaaaatgagaggggcctcaaaaacggaagtgtacaacagcttccgcgatcccttacacgcggccgtgaactcagtcttcttcccaaacgacgtccgggtcaggtggttgaaagcaaaagggatcttgggcccggacggggtcccgagcagggccgcggaagtggccgcggccgcgtacaggaacctgtga

SEQ ID NO: 8327 - RNA, 738 nt, synthetic construct
  misc_feature 1..738: note = derived and/or modified CDS sequence (opt11) from SFTSV(AP01-Korea-13)__KR612072.1__N
  source 1..738: mol_type = other RNA
atgagcgagtggtcgcgcatagcagtggagttcggagaacaacagctcaacctcacggaactggaagacttcgcgcgcgagctcgcgtacgagggcctggacccggccctgatcatcaaaaagctcaaggaaacgggtggagacgactgggtgcgcgacactaagttcataatagtgttcgcgctcacacgcgggaacaagatcgtaaaagcgagcgggaaaatgagcaacagcgggagcaaacgcctgatggcgctacaggaaaagtacgggctcgtggaaagggccgagaccagactctcgatcacgcccgtgcgcgtggcccagagcctgcccacgtggacgtgcgcagccgcggccgcactcaaggaatacctaccagtcgggcccgcagtcatgaacctgaaagtggaaaactacccgcccgagatgatgtgcatggccttcggctcactcatacccacggccggggtctcggaagcgaccacgaaaacactaatggaagcgtactcactctggcaagacgccttcaccaagacaataaacgtgaaaatgcgcggggcctcgaaaacggaagtgtacaacagcttccgcgaccccttgcacgcggccgtcaactcagtatttttcccaaacgacgtcagagtcaaatggctgaaagcaaaaggaatcctgggcccagacggggtcccgagccgggccgcggaagtggccgcggccgcgtacaggaacctgtga

SEQ ID NO: 8328 - RNA, 738 nt, synthetic construct
  misc_feature 1..738: note = derived and/or modified CDS sequence (opt11) from SFTSV(JP03-Korea-13)__KR612079.1__N
  source 1..738: mol_type = other RNA
atgagtgagtggtcgcgcatagccgtagagttcggcgaacaacagctcaacctcacggaactggaagacttcgcgcgcgagctcgcatacgagggactggacccagccctaataatcaaaaagctaaaagaaacgggaggggacgactgggtgcgcgacaccaagttcataatagtgttcgcgctaacgcgcgggaacaagatcgtgaaagcaagcgggaaaatgagcaacagcgggagcaagcgcctgatggcgctacaggaaaagtacgggctcgtggaaagagccgagaccaggctctcgatcacacccgtacgcgtggcccaaagcctgcccacgtggacatgcgcggccgcagccgcgctcaaggaatacctcccggtcgggcccgcagtcatgaacctaaaagtagaaaactacccgcccgaaatgatgtgcatggccttcggctcgctcataccaacggccggagtctcggaagcgacaacaaaaacgctcatggaagcgtactcactctggcaagacgccttcaccaagaccataaacgtgaaaatgcgcggggcctcgaaaacagaagtgtacaacagcttccgcgaccccctgcacgcggccgtgaactcagtcttcttcccgaacgacgtcagggtcaagtggttgaaagcaaaaggaatcctgggcccggacggcatcccgagcagagccgcggaagtggcagcggccgcatacagaaacctgtga

SEQ ID NO: 8329 - RNA, 738 nt, synthetic construct
  misc_feature 1..738: note = derived and/or modified CDS sequence (opt11) from SFTSV(JP07-Korea-13)__KR612088.1__N
  source 1..738: mol_type = other RNA
atgagtgaatggtcgcgcatagccgtagaatttggcgagcaccagctcaatctaacagaattggaagacttcgcgcgagagctcgcatacgagggcttggacccggccctgatcatcaaaaagctcaaggaaacgggaggagacgactgggtacgcgacaccaagttcataatagtgttcgcgcttacgcgcgggaacaagatcgtgaaagcgagtggaaaaatgagcaatagtgggagtaagcgcctgatggcgctccaggaaaagtacgggctcgtagaaagagccgagacaaggctatcgatcacacccgtgcgcgtagcccagagcctgcccacgtggacgtgcgcggccgcagcagcactaaaagaatacctcccagtcgggcccgcggtcatgaacctgaaagtagaaaattacccgcccgagatgatgtgcatggccttcggctcgctcatacccacggccggggtctcggaagcgaccacgaaaacgctcatggaagcgtactcactatggcaagacgcattcaccaagaccataaacgtgaaaatgcgcggagcctcgaaaacggaagtatacaatagcttccgcgaccccctgcacgcggccgtaaactcggtcttcttcccgaacgatgtcagggtcaagtggctgaaagcgaaagggatcctgggcccggacggggtcccgagcagagcagcggaagtggccgcggccgcgtacagaaacctgtga

SEQ ID NO: 8330 - RNA, 738 nt, synthetic construct
  misc_feature 1..738: note = derived and/or modified CDS sequence (opt11) from SFTSV(JS2011-13-2)__KR230790.1__N
  source 1..738: mol_type = other RNA
atgagcgaatggtcgcgcatagccgtggagttcggcgaacaacagctcaacctcacggaattggaagacttcgcgcgcgaactcgcgtacgaaggcctggacccggccctgatcatcaaaaagctcaaggaaacgggcggggacgactgggtgaaagacacaaagttcataatagtattcgcgctcacacgcggaaacaagatcgtgaaagcgagcgggaaaatgagctcgagcgggagcaagcgcctgatggcgctccaggaaaagtacggactcgtggaaagagcagagaccaggctctcaatcacgccagtacgcgtagcccagagcctgcccacgtggacgtgcgcggccgcggcagcgctcaaggaatacctcccggtcgggccagcggtcatgaacttgaaagtggaaaactacccgcccgagatgatgtgcatggcattcggctcgctcatacccacggccggggtctcagaagcgaccacgaaaacactcatggaagcatactcactctggcaagacgccttcaccaagaccataaacgtgaaaatgcgaggggcatcgaaaacagaagtgtacaacagcttccgcgaccccctgcacgcggccgtaaactcagtcttcttcccgaacgacgtcagagtcaagtggctaaaggcgaaagggatcctaggcccggacggggtcccgagccgggccgcggaagtggccgcggccgcatacaggaacctgtga

SEQ ID NO: 8331 - RNA, 738 nt, synthetic construct
  misc_feature 1..738: note = derived and/or modified CDS sequence (opt11) from SFTSV(JS2014-15)__KR230799.1__N
  source 1..738: mol_type = other RNA
atgagcgagtggtcgcgcattgccgtagagttcggagaacaacagctcaacctcacggaactggaagacttcgcgcgagagctcgcgtacgagggcctggacccggccctgatcatcaaaaagctcaaggaaacgggcggagacgactgggtaaaagacaccaaattcataatagtgttcgcgctcacgcgcgggaacaaaatcgtgaaagcgagcgggaaaatgagtaacagcgggagcaagcgcctgatggcgttacaggaaaagtacgggctcgtggaaagggccgagacacggctatcgatcacacccgtacgcgtagcccagagcctgcccacgtggacgtgcgcggccgcggcagcgctaaaggaatacctcctggtcgggcccgcggtcatgaacttgaaagtggaaaactacccgcccgagatgatgtgcatggcctttggctcactcatacccacggccggggtctcagaagcgacaacaaaaacactcatggaagcgtactcgctctggcaagacgccttcaccaagaccataaacgtgaaaatgcgtggggcctcaaaaacagaagtgtacaacagctttcgcgaccccttgcacgcggccgtgaactcggtcttcttcccgaacgacgtcagggtcaagtggctgaaagcgaaagggatcctgggcccggacggagtcccaagcagggccgcggaagtggccgcggccgcgtacaggaacttgtga

SEQ ID NO: 8332 - RNA, 738 nt, synthetic construct
  misc_feature 1..738: note = derived and/or modified CDS sequence (opt11) from SFTSV(KASJH)__KP663733.1__N
  source 1..738: mol_type = other RNA
atgagcgagtggtcgcgcatagccgtggaatttggcgagcaacagctcaatctatcggaactagaagacttcgcgcgcgagctcgcgtacgagggcctggacccggccttgatcatcaaaaagctcaaggaaacgggcggggacgactgggtgaaagacaccaagttcataatagtattcgcactcacgcgcggcaacaagatcgtgaaagcgagcggaaaaatgagcaacagcgggagcaagcgcctgatggcgctacaggaaaagtacgggctcgtggaaagagccgagacaaggctctcaatcacacccgtgcgcgtggcccagagcctgcccacgtggacgtgcgcagccgcggccgcgctcaaggaatacctcccggtcggacccgcggtcatgaacttgaaagtggaaaattacccgcccgagatgatgtgcatggcctttggctcgctaatacccacggccggggtctcggaagcgaccacgaaaacgctcatggaagcatactcgctctggcaagacgccttcacaaagacaataaacgtgaaaatgcgcggggcctcgaaaacggaagtgtacaacagctttcgagaccccctgcacgcggccgtgaacagtgtcttcttcccaaacgacgtcagggtcaagtggttgaaagcaaaagggatcttgggcccagacggggtcccgagcagggccgcggaagtggccgcagccgcgtacaggaatctgtga

SEQ ID NO: 8333 - RNA, 738 nt, synthetic construct
  misc_feature 1..738: note = derived and/or modified CDS sequence (opt11) from SFTSV(YSH116)__KT721303.1__N
  source 1..738: mol_type = other RNA
atgagcgagtggtcacgaatagccgtagagttcggcgaacaacagctaaacctcacagaactagaagacttcgcccgcgagctcgcgtacgaaggactggacccagccttgatcatcaaaaagctcaaggaaacaggcggagacgactgggtgaaagacaccaagttcataatagtgttcgcgctcacgcgcgggaacaagatagtgaaagcgagcggaaaaatgagcaacagcgggagcaagcgcctgatggcgctccaagaaaagtacgggctagtggaaagggcagagaccagactctcgatcacaccagtgcgcgtggcacagagcctgccaacgtggacgtgcgcagccgcggccgcactcaaggaatacctcccggtagggcccgcggtcatgaacctcaaagtggaaaactacccgcccgagatgatgtgcatggccttcggctcgctcatccccacggcaggagtctcagaagcgaccacaaaaacgctcatggaagcgtactcgctctggcaagacgtcttcacaaagaccataaacgtgaaaatgcgcggagcatcaaaaacggaagtgtacaacagcttccgagatcccctgcacgcggccgtaaactcggtcttcttcccgaacgacgtcagggtcaagtggctgaaagcgaaagggatcctaggcccggacggggtcccaagcagggccgcggaagtggccgcggccgcatacaggaacctgtga

SEQ ID NO: 8334 - RNA, 738 nt, synthetic construct
  misc_feature 1..738: note = derived and/or modified CDS sequence (opt11) from SFTSV(AH-YTY/China/05/2012)__KR017811.1__N
  source 1..738: mol_type = other RNA
atgagcgagtggtcgcgcatagccgtggaatttggcgagcaacagctcaatctcacggaactggaagattttgcacgcgagctagcgtacgaaggcctggacccagccctgatcataaagaaactcaaagaaacgggcggggacgactgggtgaaagacaccaagttcataatcgtattcgcgctcacgcgcgggaacaagatcgtgaaagcgagcggaaaaatgagcaacagcgggagcaagcgcctgatggcgctccaggaaaaatacggactcgtggaaagggccgaaaccagactctcaatcacgcccgtgcgcgtggcccagagcctgcccacgtggacgtgcgcggccgcagcagcgttaaaggaatacctccctgtcggacccgcggtcatgaacctgaaagtggaaaactacccacccgaaatgatgtgcatggccttcggctcgctcatacccacaaccggggtctcagaagcgaccacgaaaacgctcatggaagcgtactcactctggcaagacgccttcaccaaaaccataaacgtgaaaatgcgcggggcctcaaaaacggaagtgtacaacagcttccgcgaccccctgcacgcggccgtaaactcggtcttcttcccgaacgacgtcagggtcaagtggctgaaagcgaaagggatattaggcccggacggagtcccgagcagggccgcggaagtggccgcggccgcgtacaggaacctgtga

SEQ ID NO: 8335 - RNA, 738 nt, synthetic construct
  misc_feature 1..738: note = derived and/or modified CDS sequence (opt11) from SFTSV(DS02/CHN/2013)__KR698319.1__N
  source 1..738: mol_type = other RNA
atgagcgagtggtcgcgaatagccgtggagttcggcgaacaacagctcaacctcacggaattagaagatttcgcacgcgagctagcatacgagggcctagacccggccctgataataaagaaactaaaagaaactggcggggacgactgggtacgcgataccaagttcataatcgtgttcgcgctaacacgcgggaacaagatcgtaaaagcaagcgggaaaatgagcaacagcgggagcaagcgactgatggcgctccaggaaaagtacgggctcgtggaaaaggccgaaaccaggctctcgatcacgcccgtgcgcgtggcccagagcttgccaacgtggacatgcgcggccgcggccgcactcaaggaatacctaccagtcgggcccgcagtcatgaacctgaaagtggaaaactacccgcccgagatgatgtgcatggccttcggctcgctcatacccacggcaggggtctcggaagcgaccacgaaaacgctcatggaagcatactcgctctggcaagacgccttcaccaagaccataaacgtaaaaatgcgcggggcctcaaaaacggaagtgtacaacagcttccgcgaccccctgcacgcagcagtgaactcagtattcttcccaaacgacgtcagagtcaaatggctgaaagcaaaagggatcctgggcccggacggagtcccaagcagggccgcggaagtggccgcggccgcgtacaggaacctatga

SEQ ID NO: 8336 - RNA, 738 nt, synthetic construct
  misc_feature 1..738: note = derived and/or modified CDS sequence (opt11) from SFTSV(HB2014-13)__KU738908.1__N
  source 1..738: mol_type = other RNA
atgagcgaatggtcgcgaatagccgtggagttcggcgaacaacagctcaatctcacggaactagaagacttcgcgcgcgagctcgcgtacgagggcctggacccggctttgatcatcaaaaagctaaaggaaacgggcggggacgactgggtaaaagacaccaagttcataatagtgttcgcgctcacgcgcgggaacaagatcgtgaaagcgagcgggaaaatgagcaacagcgggagcaagcgcctgatggcactccaggaaaagtacgggctagtggaaagggccgagaccaggctctcaatcacgcccgtgcgcgtagcccagagcctgcccacgtggacatgcgcggccgcagccgcactcaaggaatacctcccggtcggacccgcggtcatgaacttgaaagtggaaaattacccaccagagatgatgtgcatggccttcggctcgctaataccaacgaccggggtctcggaagcgaccacgaaaacgcttatggaagcatactcgctctggcaagacgccttcaccaagaccataaacgtgaaaatgcgaggggcctcgaaaacggaagtgtacaacagctttcgcgatcccctgcacgcagccgtgaactcggtcttcttcccgaacgatgtcagggtcaggtggttgaaagcgaaagggatcctgggcccggacggggtcccgagcagggccgcagaagtggcagcagccgcgtacaggaacttgtga

SEQ ID NO: 8337 - RNA, 738 nt, synthetic construct
  misc_feature 1..738: note = derived and/or modified CDS sequence (opt11) from SFTSV(HB2014-20)__KU738910.1__N
  source 1..738: mol_type = other RNA
atgagcgagtggtcacgcatagccgtggagttcggcgaacaacagctcaacctcacggaactggaagacttcgcgcgcgagctagcgtacgaaggcctagacccggccctgatcatcaaaaagctcaaggaaacgggcggagacgactgggtaaaagacaccaagttcataatagtcttcgcactaacgcgcgggaacaagatagtaaaagcgagcggaaaaatgagcaacagtggaagcaagcgcctgatgacactccaggaaaaatacgggctcgtggaaagggccgagacccggctatcgatcacgcccgtacgcgtggcacagagcctaccaacgtggacgtgcgcagccgcggccgcactcaaggaatacctcccggtcgggcccgcagtcatgaacctaaaagtggaaaactacccgcccgagatgatgtgcatggccttcggatcactcatacccacggccggagtctcagaagcaaccacaaaaacactcatggaagcgtactcactctggcaagatgccttcaccaagaccataaacgtgaaaatgcgaggagcctcgaaaacagaagtatacaacagcttccgagaccccctgcacgcggccgtgaactcagtcttcttcccgaacgacgtcagagtcaagtggctgaaagcaaaaggaatcctaggcccggacggagtcccgagcagggccgcggaagtagcagcggccgcgtacaggaacttatga

SEQ ID NO: 8338 - RNA, 738 nt, synthetic construct
  misc_feature 1..738: note = derived and/or modified CDS sequence (opt11) from SFTSV(LN2012-14)__KF887431.1__N
  source 1..738: mol_type = other RNA
atgagcgagcgatcacgcatagccgtggagttcggagaacaacagctcaacctcacgggcctggaagacttcgcgcgcgaactcgcgtacgaaggcctggacccggccctgatcatcaaaaagctcaaggaaacgggcggagacgactgggtgaaagacaccaagttcataatagtattcgcactcacgcgcggaaacaaaatcgtgaaagcaagcggaaaaatgagcaacagcgggagcaagcgcctgatggcgctccaggaaaagtacggactcgtggaaagggccgagaccaggctctcgataacgcccgtgcgcgtggcccagagcctgccaacatggacatgcgcggccgcagccgcgctcaaggaatacctcccggtcgggcccgccgtcatgaacctgaaagtcgaaaactatccgcccgagatgatgtgcatggccttcggctcgctcatacccacggcaggagtctcggaagcgacaacgcgcacgctcatggaagcatactcactatggcaagacgcattcaccaagaccataaacgtgaaaatgcgcggggcctcaaaaacggaagtgtacaacagctttcgcgaccccctgcacgcggccgtgaactcggtcttcttccccaacgacgtccgagtcaagtggctgaaagcgaaagggatcctgggcccggacggagtcccgagcagggccgcggaagtggccgcagccgcgtacagaaacctgtga

SEQ ID NO: 8339 - RNA, 738 nt, synthetic construct
  misc_feature 1..738: note = derived and/or modified CDS sequence (opt11) from SFTSV(NB31/CHN/2013)__KR698325.1__N
  source 1..738: mol_type = other RNA
atgagcgaatggtcgcgcatagccgtagagttcggcgaacaacagctcaacctcatagaattggaagacttcgcgcgcgagctcgcatacgaaggcctggacccggccttgatcataaagaaactcaaagaaacgggcggggacgactgggtgcgcgacaccaagttcataatcgtattcgcgctcacacgcggaaacaagatcgtgaaagcgagcgggaaaatgagcaacagcgggagcaagcgcctgatggcgctacaggaaaagtacgggttagtggaaaaggccgagaccaggctctcgataacgcccgtgcgcgtggcccagagcctgcccacgtggacatgcgcggccgcggccgcgctcaaggaatacctcccggtagggcccgcggtcatgaacctgaaagtagaaaactacccgcccgagatgatgtgcatggccttcggatcgctcatccccacggccggggtctcgaaaccaaccacgaaaacgctcatggaagcgtactcgctatggcaagacgcatttaccaagaccataaacgtgaaaatgcgcggcgcctcaaaaacagaagtgtacaacagcttccgagaccccctgcacgcggccgtaaactcggtctttttcccgaacgacgtcagagtcaagtggctgaaagcaaaagggatcttgggcccggacggagtcccgagcagagccgcggaagtggccgcggccgcatacaggaacttgtga

SEQ ID NO: 8340 - RNA, 738 nt, synthetic construct
  misc_feature 1..738: note = derived and/or modified CDS sequence (opt11) from SFTSV(QD7)__KR706565.1__N
  source 1..738: mol_type = other RNA
atgagcgagtggtctcgcatagccgtagagttcggagtgcaacagctcaacctcacggaactagaagactttgcgcgcgaactagcatacgagggcctggacccggccttgatcatcaaaaagctcaaagaaacgggaggggacgactgggtgaaagacaccaagttcataatcgtattcgcgctcacaagagggaacaagatcgtgaaagcgagcgggaaaatgagcaacagcggcagcaagcgactaatggcgctccaggaaaaatacgggctagtagaaagggccgaaacacgactctcaatcacgcccgtgcgcgtggcccagagcctgcccacgtggacgtgcgcggccgcggccgcgctaaaagaatacctcccggtaggacccgcggtcatgaacctgaaagtggaaaactatccgcccgagatgatgtgcatggccttcggctcgctcatacccacggccggggtctcggaagcgaccacgaaaacactcatggaagcgtactcgctctggcaagacgccttcaccaagaccataaacgtgaaaatgcgcggggcctcgaaaacggaagtgtacaacagcttcagagaccccctgcacgcggccgtgaactcagtcttcttcccgaacgacgtcagggtcaagtggctgaaagcgaaagggatcctaggcccggacggagtcccgagcagggccgcggaagtggccgcggccgcgtacagaaacctgtga

SEQ ID NO: 8341 - RNA, 738 nt, synthetic construct
  misc_feature 1..738: note = derived and/or modified CDS sequence (opt11) from SFTSV(SDLZP06/2011)__JQ693009.1__N
  source 1..738: mol_type = other RNA
atgagcgagtggtcgcgcacggcagtggaatttggcgagcaacagctaaacctcacggaactggaagacttcgcgcgcgagctcgcgtacgagggcctggacccggccttgatcatcaaaaagctcaaggaaacaggcggggacgactgggtgaaagacaccaagttcataatagtgttcgcgctcacgcgcgggaacaagatcgtaaaagcgagtgggaaaatgagcaacagcgggagcaagcgactgatggcgctccaggaaaagtacgggctagtggaaagggccgagacaaggctctcgatcacgccagtacgcgtagcccagagcctgccaacgtggacgtgcgcggccgcggccgcgctcaaggaatacctcccggtcgggcccgcagtcatgaacctgaaagtggaaaattacccacccgagatgatgtgcatggcctttggctcactcataccaacggcaggagtctcggaagcaacaacgaaaacgctcatggaagcgtactcactctggcaagacgccttcacaaagaccataaacgtaaaaatgcgcggggcctcgaaaacagaagtgtacaacagcttccgcgaccccttgcacgcggccgtcaactcggtcttctttccgaacgacgtaagggtcaagtggctgaaagcgaaaggaatcttgggcccggacggagtcccgagcagggccgcggaagtagccgcagccgcgtacagaaacctgtga

SEQ ID NO: 8342 - RNA, 738 nt, synthetic construct
  misc_feature 1..738: note = derived and/or modified CDS sequence (opt11) from SFTSV(ZJZHSH-FDE/China/06/2012)__KR017821.1__N
  source 1..738: mol_type = other RNA
atgagcgagtggtcgcgcatagcagtggagttcggcgaacaacagctcaatctcacggaactggaagacttcgcgcgcgagctcgcgtacgagggcctagacccggccctgatcatcaaaaagctcaaggaaacaggcggagacgactgggtgcgcgacaccaaattcataatagtgttcgcgctcacgcgcgggaacaagatcgtgaaagcgagtgggaaaatgagcaacagcggaagcaagcgcctgatggcactccaggaaaagtacgggctcgtggaaaaggccgagaccaggctctcaatcacgcccgtacgcgtggcccaaagcctacccacgtggacgtgcgcagcagcggcagcgctcaaggaatatctaccggtcgggcccgcggtcatgaacttgaaagtggaaaattacccgcccgagatgatgtgcatggccttcggctcgctaatacccacagccggggtctcggaagcaaccacaaaaacgctaatggaagcgtactcgctctggcaagacgccttcaccaagacaataaacgtaaaaatgcgcggggcctcgaaaacggaagtgtacaacagcttccgcgaccccttacacgcggccgtgaactcggtcctgttcccgaacgacgtcagggtcaaatggttgaaagcgaaaggaatcttgggaccggacggggtcccgagcagggccgcagaagtggccgcagccgcgtacaggaacctgtga

SEQ ID NO: 8343 - RNA, 738 nt, synthetic construct
  misc_feature 1..738: note = derived and/or modified CDS sequence (opt11) from SFTSV(ZJZHSH-FZHR/China/07/2013)__KR017824.1__N
  source 1..738: mol_type = other RNA
atgagcgagtggtcacgaatagccgtggaatttggcgagcaacagctcaatctaacggaattagaagatttcgcgcgcgagctagcgtacgagggcctggacccggccctgataatcaaaaagctcaaggaaacgggaggggacgactggatgaaagacaccaagttcataatagtgttcgcgctcacgcgcgggaacaagatcgtgaaagcgagcgggaaaatgagcaatagcgggagcaagcgcttgatggcactccaggaaaagtacgggctcgtggaaagagccgagaccaggctctcgatcacgcccgtgcgcgtagcccagagcctgcccacgtggacgtgcgcggccgcggccgcactaaaggaatatctaccggtcgggcccgcggtcatgaacttaaaagtggaaaattacccgcccgagatgatgtgcatggccttcggctcgctcatacccacggccggggtctcggaagcgacaaccaaaacgctcatggaagcgtactcactctggcaagacgcctttaccaagaccataaacgtgaaaatgagaggggcctcgaaaacggaagtgtacaatagctttcgcgatcccttgcacgcggccgtgaactcggtcttcttcccgaacgatgtacgggtcaagtggctaaaagcgaaagggatcctgggcccggacggggtaccgagtagagccgcggaagtagccgcggccgcatacaggaacctgtga

SEQ ID NO: 8344 - RNA, 738 nt, synthetic construct
  misc_feature 1..738: note = derived and/or modified CDS sequence (opt11) from SFTSV(ZJZHSH-HYC/China/05/2012)__KR017809.1__N
  source 1..738: mol_type = other RNA
atgagcgagtggtcacgcatagccgtggaatttggcgagcaacagctaaatctcacggaactggaagacttcgcgcgcgagctcgcgtacgagggcttggacccggccttgatcatcaaaaagctcaaggaaacgggcggagacgactgggtgcgcgacaccaaattcataatagtgttcgcgctcacgcgcgggaacaagatcgtaaaagcgagcgggaaaatgagcaatagcgggagcaagcgcctaatggcgctacaggaaaagtacgggctcgtagaaaaggccgagaccagactctcgatcacgcccgtgcgagtggcccagagcttgcccacgtggacgtgcgcggccgcggccgcgctcaaggaatatctaccggtcgggcccgcggtaatgaacctgaaagtggaaaattacccgcccgaaatgatgtgcatggccttcggctcactcatccccacggtcggggtctcggaagcgaccacgaaaacgctaatggaagcgtactcgctctggcaagatgcatttaccaagaccataaacgtaaaaatgcgcggggcctcgaaaacggaagtgtacaatagcttccgcgatcccctacacgcggccgtgaactcggtcttcttcccgaacgatgtcagggtcaagtggttgaaagcgaaaggaatcttgggcccggacggggtcccaagcagagccgcggaagtggccgcggccgcatacaggaacttgtga

SEQ ID NO: 8345 - RNA, 738 nt, synthetic construct
  misc_feature 1..738: note = derived and/or modified CDS sequence (opt11) from SFTSV(SPL003A)__AB817996.1__N
  source 1..738: mol_type = other RNA
atgagcgagtggtcacgcatagccgtggagttcggcgaacaacaactcaacctcacggaactggaagacttcgcacgcgaactagcgtacgaaggcctagacccagcactaatcatcaaaaagctcaaggaaacgggcggagacgactgggtacgagacaccaagttcataatagtattcgcactcacgcgcgggaacaagatcgtgaaagcgagcgggaaaatgagcaacagcgggagcaagcgcctaatggcgctccaggaaaagtacgggctcgtggaaagagccgagacccgactctcgatcacgcccgtgcgcgtggcccagagcctacccacgtggacgtgcgcggccgcggccgcgctcaaggaatacctcccggtcgggcccgcagtcatgaacctgaaagtggaaaactacccgcccgagatgatgtgcatggcattcggctcgctcatacccacggccggagtatcagaagcgaccacaaaaacactcatggaagcgtactcgctctggcaagacgccttcaccaagaccataaacgtcaaaatgcgcggggcctccaaaacagaagtgtacaacagcttccgagacccactacacgcggcagtgaactcagtcttcttcccgaacgatgtcagagtaaagtggctgaaagcaaaaggaatcctaggaccggacggggccccgagcagagccgcagaagtggccgcagccgcgtaccgaaacctgtga

SEQ ID NO: 8346 - RNA, 738 nt, synthetic construct
  misc_feature 1..738: note = derived and/or modified CDS sequence (opt11) from SFTSV(SPL077A)__AB985536.1__N
  source 1..738: mol_type = other RNA
atgagcgagtggccgcgcatagccgtggaatttggcgaacaacagctcaatctcacggaattggaagatttcgcacgagagctcgcgtacgagggattggacccagccttaattatcaaaaagctcaaggaaacgggcggggacgactgggtgcgcgataccaagttcataatagtgtttgcactcacgcgagggaacaagatcgtgaaagcgagcgggaaaatgagcaacagtgggagcaagcgcttgatggcgctccaggaaaagtacgggctcgtggaaagagccgagacaaggctctcaataacgcccgtgcgcgtggcccagagcctgccaacgtggacgtgcgcggccgcggccgcgctcaaggaatatctcccggtcgggccagcggtcatgaacctgaaagtggaaaattacccaccagagatgatgtgcatggcctttggatcactaatacccacggccggagtctcggaagcaaccacaaaaacgctcatggaagcgtactcgctatggcaagacgcctttaccaagacaataaacgtgaaaatgcgcggggcatcgaaaacggaagtgtacaatagcttccgagatcccttgcacgcggccgtgaactcggtcttcttcccgaacgatgtcagggtcaagtggttaaaagcaaaagggatcttgggcccggacggggtcccgagcagagccgcggaagtagccgcggccgcgtacaggaacttgtaa

SEQ ID NO: 8347 - RNA, 738 nt, synthetic construct
  misc_feature 1..738: note = derived and/or modified CDS sequence (opt11) from SFTSV(SPL106A)__AB985548.1__N
  source 1..738: mol_type = other RNA
atgagcgactggtcgcgaatcgccgtagagttcggcgaacaacaactcaacctcacggaactagaagacttcgcacgcgaactcgcatacgaaggcctcgacccggccctgatcatcaaaaagctcaaagaaacaggcggcgacgactgggtccgcgacaccaaattcataatagtcttcgccctcacacgcggaaacaagatcgtaaaagcaagcgggaaaatgagcaacagcggaagcaagcgcctaatggcactccaagaaaaatacggactcgtagaaagagccgaaaccagactctcaatcacacccgtacgcgtggcccagtccctacccacctggacctgcgcagccgcagccgcactaaaagaatacctaccggtcggacccgcagtcatgaacctgaaagtagaaaactacccacccgaaatgatgtgcatggccttcggctcactcatacccacagccggggtctccgaagcaaccacaaaaacactcatggaagcatactcactctggcaagacgccttcaccaaaaccatcaacgtcaaaatgcgcggggcctcaaaaacggaagtatacaacagcttccgcgaccccctacacgcggccgtgaactcagtattcttcccaaacgacgtcagagtcaagtggttaaaagcaaaagggatcctaggcccggacggagtcccaagcagggccgccgaagtagccgcagccgcatacagaaacctgtaa

SEQ ID NO: 8348 - RNA, 738 nt, synthetic construct
  misc_feature 1..738: note = derived and/or modified CDS sequence (opt11) from SFTSV(SPL114A)__AB985552.1__N
  source 1..738: mol_type = other RNA
atgagcgagtggtcgcgcatagccgtggagttcggcgaacaacagctcaacctcacggaactggaagacttcgcgcgcgagctcgcgtacgaaggcctagacccggccctgatcatcaaaaagctcaaggaaacgggcggggacgactgggtgcgcgacaccaagttcataatagtgttcgccctcacgcgagggaacaagatagtgaaagcgcccgggaaaatgagcaacagtgggagtaagcgactaatggcgcttcaggaaaagtacgggctcgtggaaagggccgagaccagactctcaatcacacccgtgcgagtggcccagagcctgcccacgtggacatgcgcggccgcggccgcgctcaaagaatacctcccggtcgggcctgcggtcatgaacctgaaagtagaaaactacccacccgagatgatgtgcatggcattcggctcactaatacccacggccggggtctcggaagcgaccacgaaaacactcatggaagcatactcactatggcaagacgccttcacaaagaccataaacgtgaaaatgcgaggggcctcgaaaacggaagtatacaacagcttccgcgaccccctgcacgcggccgtgaactcagtcttcttcccgaacgacgtcagggtcaaatggctgaaagcaaaaggaatcctaggcccggacggagtcccgagcagagccgcggaagtggccgcagccgcgtacaggaacctgtga

SEQ ID NO: 8349 - RNA, 738 nt, synthetic construct
  misc_feature 1..738: note = derived and/or modified CDS sequence (opt11) from SFTSV(SPL125A)__AB985557.1__N
  source 1..738: mol_type = other RNA
atgagcgagtggtcgggcgtggccgtagagttcggcgaacaacagctcaatctcacggaattggaagatttcgcgcgcgaactcgcgtacgagggactggacccggccttgatcatcaaaaagctcaaagagacgggcggggacgattgggtgcgcgacacaaagttcataatagtgttcgcactcacacgagggaacaagatagtgaaagcgagcgggaaaatgagcaatagcggcagcaagcgcctaatggcgctccaggaaaagtacgggctcgtagaaagagccgagaccagactctcgatcacgcccgtgcgagtggcccagagcttgcccacatggacgtgcgcggccgcggccgcgctcaaggaatacctaccggtcgggcccgcggtcatgaacttaaaagtggaaaactacccgcccgagatgatgtgcatggcctttggctcactcatacccacggccggggtctcggaagcgaccacgaaaacgctcatggaagcgtactcgctctggcaagatgccttcaccaagaccattaacgtgaaaatgagaggggcctcgaaaacagaagtgtacaacagctttcgagaccccctacacgcggccgtgaactcggtcttcttcccgaacgacgtcagggtcaagtggctgaaagcaaaagggatcctgggcccggacggggtcccgagcagagccgcagaagtggccgcggcagcgtacagaaacctgtga

SEQ ID NO: 8350 - RNA, 738 nt, synthetic construct
  misc_feature 1..738: note = derived and/or modified CDS sequence (opt11) from SFTSV(SPL160A)__AB985571.1__N
  source 1..738: mol_type = other RNA
atgagcgagtggtcgcgcatagccgtggagttcggcgaacaacagctaaacctcacggaattggaagacttcgcgcgcgaactcgcatacgagggattggacccggccctgattataaccaagctaaaggaaacgggaggagacgactgggtgcgcgacaccaaattcataatcgtgttcgcactcacgcgaggaaacaaaatcgtgaaagcgagcgggaaaatgagcaacagcgggagcaagcgcctgatggcgctccaggaaaagtacggactcgtagaaagagccgagaccaggctctcgatcacacccgtgcgcgtggcccagagcctgcccacgtggacatgcgcggccgcggccgcgctcaaggaatacctcccggtcgggcccgcggtcatgaacttgaaagtggaaaactacccacccgaaatgatgtgcatggccttcggctcacttatacccacggccggagtctcggaagcgaccacaaaaacgctcatggaagcgtactcactctggcaagatgccttcaccaagaccataaacgtgaaaatgagaggggcctcaaaaacggaagtgtacaacagcttccgcgaccccctacacgcggccgtgaactcagtcttcttcccgaacgacgtcagggtcaagtggttgaaagcgaaagggatcctaggcccagacggggtcccaagcagggccgcggaagtagccgcggccgcgtacaggaacctgtga

SEQ ID NO: 8351 - RNA, 738 nt, synthetic construct
  misc_feature 1..738: note = derived and/or modified CDS sequence (opt11) from SFTSV(SPL163A)__AB985573.1__N
  source 1..738: mol_type = other RNA
atgagcgagtggtcgagaatagcagtggagttcggcgaacaacagctaaacctcacggaactggaagacttcgcgcgcgaactcgcgtacgagggcctggacccggccctaatcatcaaaaagctcaaggaaacgggcggggacgactgggtgcgcgataccaagttcataatagtgttcccactaacgcgcgggaacaagatcgtgaaagcgagcggaaaaatgagcaatagcggaagcaagcgcctgatggcgctccaggaaaaatacgggctcgtggaaagggcagaaacaagactctcgatcacaccagtgcgcgtggcccagagcctacccacatggacatgcgcagccgcggccgcgctcaaggaatacctcccggtcggacccgcagtcatgaacctgaaagtggaaaactacccgcccgagatgatgtgcatggccttcggctcactcatacccacggccggagtctcggaagcaaccacgaaaacgctaatggaagcatactcgctctggcaagacgcattcaccaagaccataaacgtaaaaatgcgcggggcatcgaaaaccgaagtatacaatagcttccgcgaccccttgcacgcggccgtaaactcggtcttcttcccgaacgacgtcagagtcaagtggctgaaagcgaaagggatcctgggcccggacggggtcccgagtagggccgcagaagtggcagcagccgcatacaggaacctgtga

SEQ ID NO: 8352 - RNA, 738 nt, synthetic construct
  misc_feature 1..738: note = derived and/or modified CDS sequence (opt11) from SFTSV/FTLSV(2011YPQ12)__KF711915.1__N
  source 1..738: mol_type = other RNA
atgagcaagtggtcacgcatagccgtggagttcggcgaacaacagctcaacctaacggaactggaagacttcgcacgcgagctcgcgtacgagggcctagacccggccctgatcatcaaaaagctcaaggaaacgggcggagacgattgggtgaaagacaccaagttcataatagtgttcgcactcacgcgcgggaacaagatcgtgaaagcaagcggaaaaatgagcaacagcgggagcaagcgactgatggcgctccaggaaaagtacgggctagtggaaagggccaagaccaggctctcaatcacacccgtgcgcgtggcccagagcctgcccacgtggacgtgcgcggccgcggccgcgctcaaggaatacctcccagtcgggcccgcggtcatgaacctgaaagtggaaaattacccgcccgagatgatgtgcatggcattcggctcgctcataccaacggccggagtctcggaagcgaccacgaaaacgctcatggaagcatactcgctctggcaagacgccttcaccaagaccataaacgtgaaaatgcgcggagcctcgaaaacagaagtgtacaacagcttccgagacccactgcacgcggccgtaaactcggttttcttcccgaacgacgtaagggtcaaatggctaaaagcgaaaggaatcctgggcccggacggagtcccgagcaaggccgcagaagtagccgcagccgcgtacagaaacctgtga

SEQ ID NO: 8353 - RNA, 738 nt, synthetic construct
  misc_feature 1..738: note = derived and/or modified CDS sequence (opt11) from SFTSV/FTLSV(2011YXX9)__KF711898.1__N
  source 1..738: mol_type = other RNA
atgagcgagtggtcgcgcatagccgtggagttcggagaacaacagctcaacctaacagaactggaagacttcgcgcgcgaactcgcgtacgaaggcctggacccggccctgatcatcaaaaagctaaaagaaacgggcggggacgactgggtgaaagatacaaagttcataatagtgttcgcgctcacacgcggaaacaagatcgtgaaagcgagcggaaaaatgagcaacagcggaagcaagcgcctaatggcactacaggaaaagtacggactcgtggaaagggccgagaccaggctctcgatcacgcccgtgcgcgtcgcccagagcctacccacgtggacatgcgcagccgcggccgcactcaaggaatacctcccggtcgggcccgcggtcatgaacctgaaagtggaaaactacccgcccgagatgatgtgcatggcattcggatcgctcatacccacagccggggtctcggaagcaaccacaaaaacgctcgtagaagcgtactcgctctggcaagacgccttcaccaaaaccatcaacgtgaaaatgcgaggagcctcgaaaacggaagtgtacaacagcttccgcgaccccctgcacgcggcagtgaactcggtcttcttcccgaacgacgtcagggtcaagtggctgaaagcgaaagggatcctgggcccagacggagtcccgagcagagcagcggaagtggccgcggccgcgtaccggaacttgtga

SEQ ID NO: 8354 - RNA, 738 nt, synthetic construct
  misc_feature 1..738: note = derived and/or modified CDS sequence (opt11) from SFTSV/FTLSV(YPQ2)__KF356519.1__N
  source 1..738: mol_type = other RNA
atgagcgagtggtcgcgcatagcagtggagttcggcgaacaacagctcaacctaacggaactggaagacttcgcacgagagctagcgtacgagggcctggacccggccctaatcataaagaaactcaaagaaacgggcggagacgattgggtaaaagacaccaagttcataatcgtgttcgcgctcacgcgcgggaacaagatcgtaaaagcgagcggaaaaatgagcaacagcgggagcaaacgactaatggcgctccaggaaaagtacgggctcgtggaaagggccgagaccagactatcgatcacgcccgtgcgagtggcccagagtctgcccacatggacgtgcgcagcagcggccgcgctcaaggaatacctcccagtcgggcccgcagtcatgaacttgaaagtggaaaactacccgcccgagatgatgtgcatggccttcggctcactaatacccacggccggagtctcggaagcgaccacgaaaacactcatggaagcatactcactctggcaagacgccttcaccaaaaccataaacgtgaaaatgcgaggggcctcaaaaacggaagtgtacaacagcttccgagaccccctgcacgcggccgtgaactcggtattcttcccgaacgacgtcagggtcaagtggctgaaagcaaaagggatcctaggcccgaacggggtcccgagcagagccgcggaagtggccgcggccgcatacagaaacctgtga

SEQ ID NO: 8355 - RNA, 738 nt, synthetic construct
  misc_feature 1..738: note = derived and/or modified CDS sequence (opt11) from SFTSV/Guertu virus(DXM)__KT328591.1__N
  source 1..738: mol_type = other RNA
atgagcgaatggtcgaaaatagccgtcgaattcggcgaacaacaactcaacgtcatagaactggaagaattcgcccgcgaactcgcatacgagggcctagacccagccctgatcataaaaaaactaaaagaagtcggcggcgacgactggatgcgcgacaccaaattcataatagtattcgcactaacacgcggaaacaaaatcctaaaagcagcaggaaaaatgagcaactccggaagcaaacgcataatggccctccaagaaaagtacggactagtcgaaagagccgaaacccggctctcaatcacacccgtgcgagtagcccaaagcctacccacatggacatgctcagccgcagccgcactccaagaatacctcccagtcggacccgccgtaatgtccctaaaagtatccaacttcccacccgaaatgatgtgcatggccttcggctccctcatacccgccaccggagtccccgaatcaaccacaaaaatcctaatggaagcatactcactctggcaagacgccttcacaaaaaccataaacgtaaaaatgcgaggagcctcaaaagccgaagtctacaacagcttccgcgaccccctacacgcagccgtaaactcagtcttcttcccaaacgacgtccgactacgatggctaaaatcaaaaggaatcctaggcccagacggactcccaagcaaagccgtagaaacagccgccgccgcctaccgcaacctgtaa

SEQ ID NO: 8356 - RNA, 738 nt, synthetic construct
  misc_feature 1..738: note = derived and/or modified CDS sequence (opt11) from SFTSV/Huaiyangshan virus(2010-FQM)__HQ419240.1__N
  source 1..738: mol_type = other RNA
atgagcgagtggtcgcgcatagccgtgaaattcggcgagcaacagctcaacctcacggaactggaagacttcgcgcgcgagctagcatacgaaggcctagacccggccctgatcatcaaaaagctcaaggaaacgggcggggacgactgggtaaaagacaccaagttcataatagtgttcgcactcacgcgcgggaacaagatcgtaaaagcgagcgggaaaatgagcaacagcgggagcaaacgcctgatggcactacaggaaaagtacgggctagtggaaagggccgagaccagactctccatcacacccgtgcgcgtggcccagagcctgcccacgtggacatgcgcagccgcggccgcactcaaggaatacctcccggtcggacccgcggtcatgaacttgaaagtagaaaactacccgcccgaaatgatgtgcatggccttcggctcgctcataccaacagccggagtctcagaagcaacaacgaaaacactcatggaagcgtactcgctatggcaagacgccttcaccaagaccatcaacgtaaaaatgcgcggggcctcgaaaacggaagtgtacaacagcttccgcgaccccttacacgcggccgtaaactcagtctttctaccgaacgatgtcagagtcaagtggctgaaagcgaaaggaatcctaggtccggacggggtcccgagcagagccgcggaagtagccgcggccgcgtacaggaacctgtga

SEQ ID NO: 8357 - RNA, 738 nt, synthetic construct
  misc_feature 1..738: note = derived and/or modified CDS sequence (opt11) from SFTSV/Huaiyangshan virus(2010-ZGQ)__HQ419241.1__N
  source 1..738: mol_type = other RNA
atgagcgagtggtcgcgcatagccgtagagttcggcgaacaacagctcaacctcacggaactggaagacttcgcgcgcgaactcgcatacgagggcctggacccggccctgatcatcaaaaagctcaaggaaacgggcggggacgactgggtgaaagacacaaagttcataatagtattcgcgctcacgcgaggaaacaagatcgtaaaagcaagcgggaaaatgagcaacagcgggagcaagcgcctgatgtcactccaggaaaagtacgggctagtggaaagggccgagaccaggctctcaattacacccgtacgtgtagcccagagcctgcccacatggacgtgcgcggccgcggccgcgctcaaggaatacctcccggtcgggcccgcagtaatgaacctgaaagtggaaaactacccgcccgagatgatgtgcatggccttcggctcgctcataccaacggccggagtctcggaagcgaccacgcgcacgctcatggaagcgtactccctatggcaagacgccttcaccaaaaccataaacgtgaaaatgcgcggagcatcaaaaacggaagtatacaacagcttccgcgacccactgcacgcagccgtaaactcagtcttcttcccgaacgacgtccgggtcaaatggctgaaagcgaaagggatcctgggcccggacggggtcccgagcagggccgcggaagtggccgcggccgcgtacagaaacctataa

SEQ ID NO: 8358 - RNA, 738 nt, synthetic construct
  misc_feature 1..738: note = derived and/or modified CDS sequence (opt11) from SFTSV/Huaiyangshan virus(S-HGX)__HQ171192.1__N
  source 1..738: mol_type = other RNA
atgagcgagtggtcgcgcatagccgtagagttcggcgaacaacagctcaatctcacggaactggaagacttcgcgcgagagctagcatacgagggcctggacccggcactgatcatcaaaaagctaaaggaaacaggcggggacgactgggtgaaagacaccaagttcataatagtgttcgcgctcacgcgagggaataagatcgtgaaagcaagcgggaaaatgagcaactccgggtccaagcgcctgatggcgctccaggaaaagtacgggctcgtggaaagggcagaaaccaggctctcgatcacgcccgtgcgcgtggcccagagcctgcccacgtggacgtgcacagccgcggccgcactcaaggaatacctcccggtcgggcccgcggtcatgaacctaaaagtggaaaactacccgcccgagatgatgtgcatggctttcgaatcgctcatacccacggccggggtctccgaagcaaccacgaaaacgctaatggaagcgtattcactctggcaagacgcatttaccaagaccataaacgtggaaatgcgaggggcctcgaaaacggaagtatacaacagcttccgcgaccccctacacgcggccgtgaactcagtattcttcccgaacgacgtcagagtcaagtggctgaaagcgaaaggaatcctaggaccggacggggtcccgagcagagccgcagaagtggccgcggccgcgtacagaaacctgtaa

SEQ ID NO: 8359 - RNA, 738 nt, synthetic construct
  misc_feature 1..738: note = derived and/or modified CDS sequence (opt11) from SFTSV/Huaiyangshan virus(S-HZM)__HQ171193.1__N
  source 1..738: mol_type = other RNA
atgagcgagtggtcgcgaatagccgtggagttcggcgaacaacagctcaacctcacagaactagaagacttcgcgcgcgaactcgcatacgaaggattggacccggccctaatcatcaaaaagctcaaggaaacgggcggggacgactgggtaaaagacaccgagttcataatagtgttcgcgctaacgcgcggaaacaagatagtaaaagcgagcggaaaaatgagcaacagcgggagtaagcgcctaatggcgctacaggaaaagtacgggctcgtggaaagagcagagaccaggctctcgatcacgcccgtgcgcgtggcccagagcctacccacgtggacgtgcgcggctgcagccgcactcaaggaatacctcccggtcgggccagcggtcatgaacttgaaagtggaaaactacccgccagaaatgatgtgcatggccttcggctcactaatacccacgaccggggtctcggaagcgaccacgaaaacgctcatggaagcgtactcactctggcaagacgccttcaccaagacaataaacgtgaaaatgcgcggggcatcgaagacggaagtgtacaacagcttccgcgacccactacacgcggccgtgaactcggtcttcttcccaaacgacctcagggtcaaatggttgaaagcgaaagggatcttgggcccggacggggtcccgagcagagccgcggaagtcgccgcggccgcatacaggaacttgtga

SEQ ID NO: 8360 - RNA, 738 nt, synthetic construct
  misc_feature 1..738: note = derived and/or modified CDS sequence (opt11) from SFTSV/Huaiyangshan virus(S-WJ)__HQ171191.1__N
  source 1..738: mol_type = other RNA
atgagcgagtggtcgcgcatagccgtggaatttggcgagcaacagctcaatctcacggaattggaagacttcgcgcgcgagctagcgtacgagggcctgggaccggccctgatcatcaaaaagctcaaggaaacgggcggggacgactgggtgaaagacaccaagttcataatagtattcgcgctcacgcgcgggaacaagatagtgaaagcgagcgggaaaatgagcaatagcgggagcaagcgcctgatggcgctacaggaaaagtacgggctagtggaaagggccgagaccagactctcgataacgcccgtacgcgtggcccagagcctgcccacgtggacgtgcgcggccgcggccgcgctcaaggaatatctcccggtcggacccgcagtcatgaacctgaaagtggaaaactacccacccgagatgatgtgcatggcctttggctcgctcatacccaccgcaggggtctcagaagcgaccacgaaaacgctcatggaagcgtactcgctctggcaagatgcatttaccaagaccatcaacgtgaaaatgcgaggggcttcgaaaacggaagtatacaatagcttccgcgaccccctgcacgcagccgtgaactcggtctttttcccgaacgatgtcagggtcaagtggctgaaagcgaaagggatcctgggcccggacggggtcccaagcagagccgcagaagtggcagcggccgcgtacaggaacttataa

SEQ ID NO: 8361 - RNA, 738 nt, synthetic construct
  misc_feature 1..738: note = derived and/or modified CDS sequence (opt11) from SFTSV/Phlebovirus(JS2010-019)__JQ317180.1__N
  source 1..738: mol_type = other RNA
atgagcgaatggtcgcgcatagccgtggagttcggcgaacaacagctcaacctcacggaactggaagacttcgcacgcgagctagcgtacgaaggcctagacccggcattgatcatcaaaaagctcaaagaaacgggcggagacgactgggtgaaagacaccaagttcataatagtgttcgcgctcacacgcgggaacaaaatcgtaaaagcgagcggaaaaatgagtaacagcggaagcaagcgcttaatggcactccaggaaaaatacgggctagtggaaagggccgagaccaggctctcgatcacgcccgtgagagtcgcccagagcctgcccacatggacgtgcgcggccgcggccgctctcaaggaatacctcccggtcggacccgcggtcatgaacctgaaagtggaaaactacccgcccgagatgatgtgcatggccttcggctcgctaataccaacggccggagtctcggaagcaacaacgaaaacgctcatggaagcgtactcgctctggcaagacgccttcaccaagaccataaacgtgaaaatgcgcggggcctcgaaaacagaagtgtacaacagcttccgagaccccctgcacgcggccgtgaactcggtcttcttcccgaacgacgtcagggtcaagtggttaaaagcgaaagggatcctgggcccggacggagtcccgagcagagccgcggaagcggccgcggcagcatacagaaacttgtga

SEQ ID NO: 8362 - RNA, 738 nt, synthetic construct
  misc_feature 1..738: note = derived and/or modified CDS sequence (opt11) from SFTSV/Phlebovirus(SD24/China/2010 strain SD24)__HM802205.1__N
  source 1..738: mol_type = other RNA
atgagcgaatggtcacgcatagccgtggagttcggcgaacaacagctcaacctaacggaactggaagacttcgcgcgagagctagcgtacgagggcctggacccggcattgatcataaagaaactaaaagaaacgggcggggacgactgggtgaaagacaccaagttcataatcgtgttcgcgctcacgcgaggaaacaagatcgtgaaagcgagcgggaaaatgagtaacagcgggagcaagcgcctgatggcgctccaggaaaagtacggactcgtggaaagagccgagaccaggctctcaataacgccagtacgcgtggcccagagcctgcccacgtggacgtgcgcggccgcggccgcgctcaaggaatatctcccggtcgggcccgcggtcatgaacctgaaagtggaaaactacccacccgagatgatgtgcatggccttcggctcactcataccaacggccggggtaacggaagcaaccacaaaaacgctcatggaagcgtactcgctctggcaagatgccttcaccaagaccatcaacgtgaaaatgcgcggggcctcgaaaacggaagtctacaacagcttccgcgaccctctgcacgcggccgtaaactcggtattcttcccaaacgacgtcagagtcaagtggctgaaagcaaaagggatcttgggcccggacggagtaccgagcagggccgcggaagtggccgcggccgcatacagaaacctatga

SEQ ID NO: 8363 - RNA, 738 nt, synthetic construct
  misc_feature 1..738: note = derived and/or modified CDS sequence (opt11) from SFTSV/Phlebovirus(ZJ1/China/2011)__HE663216.1__N
  source 1..738: mol_type = other RNA
atgagtgagtggtcgcgcatagccgtggaatttggagagcaacagctcaacctcacggaactagaagacttcgcacgcgaactagcatacgagggcttggacccggcactgataatcaaaaagctaaaggaaaccggcggggacgactgggtacgcgataccaagttcataatagtgttcgcactcacgcgcgggaacaagatcgtgaaagcgagcgggaaaatgagcaatagcgggagcaaacgcctgatggcgctccaagaaaagtacgggctcgtggaaaaggcagagacccggctctcgatcacgcccgtgcgcgtggcccagagcttgcccacgtggacatgcgcggccgcagccgcgctcaaggaatacctaccggtcgggcccgcggtcatgaacctgaaagtggaaaattacccgcccgagatgatgtgcatggccttcggctcactcatacccacggccggggtctcagaagcgaccacgaaagcgctcatggaagcgtactcgctctggcaagacgcctttacaaagaccataaacgtgaaaatgcgcggagcctcgaaaacggaagtgtacagctcattccgcgatccattacacgcggccgtgaactcggtcttcttcccgaacgacgttagggtcaagtggttgaaagcgaaagggatcctgggcccggacggggtcccgagcagggccgcggaagtagccgcagccgcgtacaggaacctatga

SEQ ID NO: 8364 - RNA, 3417 nt, synthetic construct
  misc_feature 1..3417: note = derived and/or modified CDS sequence (opt4) from ANDV(Chile-9717869)__AF291703.2__GP
  source 1..3417: mol_type = other RNA
atggagggctggtacctggtggtgctgggcgtgtgctacaccctgaccctggccatgcccaagaccatctacgagctgaagatggagtgcccccacaccgtgggcctgggccagggctacatcatcggcagcaccgagctgggcctgatcagcatcgaggccgccagcgacatcaagctggagagcagctgcaacttcgacctgcacaccaccagcatggcccagaagagcttcacccaggtggagtggagaaagaagagcgacaccaccgacaccaccaacgccgccagcaccaccttcgaggcccagaccaagaccgtgaacctgagaggcacctgcatcctggcccccgagctgtacgacaccctgaagaaggtgaagaagaccgtgctgtgctacgacctgacctgcaaccagacccactgccagcccaccgtgtacctgatcgcccccgtgctgacctgcatgagcatcagaagctgcatggccagcgtgttcaccagcagaatccaggtgatctacgagaagacccactgcgtgaccggccagctgatcgagggccagtgcttcaaccccgcccacaccctgaccctgagccagcccgcccacacctacgacaccgtgaccctgcccatcagctgcttcttcacccccaagaagagcgagcagctgaaggtgatcaagaccttcgagggcatcctgaccaagaccggctgcaccgagaacgccctgcagggctactacgtgtgcttcctgggcagccacagcgagcccctgatcgtgcccagcctggaggacatcagaagcgccgaggtggtgagcagaatgctggtgcaccccagaggcgaggaccacgacgccatccagaacagccagagccacctgagaatcgtgggccccatcaccgccaaggtgcccagcaccagcagcaccgacaccctgaagggcaccgccttcgccggcgtgcccatgtacagcagcctgagcaccctggtgagaaacgccgaccccgagttcgtgttcagccccggcatcgtgcccgagagcaaccacagcacctgcgacaagaagaccgtgcccatcacctggaccggctacctgcccatcagcggcgagatggagaaggtgaccggctgcaccgtgttctgcaccctggccggccccggcgccagctgcgaggcctacagcgagaacggcatcttcaacatcagcagccccacctgcctggtgaacaaggtgcagagattcagaggcagcgagcagaagatcaacttcatctgccagagagtggaccaggacgtggtggtgtactgcaacggccagaagaaggtgatcctgaccaagaccctggtgatcggccagtgcatctacaccttcaccagcctgttcagcctgatgcccgacgtggcccacagcctggccgtggagctgtgcgtgcccggcctgcacggctgggccaccgtgatgctgctgagcaccttctgcttcggctgggtgctgatccccgccgtgaccctgatcatcctgaagtgcctgagagtgctgaccttcagctgcagccactacaccaacgagagcaagttcaagttcatcctggagaaggtgaagatcgagtaccagaagaccatgggcagcatggtgtgcgacgtgtgccaccacgagtgcgagaccgccaaggagctggagagccacagacagagctgcatcaacggccagtgcccctactgcatgaccatcaccgaggccaccgagagcgccctgcaggcccactacagcatctgcaagctgaccggcagattccaggaggccctgaagaagagcctgaagaagcccgaggtgaagaagggctgctacagaaccctgggcgtgttcagatacaagagcagatgctacgtgggcctggtgtggtgcctgctgctgacctgcgagatcgtgatctgggccgccagcgccgagacccccctgatggagagcggctggagcgacaccgcccacggcgtgggcgagatccccatgaagaccgacctggagctggacttcagcctgcccagcagcagcagctacagctacagaagaaagctgaccaaccccgccaacaaggaggagagcatccccttccacttccagatggagaagcaggtgatccacgccgagatccagcccctgggccactggatggacgccaccttcaacatcaagaccgccttccactgctacggcgcctgccagaagtacagctacccctggcagaccagcaagtgcttcttcgagaaggactaccagtacgagaccggctggggctgcaaccccggcgactgccccggcgtgggcaccggctgcaccgcctgcggcgtgtacctggacaagctgaagagcgtgggcaaggcctacaagatcatcagcctgaagtacaccagaaaggtgtgcatccagctgggcaccgagcagacctgcaagcacatcgacgccaacgactgcctggtgacccccagcgtgaaggtgtgcatcgtgggcaccgtgagcaagctgcagcccagcgacaccctgctgttcctgggccccctggagcagggcggcatcatcctgaagcagtggtgcaccaccagctgcgccttcggcgaccccggcgacatcatgagcacccccagcggcatgagatgccccgagcacaccggcagcttcagaaagatctgcggcttcgccaccacccccgtgtgcgagtaccagggcaacaccatcagcggctacaagagaatgatggccaccaaggacagcttccagagcttcaacctgaccgagccccacatcaccaccaacaagctggagtggatcgaccccgacggcaacaccagagaccacgtgaacctggtgctgaacagagacgtgagcttccaggacctgagcgacaacccctgcaaggtggacctgcacacccaggccatcgagggcgcctggggcagcggcgtgggcttcaccctgacctgcaccgtgggcctgaccgagtgccccagcttcatgaccagcatcaaggcctgcgacctggccatgtgctacggcagcaccgtgaccaacctggccagaggcagcaacaccgtgaaggtggtgggcaagggcggccacagcggcagcagcttcaagtgctgccacgacaccgactgcagcagcgagggcctgctggccagcgccccccacctggagagagtgaccggcttcaaccagatcgacagcgacaaggtgtacgacgacggcgcccccccctgcaccttcaagtgctggttcaccaagagcggcgagtggctgctgggcatcctgaacggcaactggatcgtggtggtggtgctggtggtgatcctgatcctgagcatcatcatgttcagcgtgctgtgccccagaagaggccacaagaagaccgtgtga

SEQ ID NO: 8365 - RNA, 3417 nt, synthetic construct
  misc_feature 1..3417: note = derived and/or modified CDS sequence (opt4) from ANDV(AH-1)__AF324901.2__GP
  source 1..3417: mol_type = other RNA
atggagggctggtacctggtggccctgggcgtgtgctacaccctgaccctggccatgcccaagaccatctacgagctgaagatggagtgcccccacaccgtgggcctgggccagggctacatcatcggcagcaccgagctgggcctgatcagcatcgaggccgccagcgacatcaagctggagagcagctgcaacttcgacctgcacaccaccagcatggcccagaagagcttcacccaggtggagtggagaaagaagagcgacaccaccgacaccaccaacgccgccagcaccaccttcgaggcccagaccaagaccgtgaacctgagaggcacctgcatcctggcccccgagctgtacgacaccctgaagaaggtgaagaagaccgtgctgtgctacgacctgacctgcaaccagacccactgccagcccaccgtgtacctgatcgcccccgtgctgacctgcatgagcatcagaagctgcatggccagcgtgttcaccagcagaatccaggtgatctacgagaagacccactgcgtgaccggccagctgatcgagggccagtgcttcaaccccgcccacaccctgaccctgagccagcccgcccacacctacgacaccgtgaccctgcccatcagctgcttcttcacccccaagaagagcgagcagctgaaggtgatcaagaccttcgagggcatcctgaccaagaccggctgcaccgagaacgccctgcagggctactacgtgtgcttcctgggcagccacagcgagcccctgatcgtgcccagcctggaggacatcagaagcgccgaggtggtgagcagaatgctggtgcaccccatcggcgaggaccacgacgccatccagaacagccagagctacctgagaatcgtgggccccatcaccgccaaggtgcccagcaccagcagcaccgacaccctgaagggcatcgccttcgccggcgtgcccatgtacagcagcttcagcaccctggtgagaaacgccgaccccgagttcgtgttcagccccggcatcatccccgagagcaaccacagcgtgtgcgacaagaagaccgtgcccatcacctggaccggctacctgcccatcagcggcgagatggagaaggtgaccggctgcaccgtgttctgcaccctggccggccccggcgccagctgcgaggcctacagcgagaacggcatcttcaacatcagcagccccacctgcctggtgaacaaggtgcagagattcagaggcagcgagcagaagatcaacttcatctgccagagagtggaccaggacgtggtggtgtactgcaacggccagaagaaggtgatcctgaccaagaccctggtgatcggccagtgcatctacaccttcaccagcctgttcagcctgatgcccgacgtggcccacagcctggccgtggagctgtgcgtgcccggcctgcacggctgggccaccgtgatgctgctgagcaccttctgcttcggctgggtgctgatccccgccgtgaccctgatcatcctgaagtgcctgagagtgctgaccttcagctgcagccactacaccaacgagagcaagttcaagttcatcctggagaaggtgaaggtggagtaccagaagaccatgggcagcatggtgtgcgacgtgtgccaccacgagtgcgagaccgccaaggagctggagagccacagacagagctgcatcaacggccagtgcccctactgcatgaccatcaccgaggccaccgagagcgccctgcaggcccactacagcatctgcaagctgaccggcagattccaggaggccctgaagaagagcctgaagaagcccgaggtgaagaagggctgctacagaaccctgggcgtgttcagatacaagagcagatgctacgtgggcctggtgtggtgcctgctgctgacctgcgagatcgtgatctgggccgccagcgccgagacccccctgatggagagcggctggagcgacaccgcccacggcgtgggcgagatccccatgaagaccgacctggagctggacttcagcctgcccagcagcagcagctacagctacagaagaaagctgaccaaccccgccaacaaggaggagagcatccccttccacttccagatggagaagcaggtgatccacgccgagatccagcccctgggccactggatggacgccaccttcaacatcaagaccgccttccactgctacggcgcctgccagaagtacagctacccctggcagaccagcaagtgcttcttcgagaaggactaccagtacgagaccggctggggctgcaaccccggcgactgccccggcgtgggcaccggctgcaccgcctgcggcgtgtacctggacaagctgaagagcgtgggcaaggcctacaagatcatcagcctgaagtacaccagaaaggtgtgcatccagctgggcaccgagcagacctgcaagcacatcgacgccaacgactgcctggtgacccccagcgtgaaggtgtgcatcgtgggcaccgtgagcaagctgcagcccagcgacaccctgctgttcctgggccccctggagcagggcggcatcatcctgaagcagtggtgcaccaccagctgcgccttcggcgaccccggcgacatcatgagcacccccagcggcatgagatgccccgagcacaccggcagcttcagaaagatctgcggcttcgccaccacccccgtgtgcgagtaccagggcaacaccgtgagcggctacaagagaatgatggccaccaaggacagcttccagagcttcaacctgaccgagccccacatcaccaccaacaagctggagtggatcgaccccgacggcaacaccagagaccacgtgaacctggtgctgaacagagacgtgagcttccaggacctgagcgacaacccctgcaaggtggacctgcacacccaggccatcgagggcgcctggggcagcggcgtgggcttcaccctgacctgcaccgtgggcctgaccgagtgccccagcttcatgaccagcatcaaggcctgcgacctggccatgtgctacggcagcaccgtggccaacctggccagaggcagcaacaccgtgaaggtggtgggcaagggcggccacagcggcagcagcttcaagtgctgccacgacaccgactgcagcagcgagggcctgctggccagcgccccccacctggagagagtgaccggcttcaaccagatcgacagcgacaaggtgtacgacgacggcgcccccccctgcaccttcaagtgctggttcaccaagagcggcgagtggctgctgggcatcctgaacggcaactggatcgtggtggtggtgctggtggtgatcctgatcctgagcatcatcatgttcagcgtgctgtgccccagaagaggccacaagaagaccgtgtga

SEQ ID NO: 8366 - RNA, 3417 nt, synthetic construct
  misc_feature 1..3417: note = derived and/or modified CDS sequence (opt4) from ANDV(CHI-7913)__AY228238.1__GP
  source 1..3417: mol_type = other RNA
atggagggctggtacctggtggccctgggcatctgctacaccctgaccctggccatgcccaagaccacctacgagctgaagatggagtgcccccacaccgtgggcctgggccagggctacatcatcggcagcaccgagctgggcctgatcagcatcgaggccgccagcgacatcaagctggagagcagctgcaacttcgacctgcacaccaccagcatggcccagaagagcttcacccaggtggagtggagaaagaagagcgacaccaccgacaccaccaacgccgccagcaccaccttcgaggcccagaccaagaccgtgaacctgagaggcacctgcatcctggcccccgagctgtacgacaccctgaagaaggtgaagaagaccgtgctgtgctacgacctgacctgcaaccagacccactgccagcccaccgtgtacctgatcgcccccgtgctgacctgcatgagcatcagaagctgcatggccagagtgttcaccagcagaatccaggtgatctacgagaagacccactgcgtgaccggccagctgatcgagggccagtgcttcaaccccgcccacaccctgaccctgagccagcccgcccacacctacgacaccgtgaccctgcccatcagctgcttcttcacccccaaggagagcgagcagctgaaggtgatcaagaccttcgagggcatcctgaccaagaccggctgcaccgagaacgccctgcagggctactacgtgtgcttcctgggcagccacagcgagcccctgatcgtgcccagcctggaggacatcagaagcgccgaggtggtgagcagaatgctggtgcaccccagaggcgaggaccacgacgccatccagaacagccagagccacctgagaatcgtgggccccatcaccgccaaggtgcccagcaccagcagcaccgacaccctgaagggcaccgccttcgccggcgtgcccatgtacagcagcctgagcaccctggtgaagaacgccgaccccgagttcgtgttcagccccggcatcatccccgagagcaaccacagcgtgtgcgacaagaagaccgtgcccatcacctggaccggctacctgcccatcagcggcgagatggagaaggtgaccggctgcaccgtgttctgcaccctggccggccccggcgccagctgcgaggcctacagcgagaacggcatcttcaacatcagcagccccacctgcctggtgaacaaggtgcagagattcagaggcagcgagcagaagatcaacttcatctgccagagagtggaccaggacgtggtggtgtactgcaacggccagaagaaggtgatcctgaccaagaccctggtgatcggccagtgcatctacaccttcaccagcctgttcagcctgatgcccgacgtggcccacagcctggccgtggagctgtgcgtgcccggcctgcacggctgggccaccgtgatgctgctgagcaccttctgcttcggctgggtgctgatccccgccgtgaccctgatcatcctgaagtgcctgagagtgctgaccttcagctgcagccactacaccaacgagagcaagttcaagttcatcctggagaaggtgaaggtggagtaccagaagaccatgggcagcatggtgtgcgacgtgtgccaccacgagtgcgagaccgccaaggagctggagagccacagacagagctgcatcaacggccagtgcccctactgcatgaccatcaccgaggccaccgagagcgccctgcaggcccactacagcatctgcaagctgaccggcagattccaggaggccctgaagaagagcctgaagaagcccgaggtgaagaagggctgctacagaaccctgggcgtgttcagatacaagagcagatgctacgtgggcctggtgtggtgcctgctgctgacctgcgagatcgtgatctgggccgccagcgccgagacccccctgatggagagcggctggagcgacaccgcccacggcgtgggcgagatccccatgaagaccgacctggagctggacttcagcctgcccagcagcagcagctacagctacagaagaaagctgaccaaccccgccaacaaggaggagagcatcagcttccacttccagatggagaagcaggtgatccacgccgagatccagcccctgggccactggatggacgccaccttcaacaccaagaccgccttccactgctacggcgcctgccagaagtacagctacccctggcagaccagcaagtgcttcttcgagaaggactaccagtacgagaccggctggggctgcaaccccggcgactgccccggcgtgggcaccggctgcaccgcctgcggcgtgtacctggacaagctgaagagcgtgggcaaggcctacaagatcatcagcctgaagtacaccagaaaggtgtgcatccagctgggcaccgagcagacctgcaagcacatcgacgccaacgactgcctggtgacccccagcgtgaaggtgtgcatcgtgggcaccgtgagcaagctgcagcccagcgacaccctgctgttcctgggccccctggagcagggcggcgtgatcctgaagcagtggtgcaccaccagctgcgccttcggcgaccccggcgacatcatgagcacccccagcggcatgagatgccccgagcacaccggcagcttcagaaagatctgcggcttcgccaccacccccgtgtgcgagtaccagggcaacaccatcagcggctacaagagaatgatggccaccaaggacagcttccagagcttcaacctgaccgagccccacatcaccgccaacaagctggagtggatcgaccccgacggcaacaccagagaccacgtgaacctggtgctgaacagagacgtgagcttccaggacctgagcgacaacccctgcaaggtggacctgcacacccaggccatcgagggcgcctggggcagcggcgtgggcttcaccctgacctgcaccgtgggcctgaccgagtgccccagcttcatgaccagcatcaaggcctgcgacctggccatgtgctacggcagcaccgtggccaacctggccagaggcagcaacaccgtgaaggtggtgggcaagggcggccacagcggcagcagcttcaagtgctgccacgacaccgactgcagcagcgagggcctgctggccagcgccccccacctggagagagtgaccggcttcaaccagatcgacagcgacaaggtgtacgacgacggcgcccccccctgcaccttcaagtgctggttcaccaagagcggcgagtggctgctgggcatcctgaacggcaactggatcgtggtggtggtgctggtggtgatcctgatcctgagcatcatcatgttcagcgtgctgtgccccagaagaggccacaagaagaccgtgtga

SEQ ID NO: 8367 - RNA, 3417 nt, synthetic construct
  misc_feature 1..3417: note = derived and/or modified CDS sequence (opt4) from Hu39694(Hu39694)__AF028023.1__GP
  source 1..3417: mol_type = other RNA
atggagggctggtacctgatcgtgctgggcgtgtgcagcaccctgaccctggccatgcccagaaccatctacgagctgagaatggagtgcccccacaccgtgggcctgggccagggctacatcatcggcagcaccgagctgggcctgatccccatcgagaccgtgagcgacctgaagctggagagcagctgcaacttcgacctgcacaccaccagcatgacccagaagagctacacccaggtggagtggagaaagaagagcgacaccaccgacaccaccaacgccgccagcaccaccttcgaggcccagaccaagaccgtgaacctgagaggcacctgcgtgctggccagcgagctgtacgacaccctgaagaagatcaagaagaccgtgctgtgctacgacctgacctgcaaccagacccactgccagcccaccgtgtacctgatcgcccccgtgagcacctgcatgagcatcagaagctgcatggccagcgtgttcaccaacagaatccaggtgatctacgagaagacccactgcgtgaccggccagctggtggagggccagtgcttcaaccccgcccacaccctgaccctgagccagcccgcccacacctacgagatggtgaccctgcccgtgacctgcttcttcacccccaagaagagcgaccagctgaagctgatcaagaccttcgagggcatcatcagcaagaccggctgcaccgagaacgccctgcagggctactacgtgtgcttcctgggcagccacagcgagcccctgcacgtgcccagcctggaggacatcagaagcgtggaggtgttcagcagaatgatcatccaccccagaggcgaggaccacgaccccatccagaacagccagggcttcctgagaatcgtgggccccatcaccgccaaggtgcccagcaccagcagcaccgacaccctgaagggcaccgccttcgccggcgtgcccatgtacagcagcctgagcaccctggtgagaaccaccgaccccgagtacgtgttcagccccggcatcatccccgagagcaaccacagcacctgcgacaagaagaccatccccctgacctggaccggctacctgcccatcgccggcgagatggagaaggtgaccggctgcaccgtgttctgcaccctggccggccccggcgccagctgcgaggcctacagcgagcacggcatcttcaacatcagcagccccacctgcctggtgcacaaggtgcagaagttcagaggcagcgagcagaagatcaacttcatctgccagagagtggaccaggacgtggtggtgtactgcaacggccagaagaaggtgatcctgaccaaggacctggtgatcggccagtgcatctacaccttcaccagcctgttcagcctgatgcccgacgtggcccacagcctggccgtggagctgtgcgtgcccggcctgcacggctgggccaccgtgatgctgctgagcaccttctgcttcggctggatcctgatccccgccatcaccctggtggtgctgaagttcctgaagatggccaccttcagctgcagccactacaccaacgagagcaagttcaagttcatcctggagaaggtgaaggtggagtaccagaagaccatgggcagcatggtgtgcgacatctgccaccacgagtgcgagaccgccaaggagctggagagccacaagcagagctgcatcaacggccagtgcccctactgcatgaccatgaccgaggccaccgagagcgccctgcaggcccactacagcatctgcaagctgaccggcagattccaggaggccctgaagaagagcctgaagagacccgaggtgaagaagggctgctacagaaccctgggcgtgttcagatacaagagcagatgctacgtgggcctggtgtggtgcgtgctgctgacctgcgagctgatcgtgtgggccgccagcgccgagacccccctgctggagagcggctggagcgacaccgcccacggcgtgggcgaggtgcccatgaagaccgacctggagctggacttcagcctgcccagcagcagcagctacagctacagaagaaagctgaccaaccccgccaacaaggaggagagcatccccttccacttccagatggagaagcaggtgatccacgccgagatccagaccctgggccactggatggacgccaccttcaacatcaagaccgccttccactgctacggcgcctgccagaagtacagctacccctggcagaccgccaagtgcttcttcgagaaggactaccagtacgagaccggctggggctgcaaccccggcgactgccccggcttcggcaccggctgcaccgcctgcggcgtgtacctggacaagctgaagagcgtgggcaaggcctacaagatcatcagcctgaagtacaccagaaaggtgtgcatccagctgggcaccgagcagacctgcaagcacatcgacgccaacgactgcctggtgacccccagcgtgaaggtgtgcatcatcggcaccgtgagcaagctgcagcccagcgacaccctgctgttcctgggccccctggagcagggcggcatcctgctgaagcagtggtgcaccaccagctgcgccttcggcgaccccggcgacatcatgagcaccaccagcggcatgagatgccccgagcacaccggcagcttcagaaagatctgcggcttcgccaccacccccgtgtgcgagtaccagggcaacaccatcagcggctacaagagaatgatggccaccaaggacagcttccagagcttcaacctgaccgacccccacatcaccaccaacaagctggagtggatcgaccccgacggcaacaccagagaccacgtgaacctggtgctgaacagagacgtgagcttccaggacctgagcgacaacccctgcaaggtggacctgcacacccaggccatcgagggcgcctggggcagcggcgtgggcttcaccctgacctgcaccgtgggcctgaccgagtgccccagcttcatcaccagcatcaaggcctgcgacatggccatgtgctacggcagcaccgtgagcaacctggccagaggcagcaacaccgtgaaggtggtgggcaagggcggccacagcggcctgcacagcagatgctgccacgacaccgactgcagcagcgagggcctggtggccagcgccccccacctggagagagtgaccggcttcaaccagatcgacagcgacaaggtgtacgacgacggcgcccccccctgcaccttcaagtgctggttcaccaagagcggcgagtggctgctgggcatcctgaacggcaactggatcgtggtggtggtgctggtggtggtgctgatcttcagcatcatcctgttcaacatcctgtgccccagaagaggccacaagaagaccgtgtga

SEQ ID NO: 8368 - RNA, 3417 nt, synthetic construct
  misc_feature 1..3417: note = derived and/or modified CDS sequence (opt4) from LECV(Of22819)__AF028022.1__GP
  source 1..3417: mol_type = other RNA
atggagggctggtacctgatcgtgctgggcgtgtgcagcaccctgaccctggccatgcccaagaccatctacgagctgaagatggagtgcccccacaccgtgggcctgggccagggcatcatcgtgggcagcaccgagctgggcctgatccccatcgagaccgccagcgacctgaagctggagagcagctgcaacttcgacctgcacaccaccagcatgacccagaagagctacacccaggtggagtggagaaagaagagcgacaccaccgacaccaccaacgccgccgccaccaccttcgagagccaggccaagaccgtgaacctgagaggcacctgcgtgctggccgccgagctgtacgacaccctgaagaaggtgaagaagaccgtgctgtgctacgacctgacctgcaaccagacccactgccagcccaccgtgtacctgatcgcccccgtgatcacctgcatgagcatcagaagctgcatggccagcgtgttcatcagcagaatccagatcatctacgagaagacccactgcgtgaccggccagctgatcgagggccagtgcttcaaccccgcccacaccctgaccctggcccagcccgcccacacctacgagaccgtgaccctgcccgtgacctgcttcttcacccccaagaagagcgaccagctgaagctgatcaagaccttcgagggcatcatcagcaagaccggctgcaccgagaacgccctgcagggctactacgtgtgcttcctgggcagccacagcgagcccctgcacgtgcccagcctgaaggacatcagaagcgccgaggtggtgaccagaatgatcgtgcaccccagaggcgaggaccacgaccccatccagaacagccagggctacctgagaatcgtgggccccctgaccgccaaggtgcccagcaccagcagcagcgacaccctgcagggcaccgccttcgccggcgtgcccatgtacagcagcctgagcaccctggtgagaaacaccgaccccgagttcgtgttcagccccggcatcatccccgagagcaaccacagcgcctgcgacaagaagaccatccccctgacctggaccggctacctgcccatcagcggcgagatggagaaggtgaccggctgcaccgtgttctgcaccctggccggccccggcgccagctgcgaggcctacagcgagagcggcatcttcaacatcagcagccccacctgcctggtgaacaaggtgcagaagttcagaggcagcgagcagaagatcaacttcatctgccagagagtggaccaggacgtggtggtgtactgcaacggccagaagaaggtgatcctgaccaagaccctggtgatcggccagtgcatctacaccttcaccagcctgttcagcctgatgcccgacgtggcccacagcctggccgtggagctgtgcgtgcccggcctgcacggctgggccaccgtgatgctgctgagcaccttctgcttcggctggatcctgatccccgccatcaccctggtggtgctgaaggtgctgaaggtggccaccttcagctgcagccactacaccaacgagagcaagttcaagttcatcctggagaaggtgaaggtggagtaccagaagaccatgggcagcatggtgtgcgacatctgccaccacgagtgcgagaccgccaaggagctggagagccacaagcagagctgcatcaacggccagtgcccctactgcatgaccatgaccgaggccaccgagagcgccctgcaggcccacttcgccatctgcaagctgaccggcagattccaggaggccctgaagaagagcctgaagaagcccgaggtgagaaagggctgctacagaaccctgggcgtgttcagatacaagagcagatgctacgtgggcctggtgtggtgcgtgctgctgacctgcgagctgatcgtgtgggccgccagcgccgagacccccctgctggagagcggctggagcgacaccgcccacggcgtgggcgaggtgcccatgaagaccgacctggagctggacttcagcctgcccagcagcagcagctacagctacagaagaaagctgaccaaccccgccaacaaggaggagagcatccccttccacttccagatggagaagcaggtgatccacgccgagatccagaacctgggccactggatggacgccaccttcaacatcaagaccgccttccactgctacggcgcctgccagaagtacagctacccctggcagaccgccaagtgcttcttcgagaaggactaccagtacgagaccggctggggctgcaaccccggcgactgccccggcgtgggcaccggctgcaccgcctgcggcgtgtacctggacaagctgaagagcgtgggcaaggcctacaagatcatcagcctgaagtacaccagaaaggtgtgcatccagctgggcaccgagcagacctgcaagcacatcgacgccaacgactgcctggtgacccccagcgtgaaggtgtgcatcgtgggcaccgtgagcaagctgcagcccagcgacaccctgctgttcctgggccccctggagcagggcggcatcatcctgaagcagtggtgcaccaccagctgcgccttcggcgaccccggcgacatcatgagcaccaccagcggcatgagatgccccgagcacaccggcagcttcagaaagatctgcggcttcgccaccacccccgtgtgcgagtaccagggcaacaccatcagcggctacaagagaatgatggccaccaaggacagcttccagagcttcaacctgaccgacccccacatcaccaccaacaagctggagtggatcgaccccgacggcaacaccagagaccacgtgaacctggtgctgaacagagacgtgagcttccaggacctgagcgacaacccctgcaaggtggacctgcacacccaggccatcgagggcgcctggggcagcggcgtgggcttcaccctgacctgcaccgtgggcctgaccgagtgccccagcttcatgaccagcatcaaggcctgcgacctggccatgtgctacggcagcaccgtgcacaacctggccagaggcagcaacaccgtgaaggtggtgggcaagggcggccacagcggcagcagcttcaagtgctgccacgacaccgactgcagcagcgagggcctggtggccagcgccccccacctggagagagtgaccggcttcaaccagatcgacagcgacaaggtgtacgacgacggcgcccccccctgcaccttcaagtgctggttcaccaagagcggcgagtggctgctgggcatcctgaacggcaactggatcgtggtggtggtgctggtggtggtgctgatcttcagcatcatcctgttcagcatcctgtgccccagaagaggccacaagaagaccgtgtga

SEQ ID NO: 8369 - RNA, 3417 nt, synthetic construct
  misc_feature 1..3417: note = derived and/or modified CDS sequence (opt4) from ORNV(Ol22996)__AF028024.1__GP
  source 1..3417: mol_type = other RNA
atggagggctggtacctgatcgtgctgggcgtgtgcagcaccgtgaccctggccatgcccaagaccatctacgagctgaagatggagtgcccccacaccgtgggcctgggccagggctacatcatcggcagcaccgagctgaacctgatccccatcggcgccgccagcgacctgaagctggagagcagctgcgacttcgacctgtacaccacccccatgacccagaagagctacacccaggtggagtggagaaagaagagcgagaccaccgacaccaccaacgccgccgccaccaccttcgagagccagaccaagaccgtgaacctgagaggcacctgcatcctggccagcgagctgtacgacaccctgaacaagatcaagaagcccgtgctgtgctacgacctgaactgcaaccagaccagatgccagcccaccgtgtacctgatcgcccccgtgatcacctgcatgagcatcagaagctgcatggccagcgtgagcaacagcagaatccagatcatctacgagaagacccactgcgtgaccggccagctggtggagggccagtgcttcaaccccagccacaccctgaccctggcccagcccgcccacacctacgagaccgtgaccctgcccgtgacctgcttcttcacccccaagaagagcgaccagctgaagctggtgaagaccttcgagggcatcatcaccaagaccggctgcaccgagaacgccctgcagggctactacgtgtgcttcctgggcagccacagcgagcccctgcacgtgcccagcctggaggacatcagaagcgccgaggtggtgagcagaatgatcgtgcaccccagaggcgaggaccacgaccccatccagaacagccagggccacctgagaatcgtgggccccatcaccgccaaggtgcccagcaccagcagcagcgacaccctgcagggcaccgccttcagcggcgtgcccatgtacagcagcctgagcaccctggtgagaagcgccgaccccgagttcgtgttcagccccggcatcctgcccgagagcaaccacagcgtgtgcgacaagaagaccctgcccctgacctggaccggctacctgcccatcagcggcgagatggagaaggtgaccggctgcaccgtgttctgcaccctggccggccccggcgccagctgcgaggcctacagcgagaacggcatcttcaacatcagcagccccacctgcctggtgaacaaggtgcagaagttcagaggcagcgagcagaagatcaacttcatctgccagagaatggaccaggacgtggtggtgtactgcaacggccagaagaaggtgatcctgaccaagaccctggtgatcggccagtgcatctacaccttcaccagcctgttcagcctgatgcccgacgtggcccacagcctggccgtggagctgtgcgtgcccggcctgcacggctgggccaccgtgatgctgctgagcaccttctgcttcggctggatcctgatccccgccatcaccctggtggtgctgaagttcctgaagatggccaccttcagctgcagccactacaccaacgagagcaagttcaagctgatcctggagaaggtgaaggtggagtaccagaagaccatgggcagcatggtgtgcgacatctgccaccacgagtgcgagaccgccaaggtgctggagagccacaagcagagctgcatcaacggccagtgcccctactgcatgaccatgaccgaggccaccgagagcgccctgcaggcccactacagcatctgcaagctgaccggcagattccaggaggccctgaagaagagcctgaagaagcccgaggtgaagagaggctgctacagaaccctgggcgtgttcagatacaagagcagatgctacgtgggcctggtgtggtgcgtgctgctgacctgcgagctgatcgtgtgggccgccagcgccgagacccccctgctggagagcggctggagcgacaccgcccacggcgtgggcgagatccccatgaagaccgacctggagctggacttcagcctgcccagcagcagcagctacagctacagaagaaagctgaccaaccccgccaacaaggaggagagcatccccttccacttccagatggagaagcaggtgatccacgccgagatccagaccctgggccactggatggacgccaccttcaacatcaagaccgccttccactgctacggcgcctgccagaagtacagctacccctggcagaccgccaagtgcttcttcgagaaggactaccagtacgagaccggctggggctgcaaccccggcgactgccccggcgtgggcaccggctgcaccgcctgcggcgtgtacctggacaagctgaagagcgtgggcaaggcctacaagatcatcagcctgaagtacaccagaaaggtgtgcatccagctgggcaccgagcagacctgcaagcacatcgacgccaacgactgcctggtgacccccagcgtgaaggtgtgcatcgtgggcaccgtgagcaagctgcagcccagcgacaccctgctgttcctgggccccctggagcagggcggcatcatcctgaagcagtggtggaccaccagctgcgccttcggcgaccccggcgacatcatgagcaccaccagcggcatgagatgccccgagcacaccggcagcttcagaaagatctgcggcttcgccaccacccccgtgtgcgagtaccagggcaacaccatcagcggctacaagagaatgatggccaccaaggacagcttccagagcttcaacctgaccgacccccacatcaccaccaacaagctggagtggatcgaccccgacggcaacaccagagaccacgtgaacctggtgctgaacagagacgtgagcttccaggacctgagcgacaacccctgcaaggtggacctgcacacccaggccatcgagggcgcctggggcagcggcgtgggcttcaccctgacctgcaccgtgggcctgaccgagtgccccagcttcatgaccagcatcaaggcctgcgacctggccatgtgctacggcagcaccgtgaccaacctggccagaggcagcaacaccgtgaaggtggtgggcaagggcggccacagcggcagcagcttcaagtgctgccacgacaccgactgcagcagcgagggcctggtggccagcgccccccacctggagagagtgaccggcttcaaccagatcgacagcgacaaggtgtacgacgacggcgcccccccctgcaccttcagatgctggttcaccaagagcggcgagtggctgctgggcatcctgaacggcaactggatcgtggtggtggtgctgatcgtggtgctgatcttcagcatcgtgctgttcagcatcctgtgccccagaagaggccacaagaaggccgtgtga

SEQ ID NO: 8370 - RNA, 3426 nt, synthetic construct
  misc_feature 1..3426: note = derived and/or modified CDS sequence (opt4) from BCCV__L39950.1__GP
  source 1..3426: mol_type = other RNA
atgggcagactgtacctgatcgtgctgggcgtgctgatcaccgccaccgccggcttccccagaagcgtgcacgagctgaagatcgagtgcccccacaccgtggtgctgggccagggctacgtgaccggcagcgtggagctgggcttcatcgccctggaccaggtgaccgacctgaagatcgagagcagctgcagcttcgaccaccacgccgcccccaccaccacccagaacttcacccagctgaagtgggccaagaccgccagcaccaccgacaccaccaacgccgccgagaccaccttcgagagcaagagcaccgaggtgcacctgaagggcgtgtgcaccatccccagcaacgtgctggacggccccagcagacccgtgaccggcagaaagaccgtggtgtgctacgacctggcctgcaaccagacccactgccagcccaccgtgcacctgctggcccccatccagacctgcatgagcgtgagaagctgcatgatcagcctgctggccagcagaatccaggtggtgtacgagaagacctactgcgtgaccggccagctgatcgagggcctgtgcttcaaccccgtgcccaacctggccctgacccagcccggccacacctacgacaccttcaccctgcccatcacctgcttcctggtggccaagaagggcgccaacctgaagatcgccgtggagctggagaagctgaccaccaagaccggctgcgccgagaacgccctgcaggcctactacatctgcttcatcggccagcacagcgagcccctgaccgtgcccatgctggaggactacagaagcgccgagatcttcaccagaatcatgatgaaccccaagggcgaggaccacgacatggagcagagcagccagggcgccctgagaatcgtgggccccatcaagggcaaggtgccccccaccgagaccagcgacaccgtgcagggcatcgccttcgccggcctgcccatgtacagcagcttcagcagcctggtgagaaaggccgagcccgagtacctgttcagccccggcatcatcgccgagagcaaccacagcagctgcgacaagaagaccctgcccctgacctggagaggcttcctgagcatgagcggcgagatcgagagaatcaccggctgcaacgtgttctgcaccctggccggccccggcgccagctgcgaggcctacagcgagaacggcatcttcaacatcagcagccccacctgcctggtgaacaaggtgcagaagttcagaggcagcgagcagagaatcaacttcatcagccagagaatcgaccaggacgtgatcgtgtactgcaacggccagaagaaggtgatcctgaccaagaccctggtgatcggccagtgcatctacaccttcaccagcatcttcagcctgatccccagcgtggcccacagcctggccgtggagctgtgcgtgcccggcatccacggctgggccaccatcgccctggtgatcaccttctgcttcggctggctgctgatccccaccaccaccatggtggtgctgaagtgcctgagactgctgacctacagctgcagccactacagcaccgagagcaagttcaaggtgatcctggagaaggtgaaggtggagtaccagaagaccatgggcagcatggtgtgcgacatctgccaccacgagtgcgagaccgccaaggagctggagagccacaagaagagctgcgccgacggccagtgcccctactgcatgaccatcaccgaggccaccgagagcgccctgcaggcccactacgccgtgtgcaagctgaccggcagattccacgaggccctgaagaagagcctgaagaagcccgaggtgcagagaggctgctacagaaccctgggcgtgttcagatacaagagcagatgctacgtgggcctggtgtggatgtgcctgctgaccctggagctgatcgtgtgggccgccagcgccgacacccccctgctggagcccggctggagcgacaccgcccacggcgtgggcgacatccccatgaagaccgacctggagctggacttcgccatccccagcagcagcagctacagctacagaagaagactggtgaaccccgccaacagcgacgagaccgtgcccttccacttccagctggagagacaggtgatccacgccgagatccagagcctgggccactggatggacgccaccttcaacatcatcagcgccttccactgctacggcgagtgcaagaagtacagctacccctggcagaccgccaagtgcttcttcgagaaggactaccagtacgagaccagctggagctgcaacccccccgactgccccggcgtgggcaccggctgcaccgcctgcggcatctacctggacaagctgaagagcgtgggcaaggcctacaaggtgatcaccctgaagtacgccagaaaggtgtgcatccagctgggcaccgagcagacctgcaagaacatcgacgtgaacgactgcctggtgaccagcagcatcaaggtgtgcatgatcggcaccatcagcaagttccagcccggcgacaccctgctgttcctgggccccctggaggagggcggcctggtgctgaagcagtggtgcaccaccacctgcagcttcggcgaccccggcgacatcatgagcaccaccagcggcatgagatgccccgagcacaccggcagcttcagaaagatctgcggcttcgccaccacccccgtgtgcgagtaccagggcaacaccgtgagcggcttcaagagactgatggccaccaaggacagcttccagagcttcaacgtgagcgaggtgcacatcaccaccaccaagctggagtggagcgaccccgacagcaacatcaaggaccacatcaacctgatcctgaacagagacgtgagcttccaggacctgagcgacaacccctgcaaggtggacctgagcacccaggccatcgacggcgcctggggcagcggcgtgggcttcaccctgacctgcatcgtgggcctgaccgagtgcagcagcttcatgaccagcatcaaggtgtgcgacatggccatgtgctacggcgccagcgtggtgaacctggtgagaggcagcaacaccgtgaagatcgtgggcaagggcggccacagcggcagcaccttcagatgctgccacgacaaggactgcaccagcaacggcctgctggccagcgccccccacctggagagagtgaccggcttcaaccagatcgacagcgacaaggtgtacgacgacggcgcccccccctgcagcatcaagtgctggttcgccaagagcggcgagtggctgctgggcatcctgaacggcaactgggtggtggtggccgtgctggtgatcatcctgctgatcagcatcttcctgttcagcttcttctgccccatcagaagccacaagaagcagctgtga

SEQ ID NO: 8371 - RNA, 3408 nt, synthetic construct
  misc_feature 1..3408: note = derived and/or modified CDS sequence (opt4) from DOBV(DOBV/Ano-Poroia/Afl9/1999)__NC_005234.1__GP
  source 1..3408: mol_type = other RNA
atgatcatgtggggcctgctgctgaccatgatcctgatcgacttcggcgccagcctgagaaacgtgtacgacatgaagatcgagtgcccccacagcatcaacttcggcgagagcagcgtgaccggcaaggtggagctgccccccctgctgctgaccgacgccgaggccctggtgcccgagagcagctgcaacatggacaaccaccagagcatgagcatcatccagaaggtgaccaaggtgagctggagaaagaaggccgacaaggcccaggccgccaaggacagcttcgagaccaccagcagcgaggtgaacctgaagggcacctgcgccctgagccacagaatggtggaggagagctacagaaacagaagaagcgtgatctgctacgacctgagctgcaacagcacccactgcaagcccaccatgcacatgatcgtgcccgtgcacagctgcaacatgatgaagagctgcctggtgggcctgggcccctacagaatccagatcgtgtacgagagaacctactgcaccaccggcatcctgaccgagggcaagtgcttcgtgcccgaccagagcatcgtgaacgtgatcaagaacggcgtgttcgacatcgccagcgtgagcatcgtgtgcttcttcatcagagtgaagggcaccaactacaagatcatggccagcatcaagaccgccaccgccaacaactgcaacgacaccgacaacaaggtgcagggctactacctgtgcatcgtgggcggcaacagcagccccgtgtacgcccccagcaccaccgacttcagaagcatggaggccctggccagcctgctgagagccccccacggcgaggaccacgacctgagcggcgaggaggtggccacctacagcatcgccggccagatcgagggcaagatcccccacaccgccaacgccgccaacatgctgttcaccgccttcagcggcatccccagctacagcagcctgagcgtgttcatcggcagccaggacggccccgtgatctacagccccggcctgttccccagactgaaccagagcagctgcgacaagatcgccctgcccctgatctgggagggctacatcgacctgcccggctactacgagaccgtgcacccctgcaacgtgttctgcgtgctgagcggccccggcgccagctgcgaggccttcagcgagggcggcatcttcaacatcaccagccccacctgcctggtgagcaagcagaacagattcagagccgccgagcagcaggtgaacttcgtgtgccagagagtggaccaggacatcgtgatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatcctgagcatcaccctggccgtgctggtggtgctgaagttcttcgccgccatcctgcacaacagcagccaggagaacagattcaagatcatcctgagaaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagcccaccgagagcgccttccaggcccactacaaggtgtgccaggccacccacagattcagagacgacctgaagaagaccatcaccccccagagcaccagccccggctgctacagaaccctgaacctgttcagatacaagagcagatgctacatcttcaccgtgtgggtgaccctgctgatcatcgagagcatcatgtgggccgccagcgccagcgagaccgtgctggagcccagctggaacgacaacgcccacggcgtgggcgtggtgcccatgcacaccgacctggagctggacttcagcctgcccagcagcagcaagtacacctacaagagaaagctgaccagccccctgaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacaactggggctgcaaccccgccgactgccccggcatcggcaccggctgcaccgcctgcggcctgtacatcgaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccagcacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccagagcttcaacaccagcagcatccactacaccgacgagagaatcgagtggaaggaccccgacggcatgctgaaggaccacctgaacatcctggtgaccaaggacatcgacttcgagaacctgggcgagaacccctgcaaggtgggcctgcagaccagcagcatcgagggcgcctggggcagcggcgtgggcttcaccctgacctgccagatcagcctgaccgagtgcagcagattcctgaccagcatcaaggcctgcgacatggccatctgctacggcgcccagagcgtgaccctgatcagaggccagaacaccgtgaaggtgagcggcaagggcggccacagcggcagcagcttcaagtgctgccacggcaccgactgcagccagcagggcctgcaggccagcgccccccacctggacaaggtgaacggcatcgtggagcaggagagcgagaaggtgtacgacgacggcgccccccagtgcggcatcagctgctggttcgtgaagagcggcgagtggatcaccggcatcttcaacggcaactggatcgtgatcgtggtgctggtgttcttcttcatcctgagcctgatcctgctgagcctgctgtgccccatcagaaagcacaagagaagctga
